US010524471B2

(12) United States Patent
Hirt et al.

(10) Patent No.: US 10,524,471 B2
(45) Date of Patent: Jan. 7, 2020

(54) COMPOSITIONS AND METHODS FOR INCREASING SALT TOLERANCE IN PLANTS

(71) Applicant: King Abdullah University of Science and Technology, Thuwal (SA)

(72) Inventors: Heribert Hirt, Thuwal (SA); Axel de Zelicourt, Thuwal (SA); Maged Saad, Thuwal (SA)

(73) Assignee: King Abdullah University of Science and Technology, Thuwai (SA)

( * ) Notice: Subject to any disclaimer, the term of this patent is extended or adjusted under 35 U.S.C. 154(b) by 0 days.

(21) Appl. No.: 16/048,142

(22) Filed: Jul. 27, 2018

(65) Prior Publication Data

US 2018/0338493 A1    Nov. 29, 2018

Related U.S. Application Data

(63) Continuation-in-part of application No. 16/072,137, filed as application No. PCT/IB2017/050314 on Jan. 20, 2017.

(60) Provisional application No. 62/630,013, filed on Feb. 13, 2018, provisional application No. 62/281,404, filed on Jan. 21, 2016.

(51) Int. Cl.
*A01N 25/02* (2006.01)
*A01N 37/42* (2006.01)
*A01N 63/00* (2006.01)

(52) U.S. Cl.
CPC ............. *A01N 37/42* (2013.01); *A01N 25/02* (2013.01); *A01N 63/00* (2013.01)

(58) Field of Classification Search
None
See application file for complete search history.

(56) References Cited

U.S. PATENT DOCUMENTS

2015/0373993 A1    12/2015  Von Maltzahn

FOREIGN PATENT DOCUMENTS

| CA | 2953466 | | 12/2015 |
| JP | 51446766 | * | 11/1979 |
| JP | 5702081 | * | 4/1982 |
| WO | 2015091967 | | 6/2015 |
| WO | 2017125894 | | 7/2017 |

OTHER PUBLICATIONS

Sunaina et al.(Bacterial Metabolites from Bacillus Cereus B4 Responsible for Potato Plant Growth(Potato J. 32(3-4): 167-188, 2005). (Year: 2005).*
Arshad et al., Kinetics and effects of trace elements and electron complexes on 2-keto-4-methylthiobutyric acid-dependent biosynthesis of ethylene in soil, Letters in Applied Microbiology (2004), vol. 39, No. 3, pp. 306-309, 20 refs. (Year: 2004).*
Martensson, J., The occurrence of 4-methylthio-2-hydroxybutyrate in human urine, Analytical Biochemistry, (1986) vol. 154, No. 1, pp. 43-49. (Year: 1986).*
Andres-Barrao, et al., "Complete Genome Sequence Analysis of *Enterobacter* sp. SA187, a Plant Multi-Stress Tolerance Promoting Endophytic Bacterium", Front Microbiol, 8:1-21 (2017).
Bolger, et al., "Trimmomatic: a flexible trimmer for Illumina sequence data", Bioinformatics, 30:2114-2120 (2014).
Chen, et al. "Application of Plant growth-promoting endophytes (PGPE) isolated from *Solanum nugrum* L. for phytoextraction of Cd-polluted soils", Apl. Soil Ecol., 46(3):383-389 (2010).
Coleman-Derr, et al., "Building the crops of tomorrow: advantages of symbiont-based approaches to improving abiotic stress tolerance", Front Microbiol., 5:283 (2014).
de Zelicourt, "Rhizosphere microbes as essential partners for plant stress tolerance", et al., Mol Plant, 6:242-245 (2013)).
Deinlein, et al., "Plant salt-tolerance mechanisms", Trends Plant Sci, 19:371-379 (2014).
Eckert, et al., "Ethylene-forming enzyme and bioethylene production", Biotechnol Biofuels, 7:33 (2014).
Gao, et al., "Symbiotic adaptation drives genome streamlining of the cyanobacterial sponge symbiont *Candidatus Synechococcus spongiarum*", MBio, 5(2)e0079-14, (2014).
Glick, et al., "Plant Growth-Promoting Bacteria: Mechanisms and Applications", Scientifica, 2012:1-15 (2012).
Guzmán, et al., "Exploiting the triple response of *Arabidopsis* to identify ethylene-related mutants", Plant Cell, 2:513-523 (1990).
Han, et al., "Beneficial soil bacterium *Bacillus subtilis* (GB03) augments salt tolerance of white clover", Front Plant Sci, 5:525 (2014).
Hanin et al., "New Insights on Plant Salt Tolerance Mechanisms and Their Potential Use for Breeding", Front Plant Sci., 7:1-17 (2016).
Hossain, et al., "One-step biosynthesis of α-keto-γ-methylthiobutyric acid from L-methionine by an *Escherichia coli* whole-cell biocatalyst expressing an engineered L-amino acid deaminase from Proteus vulgaris", PLOS One, 9(12):e114291 (2014).
Kaplan, et al., "A survey of the microbial community in the rhizosphere of two dominant shrubs of the Negev Desert highlands, *Zygophyllum dumosum* (*Zygophyllaceae*) and *Atriplex halimus* (*Amaranthaceae*), using cultivation-dependent and cultivation-independent methods", Am J Bot, 100:1713-1725 (2013).
Karlidag, et al., "Plant Growth-promoting Rhizobacteria Mitigate Deleterious Effects of Salt Stress on Strawberry Plants (*Fragaria ×ananassa*)", Hortic Sci, 48:563-567 (2013).
Konishi and Yanagisawa, ",Ethylene signaling in *Arabidopsis* involves feedback regulation via the elaborate control of EBF2 expression by EIN3", Plant J, 55:821-831 (2008).

(Continued)

Primary Examiner — Alton N Pryor
(74) Attorney, Agent, or Firm — Pabst Patent Group LLP

(57) ABSTRACT

Methods and compositions for increasing tolerance to abiotic stresses in plants are provided. One embodiment provides a method for increasing salt tolerance in a plant by treating the plant with an amount of 2-keto-4-methylthio-butyric acid (KMBA) effective to increase salt tolerance in the plant relative to an untreated plant. Typically KMBA is in an aqueous solution used to irrigate the plant, seed, or seedling. In a preferred embodiment, the aqueous solution is a salt solution, including but not limited to seawater. The KMBA is typically present in the aqueous solution at 1.0 to 250 nM, preferably at least 100 nM.

26 Claims, 13 Drawing Sheets

Specification includes a Sequence Listing.

(56) References Cited

OTHER PUBLICATIONS

Lafi, et al., "Draft Genome Sequence of the Plant Growth—Promoting Rhizobacterium Acinetobacter radioresistens Strain SA188 Isolated from the Desert Plant *Indigofera argentea*", Genome Announc, 9-10 (2017).

Marasco, et al., "A drought resistance-promoting microbiome is selected by root system under desert farming", PLoS One, 7:e48479 (2012).

Nadeem, et al., "Variation in growth and ion uptake of maize due to inoculation with plant growth promoting rhizobacteria under salt stress", Microbiology, 25:78-84 (2006).

Negrao et al., "Evaluating physiological responses of plants to salinity stress", Ann Bot, 119:1-11 (2017).

Park et al., "Abscisic acid inhibits type 2C protein phosphatases via the PYR/PYL family of START proteins", Science, 324:1068-1071 (2009).

Rifat, et al., "Soil beneficial bacteria and their role in plant growth promotion: a review", Annals of Microbiol., 60(4):579-598 (2010).

Schwartz, et al., "Biochemical characterization of the aba2 and aba3 mutants in *Arabidopsis thaliana*", Plant Physiol, 114 :161-166 (1997).

Shabala, et al., "Learning from halophytes: physiological basis and strategies to improve abiotic stress tolerance in crops", Ann Bot, 112:1209-1221 (2013).

Staswick, et al., "Methyl jasmonate inhibition of root growth and induction of a leaf protein are decreased in an *Arabidopsis thaliana* mutant", Proc Natl Acad Sci USA, 89 :6837-6840 (1992).

Sun, et al., "Potassium Retention under Salt Stress Is Associated with Natural Variation in Salinity Tolerance among *Arabidopsis Accessions*", PLoS One, 10:e0124032 (2015).

Trapnell, et al., "Transcript assembly and quantification by RNA-Seq reveals unannotated transcripts and isoform switching during cell differentiation", Nat Biotechnol, 28:511-515 (2010).

Zhang, et al., "Soil bacteria confer plant salt tolerance by tissue-specific regulation of the sodium transporter HKT1", Mol Plant-Microbe Interact, 21:737-744 (2008).

\* cited by examiner

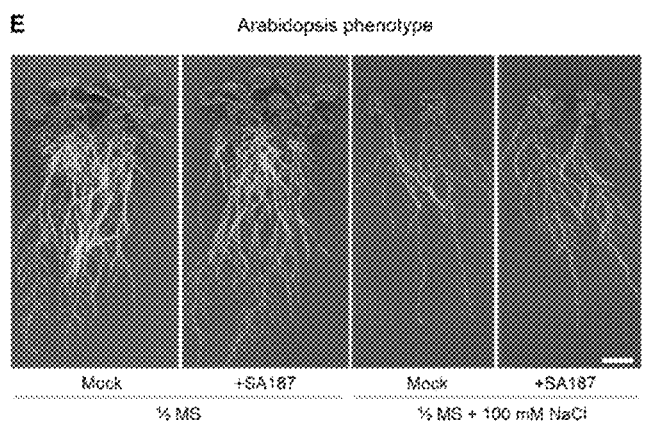
FIG. 2E
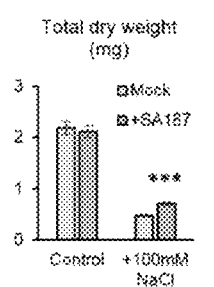 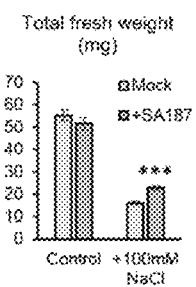 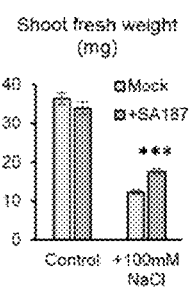 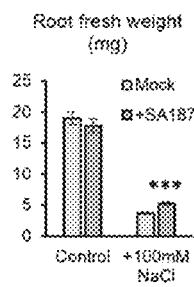 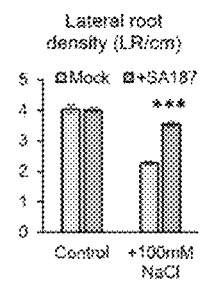
FIG. 2F　　FIG. 2G　　FIG. 2H　　FIG. 2I　　FIG. 2J

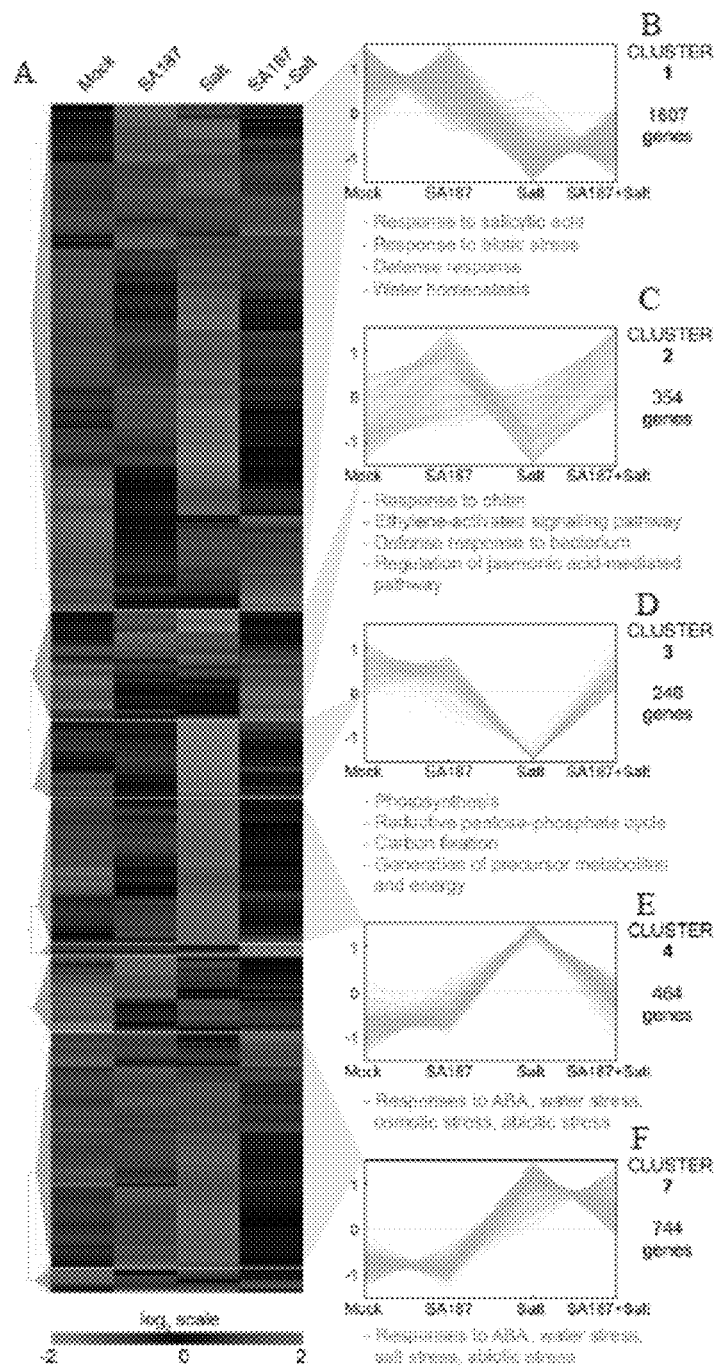
FIG. 4A-F

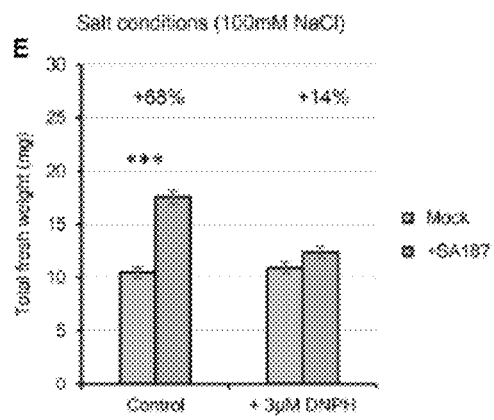
FIG. 7E
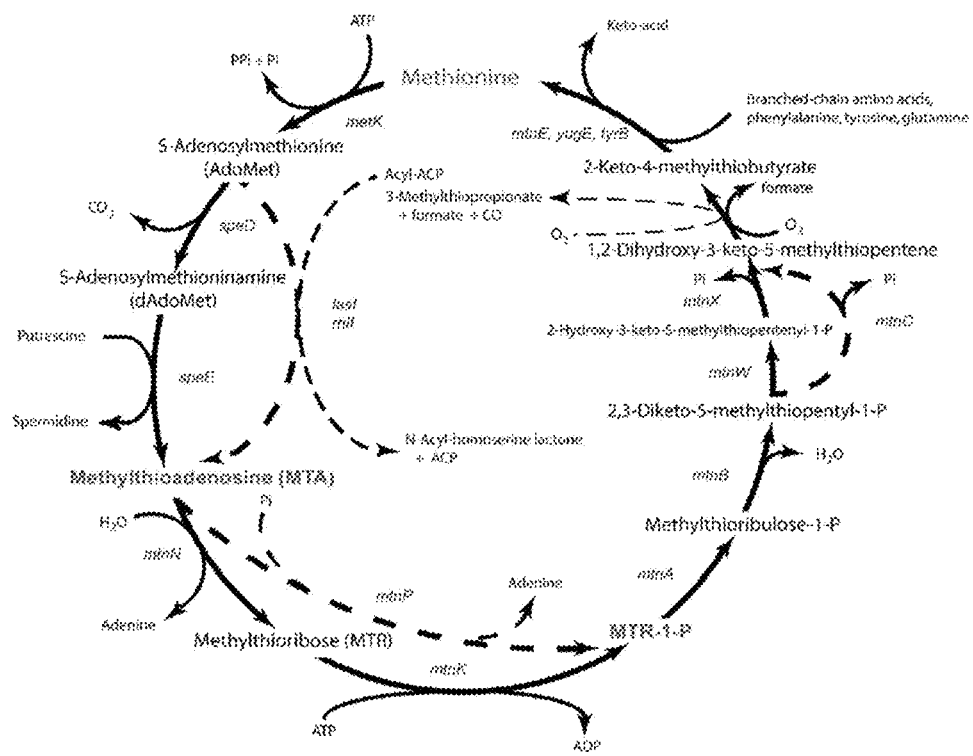
FIG. 7F (adapted from Sekowsak et al., BMC Microbiol., 4:9 (2004)

COMPOSITIONS AND METHODS FOR INCREASING SALT TOLERANCE IN PLANTS

CROSS-REFERENCE TO RELATED APPLICATIONS

This application claims the benefit and priority of U.S. Provisional Patent Application No. 62/630,013 filed on Feb. 13, 2018, and is a continuation-in part of U.S. Ser. No. 16/072,137 filed on Jul. 23, 2018, which is a National Phase application under 35 U.S.C. § 371 of International Application No. PCT/IB2017/050314, filed on Jan. 20, 2017, entitled "COMPOSITIONS AND METHODS FOR PROVIDING PLANTS WITH TOLERANCE TO ABIOTIC STRESS CONDITIONS", which claims benefit of and priority to U.S. Provisional Patent Application No. 62/281,404 filed on Jan. 21, 2016, and are incorporated herein in their entirety.

FIELD OF THE INVENTION

The invention is generally directed to plant cultivation under abiotic stress conditions.

REFERENCE TO SEQUENCE LISTING

The Sequence Listing submitted Jul. 27, 2018, as a text file named "KAUST_2018_114_02_ST25.txt" created on Jul. 27, 2018, and having a size of 5,507,846 bytes is hereby incorporated by reference pursuant to 37 C.F.R. § 1.52(e)(5).

BACKGROUND OF THE INVENTION

Plants as sessile organisms are facing multiple stresses during their lifetime. Among them, abiotic stresses, such as salt stress, can cause severe crop yield reduction, leading to food security issues in many regions of the world. In order to respond to growing food demands, especially in the context of global climate change and an increasing world population, it then becomes urgent to develop new strategies to generate more tolerant crops to abiotic stresses.

Therefore it is an object of the invention to provide compositions and methods for increasing tolerance in plants to abiotic stresses.

It is another object of the invention to provide seed coating compositions that provide plants with resistance or tolerance to abiotic stress conditions.

It is still another object to provide methods for growing plants under abiotic stress conditions.

SUMMARY OF THE INVENTION

Methods and compositions for increasing tolerance to abiotic stresses in plants are provided. The methods include providing the plant with 2-keto-4-methylthiobutyric acid (KMBA) exogenously ("exogenous KMBA method), alone or in combination with modifying the plant with a microbial system that results in production of KMBA in the plant ("endogenous KMBA method"). The exogenous KMBA method include treating seeds, seedlings or mature plants with 2-keto-4-methylthiobutyric acid (KMBA). The exogenous KMBA method in one increases salt tolerance in a plant by treating the plant with an amount of KMBA) effective to increase salt tolerance in the plant relative to an untreated plant. Typically KMBA is in an aqueous solution used to irrigate the plant, seed, or seedling. In a preferred embodiment, the aqueous solution is a salt solution, including but not limited to seawater. The KMBA is typically present in the aqueous solution at 1.0 to 250 nM, preferably at least 100 nM.

Another embodiment provides cultivating a plant in sodic soil by irrigating the plant, seed, or seedling in the sodic soil with a aqueous solution containing 1.0 to 250 nM KMBA. The aqueous solution is typically water. The water can be rainwater, wellwater, or water from natural sources such as rain, lakes, glaciers, rivers, and streams.

When KMBA is combined with a salt solution, the salt is can be from 1.0 to 10% (w/v) salt. In a preferred embodiment, the salt solution is about 3.5% salt. The salt solution can contain salts of sodium, chloride, sulfates, magnesium, calcium, potassium, and combinations thereof.

Another embodiment provides a method for cultivating a plant by planting seeds or seedlings of the plant and irrigating the seeds or seedlings with a saline solution comprising KMBA. The plant can be an agricultural crop plant or a forage crop plant. Representative plants include but are not limited to rice, wheat, sugarcane, maize, soybean, cotton, vegetables, rape, mustard, sorghum, millet, grass, *Brassica* spp., rapeseed, barley, hay, and alfalfa.

Still another embodiment provides a method of increasing tolerance to abiotic stress in a plant by treating the plant with a composition containing an effective amount of KMBA to increase tolerance to the abiotic stress. In certain embodiments, the abiotic stress is due to water salinity, soil salinity, or both. The KMBA can be present at a concentration of 1.0 to 250 nM, preferably 100 nM Yet another embodiment provides an irrigation solution containing 1.0 to 250 nM KMBA in an aqueous saline solution. The aqueous saline solution typically contains 1 to 10% salt (w/v). The aqueous solution is preferably seawater.

The endgenous KMBA method providing seeds, seedlings or mature plants with a microbial system that results in production of KMBA in mature plants. In some embodiments, seeds or plant roots can be inoculated with or coated with a microbial system that results in production of KMBA in mature plants. A preferred microbial system *Enterobacter* sp. SA187. In other embodiments, seeds, seedling and plants can be grown using substrates containing an effective amount of *Enterobacter* sp. SA187 to inhibit or reduce abiotic stress in the plant. Suitable plant substrates include, but are not limited to soil, peat, compost, vermiculite, perlite, sand, clay and combinations thereof.

Another embodiment provides a bacterium genetically engineered to express KMBA or increased levels of KMBA relative to an unmodified bacterium, which can be used as a a microbial system that results in production of KMBA in mature plants. In a preferred embodiment the bacterium is an endophytic bacterium. The engineered bacterium can be used to inoculate plants and increase tolerance in the plant to abiotic stress conditions.

BRIEF DESCRIPTION OF THE DRAWINGS

FIGS. 1A and 1D are bar graphs showing plant height (cm) of alfalfa plants inoculated with mock (gray bar) and SA187 (green bar) and subjected to low or high saline conditions. FIGS. 1B and 1E are bar graphs showing fresh weight (tons/ha) of alfalfa plants inoculated with mock (gray bar) and SA187 (green bar) and subjected to low or high saline conditions. FIGS. 1C and 1F are bar graphs showing dry weight (tons/ha) of alfalfa plants inoculated with mock (gray bar) and SA187 (green bar) and subjected to low and high saline conditions. Data from the first season (FIGS. 1A, 1B, 1C) and second season (FIGS. 1D, 1E, 1F) are displayed; each column represents a mean of 3 harvests from 4 experimental plots error bars are SE. An increase of each parameter for SA187-treated plants related to Mock is indicated in %. Asterisks indicate a statistical difference (* P<0.05;  P<0.01, * P<0.001).

FIGS. 2A-2J show that SA187 enhances *Arabidopsis* tolerance to salt stress. FIG. 2A is a bar graph that shows germination efficiency on ½ MS medium without (mock) or with SA187 (+SA187) (n>300, 3 biological replicates, bars represent SE). FIG. 2B is a bar graph that shows average root hair length (μm) of 10% longest root hairs (n>70) in 5-day-old seedlings grown vertically on ½ MS medium without (mock) or with SA187. Error bars represent SE. FIG. 2C is a representative image showing typical root hair morphology of 5-day-old seedlings used for the analysis in FIG. 2B. Scale bar represents 200 μm. FIG. 2D is a line graph showing root length (cm) over time in SA187-inoculated (upper solid line) or mock-treated (lower solid line) *Arabidopsis* seedlings after transfer of 5-day-old seedlings from ½ MS to ½ MS with or without 100 mM NaCl (dashed lines) (n=60). Error bars represent SE. FIG. 2E are representative images of SA187-colonized 17-day-old plants showing enhanced growth under salt stress (½ MS+100 mM NaCl) but negligible differences under normal conditions (½ MS). Scale bar represents 1 cm. FIGS. 2F-2J are bar graphs showing (FIG. 2F) total plant dry weight (mg), (FIG. 2G) total plant fresh weight (mg), (FIG. 2H) shoot fresh weight (mg), and (I) root fresh weight (mg) of 17-day-old seedlings and (FIG. 2J) lateral root density of 13-day-old seedlings inoculated by SA187 (green bar) or mock-treated (gray bar) transferred 5 days after germination from ½ MS to ½ MS with or without 100 mM NaCl. All plots represent the mean of three biological replicates (n>39). Error bars represent SE. Asterisks indicate a statistical difference based on the Student t-test (* P<0.05;  P<0.01; * P<0.001).

FIGS. 3A-3C are bar graphs showing (FIG. 3A) shoot Na+ content, (FIG. 3B) shoot K+ content, and (FIG. 3C) shoot Na+/K+ ratio of 17-day-old mock- (gray bar) or SA187- (green bar) inoculated *Arabidopsis* seedlings exposed for 12 days to ½ MS with or without 100 mM NaCl {48>n>36}. FIGS. 3D-3F are bar graphs showing (FIG. 3D) root Na+ content, (FIG. 3E) root K+ content, and (FIG. 3F) root Na+/K+ ratio of 17-day-old mock- (gray bar) or SA187- (green bar) inoculated *Arabidopsis* seedlings exposed for 12 days to ½ MS with or without 100 mM NaCl (48>n>12). All plots represent the mean of three biological replicates, and error bars represent SE. Asterisks indicate a statistical difference based on Mann-Whitney test (* P<0.05;  P<0.01, * P<0.001).

FIGS. 4A-4F shows transcriptome analysis of *Arabidopsis* response to SA187. FIG. 4A is a heat map showing response of genes in *Arabidopsis* seedlings in response to SA187, salt (100 mM NaCl) or both treatments based on the RNA-Seq analysis. Heat map colors indicate expression levels. FIGS. 4B-4F are hierarchical clustering of up- and down-regulated genes from the RNA-Seq analysis. For every gene, FPKM values were normalized. For the most relevant clusters, gene families significantly enriched are indicated based on gene ontology.

FIGS. 7D and 7E are bar graphs showing total fresh weight of mock- (gray bars) and SA187- (green bars) inoculated 17-day-old *Arabidopsis* seedlings grown on ½ MS medium (FIG. 7D) or ½ MS with 100 mM NaCl (FIG. 7E) supplemented with 3 μM DNPH. All plots represent the mean of four biological replicates (n>75). Error bars representing SE, beneficial index(%) is displayed above. Asterisks indicate a statistical difference based on Student t-test (*** P<0.001). FIG. 7F shows the methionine salvage pathway.

DETAILED DESCRIPTION OF THE INVENTION

I. Definitions

Figure 1A:
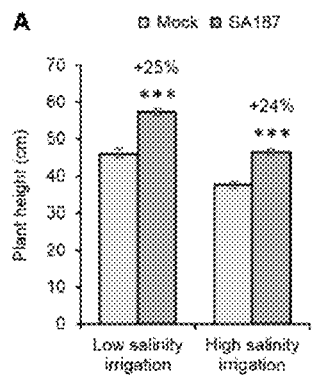
FIGS. 1A-1F show growth parameters of alfalfa in field trials.
Figure 1B:
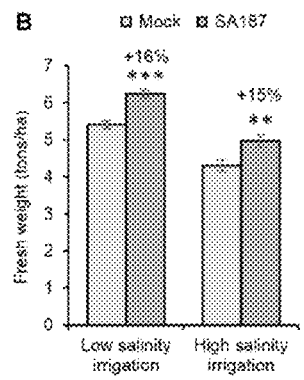
Figure 1C:
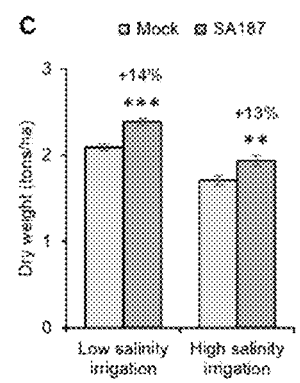

The use of the terms "a," "an," "the," and similar referents in the context of describing the presently claimed invention (especially in the context of the claims) are to be construed to cover both the singular and the plural, unless otherwise indicated herein or clearly contradicted by context.

Recitation of ranges of values herein are merely intended to serve as a shorthand method of referring individually to each separate value falling within the range, unless otherwise indicated herein, and each separate value is incorporated into the specification as if it were individually recited herein.

Use of the term "about" is intended to describe values either above or below the stated value in a range of approx. +/−10%; in other embodiments the values may range in value either above or below the stated value in a range of approx. +/−5%; in other embodiments the values may range in value either above or below the stated value in a range of approx. +/−2%; in other embodiments the values may range in value either above or below the stated value in a range of approx. +/−1%. The preceding ranges are intended to be made clear by context, and no further limitation is implied. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

The term "plant" refers to the entire plant, seeds of the plant, and seedlings of the plant.

As used herein, "abiotic stress" refers to negative impact of non-living factors on living organisms within the specific environment of the organism. Exemplary abiotic stress conditions include, but are not limited to drought, high heat, high salt, bright light, ultraviolet light, too high and too low temperatures, freezing, heavy metals and hypoxia. Abiotic stresses like salinity, drought or heat negatively affect plant growth and yield and belong to the most limiting factors of agriculture worldwide (Wang et al., *Planta*, 218:1-14 (2003); Zurbriggen et al., *Biotechnol Genet Eng Rev*, 27:33-56 (2010)). For example, salinity, known to affect almost one fourth of arable land globally, is a two-phase stress composed of a rapid osmotic stress and a slower toxic one, resulting from $Na^+$ ions accumulation and loss of $K^+$ in photosynthetic tissues (Negrao et al., *Ann Bot*, 119:1-11 (2017)). Salt stress reduces the rate of photosynthesis, leading to a decrease of plant growth and crop yield (Hanin et al., *Front Plant Sci.*, 7:1-17 (2016)). However, in the context of global climate change and an increasing world population, abiotic stress tolerant crops and sustainable solutions in agriculture are urgently needed to respond to growing food demands (Coleman-Derr, et al., *Front Microbiol.*, 5:283 (2014)).

The effect of salinity on plants includes two components: an osmotic component, being the consequence of an altered osmotic pressure due to an increased salt concentration, and a toxic ion effect as a result of the high $Na^+$ concentration in the shoot (Munns, et al., *Annu Rev Plant Biol*, 59:651-681 (2008); Shabala, et al., *Ann Bot*, 112:1209-1221 (2013)). The toxic effects of $Na^+$ accumulation result in premature senescence, leading to a decrease in photosynthesis efficiency and impaired metabolic processes. $Na^+$ also competes with $K^+$ in membrane transport and enzymatic functions, reducing plant growth. Most plant cells possess mechanisms to counteract the harmful effects of $Na^+$ accumulation by retaining $K^+$ and actively excluding $Na^+$ in roots and/or sequestering $Na^+$ in vacuoles in shoots (Munns, et al., *Annu Rev Plant Biol*, 59:651-681 (2008); Shabala, et al., *Ann Bot*, 112:1209-1221 (2013); Deinlein, et al., *Trends Plant Sci*, 19:371-379 (2014); Sun et al., *PLoS One*, 10:e0124032 (2015)).

Arid regions cover about one quarter of the Earth's land surface and encompass many of the challenges for increasing agricultural productivity (Ezcurra, *UNEP/Earthprint* (2012)). In contrast to better known dryland farming, desert agriculture can function only when crop plants are under irrigation—usually with underground water with various levels of salinity (Cresswell, et al., *Echo* (1998)). Those areas face extreme environmental conditions, characterized by high levels of radiation, low rainfall, extreme temperatures, coarse soil which retains very little moisture, as well as low nutrients and typically high salinity, which all strongly limit the yield of crops (Rewald, et al., *Wallingford: CARI*, 196-218 (2012)). Although deserts appear to be hardly inhabitable, a wide diversity of organisms has adapted to these extreme conditions. Plants along with their interacting microbial partners have evolved sophisticated mechanisms such as production of osmoprotectants, Reactive Oxygen Species scavengers or Late Embryogenesis Abundant proteins to monitor the environment and reprogram their metabolism and development (Chaves, et al., *Ann Bot*, 89:907-916 (2002); Lebre, et al., *Nat Rev Microbiol*, 15:285-296 (2017)). Therefore, this particular environment is an ideal reservoir to isolate and identify beneficial bacteria enhancing plant tolerance towards environmental stresses such as drought, heat or salinity (de Zelicourt, et al., *Mol Plant*, 6:242-245 (2013)).

As used herein, "plant growth promoting bacteria (PGPB)" refers to beneficial bacteria that promote plant growth. PGPB can establish symbiotic associations with plants and promote plant growth under optimal growth conditions or in response to biotic and abiotic stresses (Obledo, et al., *Plant Cell Tissue Organ Cult*, 74:237-241 (2003); Marasco, et al.,*PLoS One*, 7:e48479 (2012); Kaplan, et al., *Am J Bot*, 100:1713-1725 (2013); Mengual, et al., *J Environ Manage*, 134:1-7 (2014); Cherif, et at, *Environ Microbiol Rep*, 7:668-678 (2015); Pieterse, et al., *Annu Rev Phytopathol*, 52:347-375 (2014)). Direct plant growth-promotion mechanisms include the acquisition of nutrients by nitrogen fixation, phosphate and zinc solubilization, or siderophore production for sequestering iron. The modulation of phytohormone levels, such as auxin, ethylene, cytokinin or gibberellin, also largely contributes to the beneficial properties of PGPB (Persello-Cartieaux, et at, *Plant, Cell, Environ*, 26:189-199 (2003); Vessey, *Plant Soil*, 255:571-586 (2003); Hardoim, et al., *Trends Microbiol*, 16:463-471 (2008)). Indirect mechanisms comprise the production of antimicrobial agents against plant pathogenic bacteria or fungi, or inducing systemic resistance against soil-borne pathogens (Pieterse, et al., *Annu Rev Phytopathol*, 52:347-375 (2014); Glick, et al., *Scientifica*, 2012:1-15 (2012)).

Several studies have shown that inoculation of commercial crops, such as maize, strawberry and wheat by PGPBs under salt stress results in a decrease of $Na^+$ and an increase of $K^+$ in their shoots and leaves (Nadeem, et al., *Microbiology*, 25:78-84 (2006); Karlidag, et al., *Hortic Sci*, 48:563-567 (2013); Singh and Jha, *Acta Physiol Plant*, 38:110 (2016)). The inoculation of *A. thaliana* and *Trifolium repens*

(white clover) by *Bacillus subtilis* GB03 induced a decrease in the Na$^+$ content in shoots in both species accompanied by an increase or no change in the K$^+$ content (Zhang, et al., *Mol Plant-Microbe Interact*, 21:737-744 (2008); Han, et al., *Front Plant Sci*, 5:525 (2014)).

As used herein, "*Arabidopsis*" refers to the small flowering plant *Arabidopsis thaliana*. *Arabidopsis* is used as a model system for studying plant sciences, including genetics and plant development.

As used herein, "2-keto-4-methylthiobutyric acid (KMBA)" is an intermediate in the methionine salvage pathway. Oxidation of KMBA in certain bacteria leads to the production of ethylene. KMBA can be spontaneously converted to ethylene by photo-oxidation or through the action of plant peroxidases (Chague, et al., *FEMS Microbiol Ecol*, 40:143-149 (2002)), which are abundantly present in the plant apoplast (Minibayeva, et al., *Phytochemistry*, 112:122-129 (2015); Karkonen, et al., *Phytochemistry*, 112:22-32 (2014)).

The term "plant substrate" refers to a substrate commonly used for growing plants, including plant seeds, plant roots and plant seedlings. Non-limiting examples of such plant substrates include, but are not limited to soil, peat, compost, vermiculite, perlite, sand, clay, and combinations thereof.

As used herein, "sodic soil" refers to soil with a disproportionally high sodium content relative to other salts. Sodic soils are characterized by poor soil structure and low infiltration rate. Additionally, they are poorly aerated and difficult to cultivate.

II. Methods for Increasing Plant Tolerance to Abiotic Stresses

Methods and compositions for increasing tolerance to abiotic stresses in plants are provided. The methods include providing the plant with 2-keto-4-methylthiobutyric acid (KMBA) exogenously ("exogenous KMBA method), alone or in combination with modifying the plant with a microbial system that results in production of KMBA in the plant ("endogenous KMBA method"). The exogenous KMBA method include treating seeds, seedlings or mature plants with 2-keto-4-methylthiobutyric acid (KMBA).

One embodiment provides a method for increasing salt tolerance in a plant by treating the plant with an amount of 2-keto-4-methylthiobutyric acid (KMBA) effective to increase salt tolerance in the plant relative to an untreated plant (exogenous KMBA).

The endgenous KMBA method providing seeds, seedlings or mature plants with a microbial system that results in production of KMBA in mature plants. In some embodiments, seeds or plant roots can be inoculated with or coated with a microbial system that results in production of KMBA in mature plants. A preferred microbial system *Enterobacter* sp. SA187. In other embodiments, seeds, seedling and plants can be grown using substrates containing an effective amount of *Enterobacter* sp. SA187 to inhibit or reduce abiotic stress in the plant. Suitable plant substrates include, but are not limited to soil, peat, compost, vermiculite, perlite, sand, clay and combinations thereof. Some embodiments provides a bacterium genetically engineered to express KMBA or increased levels of KMBA relative to an unmodified bacterium, which can be used as a microbial system that results in production of KMBA in mature plants. In a preferred embodiment the bacterium is an endophytic bacterium. The engineered bacterium can be used to inoculate plants and increase tolerance in the plant to abiotic stress conditions.

In another embodiment, *Enterobacter* sp. SA187 produces 2-keto-4-methylthiobutyric acid (KMBA) in the plant (endogenous KMBA) to promote plant tolerance to salt stress.

Still another embodiment includes a combination of endogenous and exogenous KMBA treatment.

In some embodiments, the methods include providing the plant with one or more additional plant-growth promoting bacteria and/or one or more plant growth-promoting rhizobacteria.

A. Exogenous 2-Keto-4-methylthiobutyric Acid (KMBA) Method

Methods for increasing salt tolerance in a plant by treating the plant with an amount of KMBA effective to increase salt tolerance in the plant are provided. In one embodiment, KMBA can be delivered to mature plants. In other embodiments, KMBA can be used to irrigate seeds or seedlings. The plant can be treated with KMBA or KMBA in a solution.

In some embodiments, the amount of KMBA used to treat a plant is at a concentration of 1.0 to 250 nM. The concentration of KMBA can be 1, 5, 10, 20, 30, 40, 50, 60, 70, 80, 90, 100, 125, 150, 175, 200, 225, or 250 nM. In a preferred embodiment, KMBA is present at a concentration of at least 100 nM.

One embodiment provides a method for increasing plant tolerance to abiotic stress by treating the plant with a composition containing an effective amount of KMBA. Exemplary abiotic stress conditions include, but are not limited to drought, high heat, high salt, bright light, ultraviolet light, too high and too low temperatures, freezing, heavy metals and hypoxia. In one embodiment, the abiotic stress can be water salinity, soil salinity, or both.

In one embodiment, plants are treated with an amount of KMBA effective to increase salt tolerance in the plant. The KMBA can be delivered to the plant in solution. In one embodiment, KMBA is delivered in an aqueous solution. The aqueous solution can be water, salt water, or seawater.

Some embodiments provide a method of delivering KMBA to plants in a solution. The solution can contain 1-10% salt. In some embodiments the solution contains 1.5%, 2%, 2.5%, 3%, 3.5%, 4%, 4.5%, 5%, 5.5%, 6%, 6.5%, 7%, 7.5%, 8%, 8.5%, 9%, or 9.5% salt. In a preferred embodiment, the solution contains 3.5% salt. The salt can be selected from the group containing salts of sodium, chloride, sulfate, magnesium, calcium, potassium, or combinations thereof.

B. Edogenous 2-Keto-4-methylthiobutyric Acid (KMBA) Method

*Enterobacter* sp. SA187 is a bacterium that was previously isolated from the desert pioneer plant *Indigofera argentea* Burm.f. (Fabaceae) (Lafi, et al., *Genome Announc*, 9-10 (2017); Andrés-Barrao, et al., *Front Microbiol*, 8:1-21 (2017)). SA187 was deposited on Sep. 24, 2019, with American Type Culture Collection (ATCC), P.O. Box 1549, Manassas, Va. 20110 USA, and given Patent Deposit Number PTA-126210. SA187 was found to colonize both surface and inner plant root and shoot tissues and to modify several plant phytohormone pathways. *Enterobacter* sp. SA187 was shown to significantly increase the yield of the agronomically important crop alfalfa (*Medicago sativa*) in field trials under both normal and salt stress conditions, demonstrating that SA187 has a high potential to improve agriculture under desert conditions. Gene expression analysis of SA187-containing plants indicated an upregulation of the methionine salvage pathway upon plant colonization, increasing the production of 2-keto-4-methylthiobutyric acid (KMBA), which is known to be converted into ethylene in planta.

Methods for providing plants with tolerance to abiotic stress conditions are disclosed in WO 2017/125894. The methods include inoculating the seed or plant with an effective amount ($10^6$-$10^8$ bacteria/ml) of SA187 to provide the seed or plant with resistance to the abiotic stress conditions. The inoculation of the plant can be in the rhizosphere of the plant. The rhizosphere is the area around a plant root that is inhabited by a unique population of microorganisms. Alternatively, the plant root can be inoculated directly. In certain embodiments, the plant root is coated with SA187. The SA187 is preferably the bacterium whose genome contains SEQ ID NO:1, 2, 3, 4, 5, 6, 7, 8, 9, 10, 11, 12, 13, or a combination thereof. More preferably, the SA187 genome contains all of SEQ ID NO:1-13.

Another embodiment use a seed coating composition containing SA187. The SA187 can be encapsulated with a non-toxic, biodegradable coating. The seed coating composition can also contain a coating adhesive. Exemplary seed coating compositions contain gelatin, cellulose, alginate, xanthum, or a combination thereof. Certain seed coating compositions can have multiple layers.

Other embodiment provides a method of improving growth of a seed or plant under abiotic stress conditions by growing the seed or plant in a plant substrate, wherein the plant substrate includes an effective amount of SA187 to colonize the seed or a root of the plant to provide abiotic stress resistance to the seed or plant.

One embodiment provides a plant substrate containing an effective amount of a species of the genus *Enterobacter* to inhibit or reduce abiotic stress in the plant. In a preferred embodiment, the *Enterobacter* species is SA187. Suitable plant substrates include, but are not limited to soil, peat, compost, vermiculite, perlite, sand, clay and combinations thereof. Typically, the plant substrates contain $10^6$ to $10^9$ bacteria per/g of substrate.

The disclosed methods can use bacteria genetically engineered to express KMBA or increased levels of KMBA relative to an unmodified bacterium, which can be used as a microbial system that results in production of KMBA in mature plants. Bacteria can be genetically engineered to overexpress KMBA or increased levels of KMBA relative to an unmodified bacterium using methods known in the art. The data in this application shows that the expression level of most of the genes encoding proteins involved in the methionine salvage pathway were upregulated in SA187 upon plant colonization compared with bacteria incubated for 4 h in liquid ½ MS with or without 100 mM NaCl in the absence of plants. Thus, the disclosed methods include engineering bacteria to overexpress one or more genes involved in the methionine salvage pathway.

Many organisms including bacteria utilize the methionine salvage (FIG. 7F) pathway recycling methylthioadenosine (MTA) to methionine. In a first step in *E. coli*, MTA is hydrolysed by a nucleosidase (EC 3.2.2.16, coded by gene pfs, now mtnN, for methylthioadenosine nucleosidase). Additional genes include: tyrB encoding a wide spectrum aminotransferase the gene encoding MtnA (methylthioribose-1-phosphate isomerase), mtnA, mtnB, which codes for a methylthioribulose-1-phosphate dehydratase; an enolase-phosphatase, encoded by gene mtnC; mtnD (ykrZ), which codes for the aci-reductone dioxygenase (Sekowska, et al., *BMC Microbiology* 2004, 4:9; mtnK was identified encoding methylthioribose kinase (Sekowska, et al., *BMC Microbiology* 2001, 1:15); metK, encoding S-adenosylmethionine (SAM) synthetase; speE encoding spermidine synthetase; speD, encoding S-adenosylmethionine decarboxylase (Gao, et al., MBio, 5(2)e0079-14, (2014); Sekowska, et at, *J. Mol. Microbiol. Biotechnol.* (2000) 2(2); 145-177)). Additionally, the bacteria can be engineered to express L-amino acid deaminase (L-AAD) from *Proteus vulgaris* as disclosed for example in Hossain, et al., *PLOS One,* 9(12):e114291 (2014), for one-step biosynthesis of α-keto-γ-methylthio butyric acid from *E. coli* from L-methionine. Preferred bacteria include SA187 and *E. coli*. However, a suitable bacterium can be selected from the list of bacteria suitable for co-inoculation, described below.

Seed Coating Compositions

One embodiment provides a seed coating composition having at least one layer coating all or part of the seed, wherein at least one layer contains an effective amount of KMBA and/or SA187 to provide the seed or the plant that grows from the seed with resistance to abiotic stress conditions. The SA187 can be from $10^6$/ml to $10^9$/ml of seed coating composition.

Another embodiment provides a seed coating composition containing KMBA. The KMBA can be encapsulated with a non-toxic, biodegradable coating. The seed coating composition can also contain a coating adhesive. Exemplary seed coating compositions contain gelatin, cellulose, alginate, xanthum, or a combination thereof. Certain seed coating compositions can have multiple layers.

In another embodiment, the seed coating composition contains multiple layers for example, 2, 3, 4 or 5 or more layers. KMBA, SA187 and/or one or more additional plant growth promoting bacteria can be in any or all of the layers of the seed coating composition; however, at least one of the layers of a multiple layer seed coating composition contains an effective amount of KMBA and/or SA187 to provide the seed or the plant growing from the seed with resistance to abiotic stress conditions. Preferably, the KMBA and/or SA187 or other plant growth promoting bacteria are in the layer adjacent to the surface of the seed.

In one embodiment, at least one layer contains guar gum, derivative guar, polyacrylamide, poly(methacrylic acid), poly(acrylic acid), polyacrylate, poly(ethylene glycol), phosphonate-end capped polymers, polyethyleneoxide, poly (vinyl alcohol), polyglycerol, polytetrahydrofuran, polyamide, hydroxypropyl guar, carboxymethyl guar, carboxymethyl hydroxypropyl guar, starch, derivatized (e.g., cationic) starch, corn starch, wheat starch, rice starch, potato starch, tapioca, waxy maize, sorghum, waxy sorghum, sago, dextrin, chitin, chitosan, alginate compositions, xanthan gum, carageenan gum, gum karaya, gum arabic, pectin, cellulose, hydroxycellulose, hydroxyalkyl cellulose, hydroxyethyl cellulose, carboxymethylhydroxyethyl cellulose, hydroxypropyl cellulose, a derivative of any of the foregoing or a combination of any of the foregoing. As non-limiting examples, the layer can contain a 90 wt % derivatized guar and 10 wt % starch (or derivatized starch) mixture, or a 60 wt % hydroxypropyl guar and 40 wt % carboxymethyl hydroxypropyl guar mixture.

In some embodiments, the layer can act as a carrier coating. Fungicides and beneficial microbes that protect the seed and emerging seedling are carried in the carrier coating. For example, alfalfa seed coating with incorporated KMBA and/or SA187 is used to inoculate the field in which desired crop plants are planted or are growing.

Another embodiment provides agglomerates of seed. The agglomerate or grouping of seed is a grouping of 2 or more individual seeds together. The seeds can be for the same plant or for different plants. In another embodiment, the agglomerate is a grouping of more than 5 individual seeds together. In a further embodiment, the agglomerate is a grouping of more than 10 individual seeds together. In yet another embodiment, the agglomerate is a grouping of more than 25 individual seeds together. In yet a further embodiment, the agglomerate is a grouping of more than 50 individual seeds together. In another embodiment, the agglomerate is a grouping of more than 100 individual seeds together.

1. Seed Agglomerates

The agglomeration of seed can aid in the application of the seed coating composition because the seed coating composition, when using an agglomeration of seed, can be shaped or formed to be consistent in shape or form. For example, the agglomeration can be formed as spherical or substantially spherical, thus allowing the seed coating composition to be likewise substantially spherical. This can allow for improved or more consistent casting or spraying, can minimize the occurrence of blockage or clogging of the nozzles, hoses, etc. due to uneven particle size distribution. Typically, a binder or adhesive is utilized to bunch (e.g., agglomerize) the grouping of seeds together.

The agglomeration can also aid in seed or seedling establishment as a layer of the wetting agent (or other layer than affects the soil) can be concentrated to a local area of soil, thus, increasing its chance of wetting the soil surrounding the seed(s). the agglomeration can also promote survival by allowing the seeds, when germinating into seedlings, to generate sufficient force to penetrate hydrophobic areas or soil such as, for example, a hydrophobic (i.e., encrusted) soil surface In one embodiment, the seed coating composition contains an agglomeration of seeds of from between 2 seeds to 100 seeds, typically between 2 to 50 seeds, typically between 2 to 25 seeds; and at least one layer selected from the group consisting a layer of a filler, a layer of a binding agent, a layer of a wetting agent, a layer of an anti-bacteria agent, a layer of an active ingredient and any combination thereof.

In one embodiment, the seed coating composition is of substantially uniform size of from between 10 micrometers and 4 mm in diameter. In another embodiment, the seed coating composition is of substantially uniform size of from between 25 micrometers and 2 mm in diameter. In a further, the seed coating composition is of substantially uniform size of from between 500 micrometers and 2 mm in diameter.

2. Binder

The seed coating composition can also contain a binder as one of the layers, the binder is sometimes referred to as an adhesive. In one embodiment, the binder can include but is not limited to molasses, granulated sugar, alginates, karaya gum, guar gum, tragacanth gum, polysaccharide gum, mucilage or any combination of the foregoing. In another embodiment, the binder is chosen from, but is not limited to, gelatin, polyvinyl acetates, polyvinyl acetate copolymers, polyvinyl alcohols, polyvinyl alcohol copolymers, celluloses (including ethylcelluloses and methylcelluloses, hydroxypropylcelluloses, hydroxymethyl celluloses, hydroxymethylpropyl-celluloses), polyvinylpyrolidones, dextrins, malto-dextrins, polysaccharides, fats, oils, proteins, gum arabics, shellacs, vinylidene chloride, vinylidene chloride copolymers, calcium lignosulfonates, acrylic copolymers, starches, polyvinylacrylates, zeins, carboxymethylcellulose, chitosan, polyethylene oxide, acrylimide polymers and copolymers, polyhydroxyethyl acrylate, methylacrylimide monomers, alginate, ethylcellulose, polychloroprene, syrups or any combination of the foregoing.

3. Active Ingredients

The seed coating compositions can also include one or more active ingredients in one or more of the layers of the coating. Compounds suitable as active ingredients, which in some embodiments form all or part of at least one layer of the seed coating composition, include but are not limited to herbicides, plant growth regulators, crop desiccants, fungicides, insecticides, insect repellants, and combinations thereof. Suitable pesticides include, for example, triazine herbicides; sulfonylurea herbicides; uracils; urea herbicides; acetanilide herbicides; and organophosphonate herbicides such as glyphosate salts and esters. Suitable fungicides include, for example, nitrilo oxime fungicides; imidazole fungicides; triazole fungicides; sulfenamide fungicides; dithio-carbamate fungicides; chloronated aromatic; and dichloro aniline fungicides. Suitable insecticides, include, for example, carbamate insecticides; organo thiophosphate insecticides; and perchlorinated organic insecticides such as methoxychlor. Suitable miticides include, for example, propynyl sulfite; triazapentadiene miticides; chlorinated aromatic miticides such as tetradifan; and dinitrophenol miticides such as binapacryl. Other active ingredients can include adjuvants, surfactants, and fertilizers.

4. Filler

The seed coating composition can also include at least one filler as all or part of a layer. In one embodiment, the filler is selected from the group consisting of wood flours, clays, activated carbon, carbohydrates, sugars, dextrins, maltodextrins, diatomaceous earth, cereal flours, wheat flour, oat flour, barley flour, fine-grain inorganic solids, calcium carbonate, calcium bentonite, kaolin, china clay, talc, perlite, mica, vermiculite, silicas, quartz powder, montmorillonite or mixtures thereof.

5. Nutrients

The seed coating composition can also contain a nutrient such as a micronutrient or macronutrient in one or more layers of the seed coating composition. The nutrient can be in all or part of a layer. The nutrient can also be included with the grouping of seeds as part of the binder or adhesive. "Nutrient" as used herein can refer to an additive or substance utilized by plants, grasses, shrubs for plant, grass, and shrub growth, respectively. Macronutrients can be utilized in larger amounts by plants, grasses, etc. in proportionally larger amounts relative to micronutrients. Nutrients include but are not limited to manganese, boron, copper, iron, chlorine, molybdenum, and zinc, potassium, nitrogen, calcium, magnesium phosphorus and sulfur, among others. The seed coating compositions can include various combinations and relative amounts of individual macronutrients.

Co-inoculation

Plants and seeds can be co-inoculated with SA187 and one or more other plant growth-promoting bacteria or rhizobacteria to provide the seeds or plants with resistance or tolerance to abiotic stress conditions. Co-inoculation is based on mixed inoculants, combination of microorganisms that interact synergistically, or when microorganisms such as *Azospirillum* are functioning as "helper" bacteria to enhance the performance of other beneficial microorganisms. In the rhizosphere the synergism between various bacterial genera such as *Bacillus, Pseudomonas* and *Rhizobium* has been demonstrated to promote plant growth and development. Compared to single inoculation, co-inoculation can improve the absorption of nitrogen, phosphorus and mineral nutrients by plants.

Suitable bacteria that can be co-inoculated with SA187 include but are not limited to *Pseudomonas putida, Pseudomonas aeruginosa, Klebsiella* sp., *Enterobacter asburiae, Rhizobium* sp. (pea), *Mesorhizobium* sp., *Acinetobacter* spp., *Rhizobium* sp.(lentil), *Pseudomonas* sp. A3R3, *Psychrobacter* sp. SRS8, *Bradyrhizobium* sp.,

*Pseudomonas aeruginosa* 4EA, *Pseudomonas* sp., *Ochrobactrum cytisi*, *Bacillus* species PSB10, *Paenibacillus polymyxa*, *Rhizobium phaseoli*, *Rahnella aquatilis*, *Pseudomonas fluorescens*, *Ralstonia metallidurans*, *Azospirillum amazonense*, *Serratia marcescens*, *Enterobacter* sp., *Burkholderia*, *Pseudomonas jessenii*, *Azotobacter* sp., *Mesorhizobium ciceri*, *Azotobacter chroococcum*, *Klebsiella oxytoca*, *Pseudomonas chlororaphis*, *Baciilus subtilis*, *Gluconacetobacter, diazotrophicus*, *Brevibacillus* spp., *Bravibacterium* sp., *Xanthomonas* sp. RJ3, *Azomonas* sp. RJ4, *Pseudomonas* sp. RJ10, *Bacillus* sp. RJ31, *Bradyrhizobium japonicum*, *Variovorax paradoxus*, *Rhodococcus* sp., *Flavobacterium*, *Sphingomonas* sp, *Mycobacterium* sp, *Rhodococcus* sp, *Cellulomonas* sp., *Azospirillum* sp., *Azospirillum brasilense*, *Rhizobium meliloti*, *Kluyvera ascorbata*, *Rhizobium cicero*, *Rhizobium leguminosarum*, *Paenibacillus polymyxa* strain A26, a *Alcaligenes faecalis* strain AF, and combinations thereof.

In some embodiments, the inoculation method does not include inoculating the plant or seeds with SA187. In these embodiments, the exogenous KMBA method is employed in seeds/plants inoculated one or more other plant growth-promoting bacteria or rhizobacteria to provide the seeds or plants with resistance or tolerance to abiotic stress conditions C. Coating Techniques Equipment utilized to for coating seeds with the disclosed seed coating compositions include, but are not limited to drum coaters, rotary coaters, tumbling drums, fluidized beds and spouted beds to name a few. The seeds can be coated via a batch or continuous coating process.

The seeds can be separated prior to coating which, in one embodiment, utilizes mechanical means such as a sieve. The separated seeds can then be introduced into a coating machine having a seed reservoir. In one embodiment, the seeds in the mixing bowl are combined with one or more of the coatings described herein and adhered with a binder or adhesive.

In one embodiment of the process, one or more layers as described herein can be added to coat the seed or agglomeration. Outer layers can be introduced sequentially to the rotating drum.

In another embodiment, agglomerators or agglomerator devices may also be utilized. Coating is performed within a rotary coater by placing seeds within a rotating chamber, which pushes the seeds against the inside wall of the chamber. Centrifugal forces and mixing bars placed inside the coater allow the seed to rotate and mix with a coating layer. Binder or other coating materials can be pumped into the proximate center of the coater onto an atomizer disk that rotates along with the coating chamber. Upon hitting the atomizer disk, liquid adhesive is then directed outward in small drops onto the seed.

In one embodiment, seed coating techniques include, for example, seed in a rotating pan or drum. Seed is then misted with water or other liquid and then gradually a fine inert powder, e.g., Diatomaceous earth, is added to the coating pan. Each misted seed becomes the center of a mass of powder, layers, or coatings that gradually increases in size. The mass is then rounded and smoothed by the tumbling action in the pan, similar to pebbles on the beach. The coating layers are compacted by compression from the weight of material in the pan. Binders often are incorporated near the end of the coating process to harden the outer layer of the mass. Binders can also reduce the amount of dust produced by the finished product in handling, shipping and sowing. Screening techniques, such as frequent hand screening, are often times utilized to eliminate blanks or doubles, and to ensure uniform size. For example, tolerance for seed coating compositions described herein can be about 1/64th inch (0.4 mm), which is the US seed trade standard for sizing.

In yet another embodiment, the seed coating compositions and methods described herein comprises "in situ coating". In situ coating means, in one embodiment, where a raw or non-coated seed is implanted in a hole, cavity or hollowed area in the ground and immediately or soon thereafter a coating composition is sprayed or applied directly into the hole, cavity or hollowed area to surround or partially surround the seed. Typically, the application of the seed as well as application of the coating composition are performed mechanically, but is understood that either or both of the referenced applications can be performed manually as well.

The coating can also be applied to a seed by spraying, dipping or brushing.

D. Cultivation Methods

One embodiment provides a method of cultivating a plant by planting seeds or seedlings of the plant and irrigating the seeds or seedlings with a saline solution containing KMBA. The plant can be a forage crop. In one embodiment the forage crop is selected from the group containing rice, wheat, sugarcane, maize, soybean, cotton, vegetables, rape, mustard, sorghum, millet, grass, *Brassica* spp., rapeseed, barley, hay, and alfalfa.

Another embodiment provides a method of cultivating plants in sodic soil by contacting the plant in the sodic soil with an effective amount of KMBA to increase salt tolerance in the plant.

In embodiments combining the exogenous and endogenous KMBA methods, seeds or plants inoculated with an effective amount of SA187 to provide the seed or plant with resistance or tolerance to abiotic stress condition are cultivated in sodic soil by contacting the plant in the sodic soil with an effective amount of KMBA to increase salt tolerance in the plant. Preferred seeds and plants, preferably roots that can be inoculated with or coated with SA187 include, but are not limited to alfalfa, cotton, wheat, maize, soybean, oat, barley, potato, and sugar beets.

E. Irrigation Solution

An irrigation solution to increase salt tolerance in plants is provided. The irrigation solution contains 1.0 to 250 nM KMBA in an aqueous saline solution. In one embodiment the solution contains 1, 5, 10, 20, 30, 40, 50, 60, 70, 80, 90, 100, 125, 150, 175, 200, 225, or 250 nM of KMBA. In a preferred embodiment, KMBA is present at a concentration of at least 100 nM.

In one embodiment the aqueous saline solution is seawater. The aqueous solution can contain 1% to 10% salt. In some embodiments the solution contains 1.5%, 2%, 2.5%, 3%, 3.5%, 4%, 4.5%, 5%, 5.5%, 6%, 6.5%, 7%, 7.5%, 8%, 8.5%, 9%, or 9.5% salt. In a preferred embodiment, the solution contains 3.5% salt.

EXAMPLES

Data Submission

RNAseq data are available under the ID GSE102950 which is incorporated by reference in its entirety.

The isolation of SA0187 is previously disclosed in WO 2017/125894. Briefely, *Enterobacter* sp. SA187 (endophytic bacteria) was isolated from surface sterilized root nodules formed on roots of pioneer plant *Indigofera argentea* Burm.f. (Fabaceae). Plants were collected from different regions in the Jizan area (16° 56.475' N, 42° 36.694' E) of Saudi Arabia. SA187 has been shown to possess plant growth promoting activities, such as the production of siderophores and indole acetic acid (IAA).

Sequencing

The genomic DNA of SA187 was extracted using the Qiagen's DNeasy blood and tissue kit following the manufacturer protocol. The DNA was then sequenced using paired-end Illumina MiSeq and the library preparation was constructed as described previously (1). Contig assembly was done with Spades assembler version 3.6 (4) with a 1 KB contig 52 cutoff size.

Total RNA was extracted from 5-day-old plants inoculated or not with SA187 and transferred for 10 more days on ½ MS plates with or without 100 mM NaCl using the Nucleospin RNA plant kit (Macherey-Nagel), including DNase treatment, and following manufacturer's recommendations.

RNA samples were used for Illumina HiSeq deep sequencing (Illumina HiSeq 2000, Illumina). Three biological replicates were processed for each sample. Paired-end sequencing of RNA-seq samples was performed using Illumina GAIIx with a read length of 100 bp. Reads were quality-controlled using FASTQC (http://www.bioinformatics.babraham.ac.uk/projects/fastqc/). Trimmomatic was used for quality trimming[8]. Parameters for read quality filtering were set as follows: Minimum length of 36 bp; Mean Phred quality score greater than 30; Leading and trailing bases removal with base quality below 3; Sliding window of 4:15. TopHat v2.0.9[9] was utilized for alignment of short reads to the *Arabidopsis thaliana* genome TAIR10 (Supplementary Table 1), Cufflinks v2.2.0[10] for transcript assembly and differential expression. To identify differentially expressed genes, specific parameters (p-value: 0.05; statistical correction: Benjamini Hochberg; FDR: 0.05) in cuffdiff were used. Post-processing and visualization of differential expression were done using cummeRbund v2.0.0[11]. Gene is considered as regulated if fold change $>\log2^{10.61}$ and q-value $<0.05$. Results were confirmed by analyzing 12 genes using qPCR method.

For qPCR analysis, plant RNAs were purified as described previously. For bacterium, SA187 incubated 4 h in ½ MS or ½ MS+100 mM, at 28° C., under the dark, were used for RNA extraction, using the RiboPure™ RNA Purification Kit, bacteria (Ambion) following manual instructions for Gram-(-) bacteria, with the exception that no beads were used during bacterial lysis. RNA extraction was followed by DNAseI treatment in order to obtain purified total RNA.

cDNAs were synthetized using SuperscriptIII (Invitrogen), 1 μg of total RNA and oligo-dT following manufacturer's recommendations. For *Arabidopsis* gene expression analyses, ACTIN2 (At3g18780) and UBIQUITIN 10 (At4g05320) were used as reference genes. For SA187 gene expression analyses, infB, rpoB and gyrB were used as reference genes. All reactions were done in a CFX96 Touch™ Real-Time PCR Detection System (BIO-RAD) as follows: 50° C. for 2 min, 95° C. for 10 min; 40×[95° C. for 10 sec and 60° C. for 40 sec]; and a dissociation step to validate the PCR products. All reactions were performed in three biological replicates, and each reaction as a technical triplicate. Gene expression levels were calculated using Bio-Rad CFX manager software.

Hierarchical Clustering and Gene Family Enrichment

*Arabidopsis* regulated genes were used to generate HCL tree using Multi Experiment Viewer (McV 4.9.0 version, TM4, https://sourceforge.net/projects/mev-tm4/files/mev-tm4/MeV%204.9.0/). Raw data were normalized for every gene and transformed in log2. Hierarchical clustering was performed using Euclidian distances, average linkage and leaf order optimization. Heat colors indicate log2 fold change. Gene enrichment analyses were performed using AmiGO website (http://amigo1.geneontology.org/cgi-bin/amigo/term_enrichment). Each cluster were analyzed using default parameter.

Results

De novo assembly of MiSeq reads for *Enterobacter* sp. SA187 resulted in 14 contigs with a total length of 4,404,403 bp and a mean contig size of 314,600 bp. The N50 was 2,296,004 bp and the L50 has been reached in 1 contig. The GC content of this draft genome was 56%. Megablast comparison of the SA187 concatenated contigs against the NCBI reference genome database (http://www.ncbi.nlm.nih.gov/genome/) revealed the 57 closest relative genomes being *Enterobacter sacchari* SP1 with a coverage of 63% and sequence identity of 95% (Accession number NZ_CP007215.2). The annotation of *Enterobacter* sp. SA187 was carried out using the default INDIGO pipeline (7) with the exception of open reading frame (ORFs) prediction by FragGeneScan. The annotation of SA187 resulted in 3,087 ORFs, 9 rRNA, 75 tRNA, and 145 ncRNA.

The annotation predicted a number of siderophore pathway genes such as entE, entC, entA, entB, entF, as well as entS, an MFS transporter of enterobactin. An ABC transporter involved in iron uptake, sitABCD, was also found, as well as five copies of the iron complex outer membrane receptor (fhuA) and a TonB-dependent outer membrane iron-enterobactin/colicin (fepA). Generally, PGPR bacteria enhance plant growth through the synthesis of IAA from tryptophan via indole pyruvate as the main pathway (9). The SA187 genome harbors a number of genes involved in this pathway, but lacks the gene encoding for indolepyruvate decarboxylase (ipdC). Moreover, the SA187 genome codes for the enzyme tryptophanase (TnaA) (EC: 4.1.99.1), which can transform tryptophane into indole.

Genome of *Enterobacter* sp. SA187 has been deposited at DBJ/EMBL/GenBank under accession number MORB00000000 (which is incorporated herein in its entirety. The genome of SA187 contains SEQ ID NO:1-13.

Results

Based on 16S rDNA sequencing and comparison, SA187 was suggested to belong to the *Enterobacter* genus, with high homology with *Enterobacter kobei* strains.

The 16S ribosomal RNA gene sequence (or 16S rRNA) is deposited at DDBJ/EMBL/GenBank under the accession no KY194757.

Based on the 16S rRNA gene sequence the SA187 is closely related to *Enterobacter kobei* CCUG 49023$^T$ and *Enterobacter aerogenes* strain KCTC 2190 with 99% sequence similarity. SA187 comprises SEQ ID NO:1, 2, 3, 4, 5, 6, 7, 8, 9, 10, 11, 12, 13, or a combination thereof.

Example 1: *Enterobacter* sp. SA187 Increases Alfalfa Yield in Field Trials Under Field Conditions Methods Field Trials To inoculate alfalfa seeds (*Medicago sativa* var. CUF 101), a slurry was prepared consisting of sterilized peat, a broth culture of SA187, and sterilized sugar solution (10%) in the ratio 5:4:1 (w/v/v). Subsequently, alfalfa seeds were coated with the slurry at a rate of 50 mL·kg$^{-1}$. As a control, seeds were coated with a similar mixture without bacteria. Field trials were conducted at the experimental station in Hada Al-Sham (N 21°47'47.1" E 39°43'48.8"), Saudi Arabia, in winter seasons 2015-2016 and 2016-2017. The experiment was a randomized complete block design with a split-split plot arrangement of four replicates in the season 2015-2016 season and three replicates in the 2016-2017 season, plots (2×1.5 m) with seed spacing 20 cm row-to-row. The field was irrigated using ground water with two different salinity levels: low salinity (EC =3.12 dS·m$^{-1}$), and high salinity (EC=7.81 dS·m$^{-1}$). The soil had an average pH 7.74 and salinity EC=1.95 dS·m$^{-1}$. Agronomical data (plant height, fresh biomass, and dry biomass) were recorded every 25-30 days from each harvest; three harvests were done in the first season, four harvests in the second season.

Results

Figure 1D:
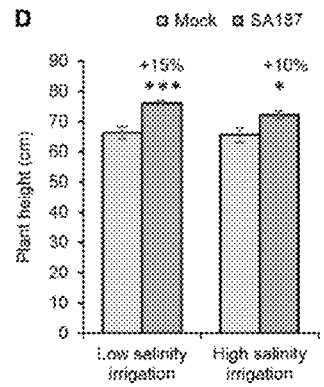
Figure 1E:
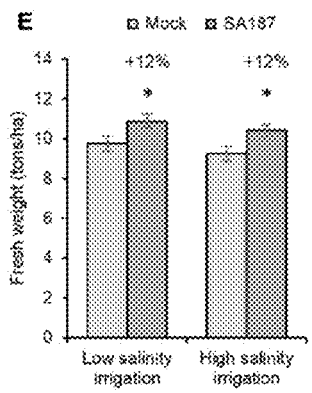
Figure 1F:
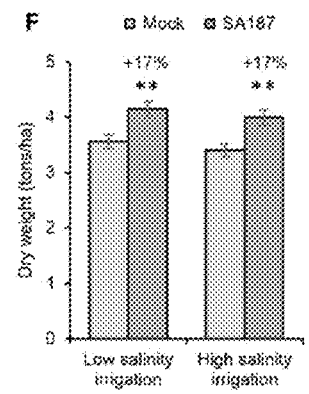

Since SA187 was an outstandingly performing bacterial isolate in a previous screen using *Arabidopsis* as a model plant (Andrés-Barrao, et al., *Front Microbiol*, 8:1-21 (2017)), the potential agronomic use of SA187 as a biological solution for agriculture was evaluated. Therefore, the beneficial activity of SA187 on different growth parameters of the crop plant alfalfa (*Medicago sativa*), which is largely used as animal feed in different regions of the world, was tested. Alfalfa seeds were coated with SA187 and tested in parallel with mock-coated seeds in the experimental fields' station near the city of Jeddah, Saudi Arabia. A randomized complete block design with a split-split plot arrangement with different replicates was used over two subsequent growth seasons (2015-2016 and 2016-2017). In the first growing season, using low saline water (EC=3.12 dS·m$^{-1}$) irrigation, SA187-inoculated alfalfa plants exhibited an increase of 25% for plant height, leading to an increase of both fresh and dry biomass by 16% and 14%, respectively (FIG. 1A, B, C). Interestingly, using high saline irrigation water (EC=7.81 dS·m$^{-1}$), a similar impact on the plant growth was observed. In the growing season 2016-2017, although there was no clear difference in the alfalfa yield between plots irrigated with low and high saline water, a beneficial impact of SA187 was still observed on both experimental plots irrigated with low and high saline water (FIG. 1D, E, F). The lowered increase in growth parameters in the second season is most likely due to exceptional rainfalls in that period. In conclusion, SA187 can efficiently improve crop productivity under extreme agricultural conditions.

Example 2: *Enterobacter* sp. SA187 Enhances Salt Tolerance in *Arabidopsis thaliana*

Methods

Endophytic Bacteria, Plant Material, Growth Condition and Physiological Experiments

*Enterobacter* sp. SA187 was previously isolated from root nodules of the leguminous pioneer plant *Indigofera argentea* in the Jizan region of Saudi Arabia (Lafi, et al., *Genome Announc*, 9-10 (2017); Andres-Barrao, et al., *Front Microbiol*, 8:1-21 (2017)). The complete genome sequence of *Enterobacter* sp. SA187 is known in the art (Andres-Barrao, C., et al., *Front Microbiol*. 8:1-21 (2017)). *Arabidopsis* seeds were obtained either from publicly available collections or provided by Dr. Jean Colcombet (IPS2, Orsay, France). The following mutant lines used in this study were published previously: the JA-receptor coi1-1 mutant (Xie, et al., *Science*, 280:1091-1094 (1998)), JA-insensitive jar1-1 (Staswick, et at, *Proc Natl Acad Sci USA*, 89:6837-6840 (1992)), the ABA biosynthesis aba2-1 mutant (Schwartz, et al., *Plant Physiol*, 114:161-166 (2997)), the ABA receptor quadruple pyr1-1pyl1-1pyl2-1pyl4-1 mutant (Park et al., *Science*, 324:1068-1071 (2009)), the ethylene insensitive ein2-1 (Guzmán, et al., *Plant Cell*, 2:513-523 (1990)) and ein3-1 mutants (Roman, et al., *Genetics*. 139:1391-1409 (1995)), the heptuple ethylene-biosynthesis deficient mutant acs1-1acs2-1acs4-1acs5-2acs6-1acs7-1acs9-1 (Tsuchisaka, et al., *Genetics*, 183:979-1003 (2009)), and the ethylene-dependent pEBF2::GUS reporter (Konishi and Yanagisawa, *Plant J*, 55:821-831 (2008)).

Prior to every experiment, *A. thaliana* seeds were surface sterilized 10 min in 70% ethanol+0.05% sodium dodecyl sulfate on a shaker, washed 2 times in 96% ethanol and let to dry. To ensure SA187-inoculation, sterilized seeds were sown on ½ MS plates (Murashige and Skoog basal salts, Sigma) containing SA187 (2·10$^5$ cfu·ml$^{-1}$), stratified for 2 days at 4° C. in the dark and then placed vertically to growth conditions for 5 days. The ½ MS plates with SA187 were prepared by addition of a calculated amount of bacterial suspension to pre-cooled agar medium during plate preparation.

Average length of root hairs was determined based on images of 5-day-old roots (1 image per root at constant distance from the root tip, 25 seedlings per condition) or 16-day-old roots (along the whole primary root length grown after transfer) captured by a Nikon AZ100M microscope equipped with an AZ Plan Apo 2× objective and a DS-Ril camera (Nikon). All root hairs in focus were measured using ImageJ. Average values and standard deviations were calculated from 10% longest root hairs to eliminate non-developed root hairs and describe the maximal elongation capacity of root hairs.

For salt stress tolerance assays, 5-day-old seedlings were transferred onto ½ MS plates with or without 100 mM NaCl (Sigma). Primary root length was measured every 2 days using ImageJ software after scanning the plates. Lateral root density was evaluated as detectable number of lateral roots under a stereo microscope divided by the primary root length. Fresh weight of shoots and roots was measured 12 days after transfer of seedlings. Dry weight was measured after drying shoota and roots for 2 days at 70° C. Following Koch's postulate, SA187 was re-isolated from *Arabidopsis* root system at the end of an initial experiment to confirm the genotype of the inoculated strain. To address the ethylene involvement in *Arabidopsis* adaptation to salt stress, ACC (1-aminocyclopropane-1-carboxylic acid, Sigma), KMBA (2-keto-4-methylthiobutyric acid, Sigma), AVG (aminoethoxyvinylglycine, Sigma), AgNO$_3$ (silver nitrate, Sigma) were added into pre-cooled ½ MS agar medium together with 100 mM NaCl. For DNPH (2,4-dinitrophenylhydrazine, Sigma), 5 mM solution was prepared by solubilizing DNPH into 2M HCl as described previously (Primrose, *J Gen Microbiol*, 98:519-528 (1977)), then the solution was diluted until reaching 1 mM, and equilibrated to the same pH as MS medium (pH 5.8) using 2M KOH. DNP was used at final concentration 3 μM.

All plants were grown in long day conditions in growth chambers (Percival; 16 h light/8 h dark, 22° C.). Each experiment was performed at least in three biological replicates.

Results

Figure 2A:
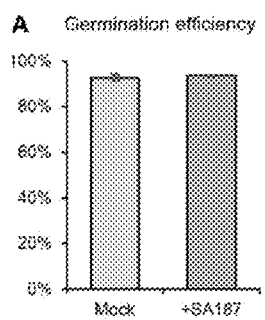
Figure 2B:
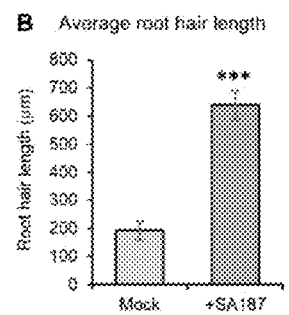
Figure 2C:
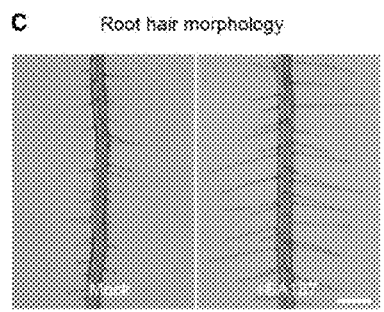
Figure 2D:
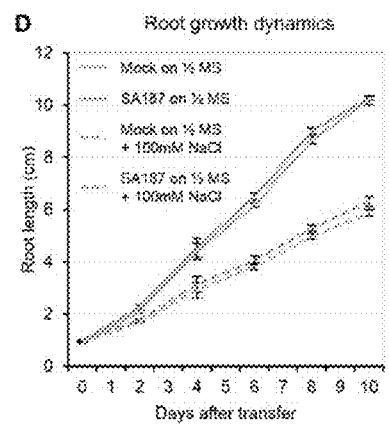

To better understand the molecular mechanism how SA187 confers stress tolerance to plants, model genetic plant *A. thaliana* was used. The capacity of SA187 to affect the early stages of *Arabidopsis* development under normal conditions (½ MS agar medium, 22° C., 16 h of light) was assessed. When compared to mock-inoculated plants, SA187 had no influence on the germination rate of *Arabidopsis* seeds (FIG. 2A), and apart from considerably longer root hairs (FIG. 2B, C), 5-day-old seedlings showed no morphological changes. Similarly, after transfer onto new ½ MS plates, no differences between 17-day-old mock- and SA187-inoculated seedlings were recorded, when measuring root length (FIG. 2D-E), lateral root density (FIG. 2J), shoot morphology (FIG. 2E), or root and shoot fresh and dry weight of seedlings (FIG. 2F-I) indicating that SA187 has no effect on *Arabidopsis* development under normal growth conditions.

On the other hand, the stress tolerance promoting capacity of SA187 on *Arabidopsis* growth was highlighted under salt stress. Five days after germination, SA187- and mock-inoculated seedlings were transferred onto ½ MS agar plates supplemented with 100 mM NaCl, and the same growth parameters were evaluated as above up to 12 days after the transfer to salt plates. SA187-inoculated plants showed stress tolerance promoting activity on salt stress: the shoot and root systems of SA187-inoculated plants were significantly more developed than those of mock-inoculated plants (FIG. 2E-J). While primary root length was similar between SA187- and mock-inoculated plants (FIG. 2D), lateral root density was significantly increased (FIG. 2J). Similarly to 5-day-old seedlings, SA187-inoculated plants at this stage had more than twice longer root hairs compared to the mock-inoculated ones under both normal and salt stress conditions. Moreover, it was proven that the beneficial activity of SA187 was largely linked to living bacterial cells as dead SA187 cells killed by heat-inactivation did not induced any beneficial activity.

Overall, SA187 strongly enhanced *Arabidopsis* growth with increased total fresh and dry weights of both shoot and root under salt stress conditions.

Example 3: *Enterobacter* sp. SA187 Modifies Root and Shoot $K^+$ Levels

Methods $Na^+$ and $K^+$ Content Determination

Dry rosettes and root systems were weighted. All samples were measured individually except for salt-treated root systems, whereby pools of three root systems were measured to ensure proper weight measurements. Sodium and potassium concentrations were prepared for shoot and root dry samples by adding 1 mL of freshly prepared 1% $HNO_3$ (nitric acid, Fisher Scientific) to the pre-weighed samples. The concentrations of sodium and potassium were determined, using Inductively Coupled Plasma Optical Emission Spectrometer (Varian 720-ES ICP OES, Australia).

Results

Figure 3A:
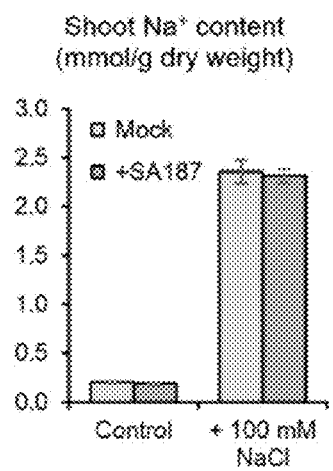
FIGS. 3A-3F show ion content in *Arabidopsis* seedlings.
Figure 3B:
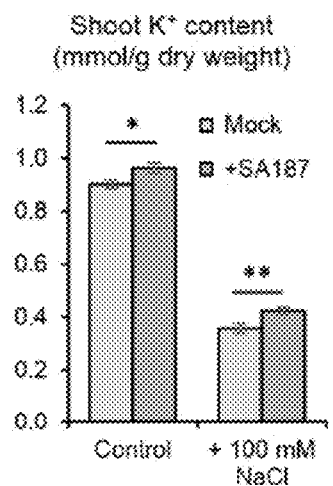
Figure 3C:
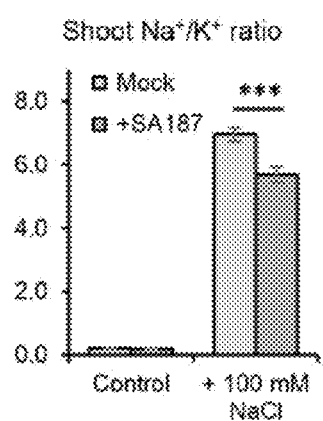
Figure 3D:
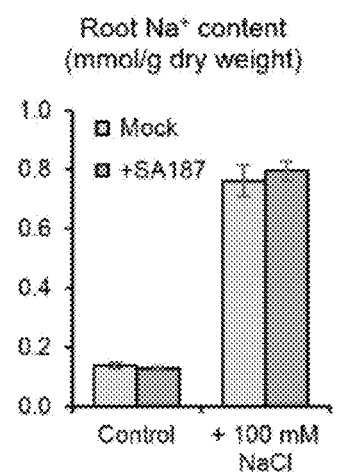
Figure 3E:
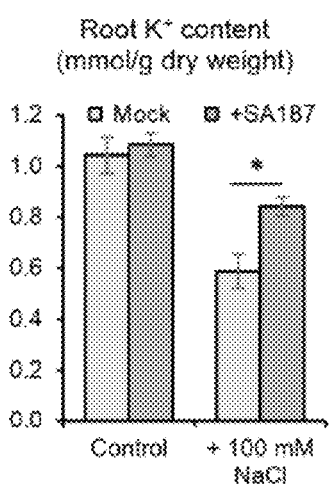
Figure 3F:
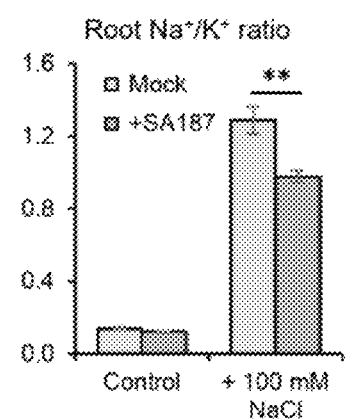

The concentration of sodium ($Na^+$) and potassium ions ($K^+$) in shoots is an important parameter for salt stress tolerance (Garriga, et al., *J Plant Physiol*, 210:9-17 (2017)). Therefore, the $Na^+$ and $K^+$ contents were determined in *Arabidopsis* organs in the absence and presence of SA187. Interestingly, both shoots and roots of SA187-inoculated plants accumulated similar levels of $Na^+$ compared with mock-inoculated plants, under normal and salt stress conditions (FIG. 3A, D). However, increased $K^+$ levels were found in SA187-colonized plants (FIG. 3B, E), resulting in significantly reduced shoot and root $Na^+/K^+$ ratios under saline conditions (FIG. 3C, F), which may help the inoculated plants to keep high growth rate.

Example 4: *Enterobacter* sp. SA187 Colonizes Epidermis and Inner Tissues of Both Roots and Shoots Methods Generation of GFP-Labeled Bacteria SA187 was genetically labeled with the GFP expressing cassette by taking advantage of the mini-Tn7 transposon system (Choi, et al., *Nat Methods*, 2:443-448 (2005)). In order to specifically select for a bacterium carrying the GFP integration in the genome, a spontaneous rifampicin resistant mutant of the strain was obtained first (Crotti, et al., *Environ Microbiol*, 11:3252-3264 (2009)): an overnight-grown culture of SA187 was plated on LB plates supplemented with 100 μg·mL$^{-1}$ of rifampicin, and the plates were incubated for 24 h at 28° C. At least 10 colonies, representing spontaneous rifampicin resistant mutants of the strain were streaked twice on LB plates containing 100 μg·mL$^{-1}$ of rifampicin and thereafter twice on LB plates supplemented with 200 μg·mL$^{-1}$ of rifampicin. The GFP expressing cassette was introduced in the SA187 Rif$^R$ strain by conjugation as described in Lambertsen et al. (*Environ Microbiol*, 6:726-732 (2004)). Briefly, $10^{10}$ cells of SA187 Rif$^R$ strain were mixed with $10^9$ cells of *E. coli* SM10λpir harboring the helper plasmid pUX-BF13, the GFP donor (a mini-Tn7) plasmid and mobilizer pRK600 plasmid. The mixed culture was incubated on sterile nitrocellulose filter for 16 hrs. The conjugation culture of bacterial cells was resuspended in saline buffer (9 g/L NaCl) and spread on selective media with a propitiate antibiotics to select transformed SA187. The selected colonies were screened by fluorescence microscopy for GFP fluorescence and positive colonies were further subjected to genotype confirmation by 16S rRNA gene sequencing.

Confocal Microscopy

GFP-labeled SA187 on *Arabidopsis* roots was imaged using an inverted Zeiss LSM 710 confocal microscope equipped with Plan-Apochromat 10×/0.45, Plan-Apochromat 20×/0.8, and Plan-Apochromat 40×/1.4 Oil objectives. Seedlings grown for 3-21 days on vertical ½ MS agar plates or in soil inoculated with SA187-GFP were washed gently in sterile distilled water and transferred on a sterile agar plate. A block of agar with several seedlings was immediately cut out and placed upside-down to a chambered cover glass (Lab-Tek™ II) with 30 μM propidium iodide (PI) in water as mounting medium. The GFP and PI fluorescence was excited using the 488 nm laser line, and captured as a single track (emission of 493-537 nm for the GFP channel, 579-628 nm for the PI channel, 645-708 nm for chloroplast autofluorescence). For 3D reconstructions, 1 μm-step Z-stacks were taken, and images were generated in the integral 3D view of the Zen software (Zeiss).

Quantification of Root Colonization

Col-0 seedlings were germinated on ½ MS agar plates, and transferred to new ½ MS plates with or without 100 mM NaCl 15 days after germination (10 seedlings per plate). Parts of their root systems grown after the transfer were cut, gently washed by dipping in distilled water to remove non-attached bacterial cells, and then grinded in Eppendorf tubes using teflon sticks. Each sample was resuspended in 1 ml of extraction buffer (10 mM $MgCl_2$, 0.01% Silwet L-77), sonicated for 1 min and subsequently vortexed for 10 min. Samples were diluted in 10× scale, spread on LB Petri dishes, and colonies were counted after overnight incubation at 28° C. Calculated number of colony forming units was normalized per centimeter of root length (total root length was determined based on images of root systems before their harvest). The experiment was conducted in three biological replicates, each with three technical replicates per condition, each sample consisted of five roots.

Results

After recognition of the beneficial impact of SA187 on plant physiology, the interaction of SA187 with plants was characterized in more detail to determine whether SA187 is able to efficiently colonize Arabidopsis as its non-native host. Therefore, its capacity to colonize Arabidopsis seedlings on ½ MS agar plates or in soil was analyzed by confocal microscopy. SA187 cells were stably transformed to express GFP (SA187-GFP), which did not affect their beneficial effect on Arabidopsis seedlings. Confocal microscopy revealed that SA187-GFP colonized both roots and shoots on ½ MS agar plates or in soil (data not shown). On vertical ½ MS agar plates, the first colonies (formed by a small number of cells) were observed on the root epidermis in the elongation zone, preferentially in grooves between epidermal cell files (data not shown). In the differentiation zone and older root parts, colonies were larger and proportional with the age of the region (data not shown). A similar colonization pattern was observed in soil-grown seedlings, however, with a more random distribution of colonies (data not shown). SA187-GFP colonies were also often found in cavities around the base of lateral roots (data not shown). While it was rare to detect SA187-GFP cells inside root tissues in 5-7 days old seedlings, the apoplast of the root cortex and even of the central cylinder was regularly occupied by small scattered colonies in 3 weeks old seedlings (data not shown). Indeed, in the initial plant assays, SA187 could be re-isolated from surface sterilized Arabidopsis roots, indicating that SA187 was proliferating inside root tissues. Inspecting shoots, SA187-GFP colonies were also found deep inside the apoplast of hypocotyls, cotyledons and the first true leaves, and in several cases bacterial cells were directly observed to penetrate through stomata of these organs (data not shown).

The colonization of root systems by SA187 (wild type strain) under normal and salt conditions was examined. Plants were germinated on ½ MS agar plates containing SA187 wild type strains, transferred to new ½ MS plates with or without 100 mM NaCl after 5 days, and parts of their root systems grown after the transfer were used for bacterial extraction after 5 more days. Interestingly, quantification based on counting of colony forming units (CFU) revealed that roots from salt conditions were twice more colonized than those from normal conditions, suggesting that in our experimental system plants can probably facilitate their accessibility to colonization by beneficial bacteria under stress conditions.

Example 5: SA187 Massively Reprograms Arabidopsis Gene Expression upon Colonization Methods RNAseq and qPCR Analysis Total RNA was extracted from 5-day-old plants either inoculated or not inoculated with SA187 and transferred for 10 more days on ½ MS plates with or without 100 mM NaCl using the Nucleospin RNA plant kit (Macherey-Nagel), including DNaseI treatment, and following manufacturer's recommendations.

RNA samples were analyzed by Illumina HiSeq deep sequencing (Illumina HiSeq 2000, Illumina). Three biological replicates were processed for each sample. Paired-end sequencing of RNA-seq samples was performed using Illumina GAIIx with a read length of 100 bp. Reads were quality-controlled using FASTQC (http://www.bioinformatics.babraham.ac.uk/projects/fastqc/). Trimmomatic was used for quality trimming (Bolger, et al., Bioinformatics, 30:2114-2120 (2014)). Parameters for read quality filtering were set as follows: Minimum length of 36 bp; Mean Phred quality score greater than 30; Leading and trailing bases removal with base quality below 3; Sliding window of 4:15. TopHat v2.0.9 (Trapnell, et al., Bioinformatics, 25:1105-1111 (2009)) was used for alignment of short reads to the A. thaliana genome TAIR10, Cufflinks v2.2.0 (Trapnell, et al., Nat Biotechnol, 28:511-515 (2010)) for transcript assembly and differential expression. To identify differentially expressed genes, specific parameters (p-value: 0.05; statistical correction: Benjamini Hochberg; FDR: 0.05) in cuffdiff were used. Post-processing and visualization of differential expression were done using cummeRbund v2.0.0 (Goff, et al., (2001)). Gene was considered as regulated if fold change $>\log_2^{10.61}$ and q-value $<0.05$ compared to Mock condition. RNAseq data set can be retrieved under NCBI geo submission ID GSE102950.

For qPCR analysis, mock and SA187-inoculated plants were used for RNA extraction as described above. Samples were used for analysis of either plant or SA187 gene expression. For bacteria alone, SA187 incubated for 4 h in liquid ½ MS or ½ MS with 100 mM NaCl at 28° C. and dark were used for RNA extraction, using the RiboPure™ RNA Purification Kit (Ambion), following manual instructions for Gram-negative bacteria, with the exception that no beads were added during bacterial lysis. RNA extraction was followed by DNAseI treatment.

cDNAs were synthetized using SuperscriptIII (Invitrogen): 1 μg of total RNA, oligo-dT as a primer, following manufacturer's recommendations. For Arabidopsis gene expression analyses, ACTIN2 (At3g18780) and UBIQUITIN10 (At4g05320) were used as reference genes. For SA187 gene expression analyses, infB, rpoB and gyrB were used as reference genes. All reactions were done in a CFX96 Touch™ Real-Time PCR Detection System (BIO-RAD) as follows: 50° C. for 2 min, 95° C. for 10 min; 40× [95° C. for 10 sec and 60° C. for 40 sec]; and a dissociation step to validate PCR products. All reactions were performed in three biological replicates, and each reaction as a technical triplicate. Gene expression levels were calculated using the Bio-Rad CFX manager software. Primer sequences used in this analysis are listed in Table 1 below.

TABLE 1

Primers Sequences Used.

| Primer name | Sequence (5' to 3') | Targetted gene | Purpose of the primer |
|---|---|---|---|
| 27F | AGAGTTTGATCCTGGCTCAG (SEQ ID NO: 14) | 16S rRNA | Bacterial strain identification |
| 1492R | TACGGYTACCTTGTTACGACTT (SEQ ID NO: 15) | | |
| P922-3G56400F1 | TGGTTCGTCCACGGAGAATG (SEQ ID NO: 16) | AT3G56400 | qPCR analysis |
| P923-3G56400R1 | CCCATTGACGTAACTGGCCT (SEQ ID NO: 17) | | |
| P854-1G01580F1 | GCAAGCGAAGCTGGAATCAG (SEQ ID NO: 18) | AT1G01580 | qPCR analysis |
| P855-1G01580R1 | AATCCCATTGCCGGTAGCAA (SEQ ID NO: 19) | | |
| P926-4G01250F1 | ACTAGCAAACCCAGTGGCTC (SEQ ID NO: 20) | AT4G01250 | qPCR analysis |
| P927-4G01250R1 | CATGCCCAGACATCGGAGTT (SEQ ID NO: 21) | | |
| P888-1G80440F2 | ATCGCTACGCCTGAATACCG (SEQ ID NO: 22) | AT1G80440 | qPCR analysis |
| P889-1G80440R2 | CCAGGAATCGGAGGAAGCTC (SEQ ID NO: 23) | | |

TABLE 1-continued

Primers Sequences Used.

| Primer name | Sequence (5' to 3') | Targetted gene | Purpose of the primer |
|---|---|---|---|
| P866-1G27730F1 | AGTCGAGCACTGGACAAAGG (SEQ ID NO: 24) | AT1G27730 | qPCR analysis |
| P867-1G27730R1 | TAGCTCAACTTCTCCACCGC (SEQ ID NO: 25) | | |
| P245-AT2G37870F1 | CTGTGCCAAAGTTGGTGCTC (SEQ ID NO: 26) | AT2G37870 | qPCR analysis |
| P246-AT2037870R1 | GTAACGTCCACATCGCTTGC (SEQ ID NO: 27) | | |
| P930-4G13420F1 | TACGTGGGGCCAAAGGATTC (SEQ ID NO: 28) | AT4G13420 | qPCR analysis |
| P931-4G13420R1 | CCCTCCTCCTCAGACATGA (SEQ ID NO: 29) | | |
| P309-AT3G30775F1 | CAACCCGTCTTCTCCGAACA (SEQ ID NO: 30) | AT3G30775 | qPCR analysis |
| P310-AT3G30775R1 | CGGTGCTTGTTGTCCAAAGG (SEQ ID NO: 31) | | |
| P237-AT3G53980F1 | CCGTCGGTTACAAGTGTGGA (SEQ ID NO: 32) | AT3G53980 | qPCR analysis |
| P238-AT3G53980R1 | AGGCCCAATGTTATCTCCTT CA (SEQ ID NO: 33) | | |
| P329-AT4G37800F1 | TTGGTTCGACCCTTCTCGTG (SEQ ID NO: 34) | AT4G37800 | qPCR analysis |
| P330-AT4G37800R1 | CCCTGATGGGCACATTGTCT (SEQ ID NO: 35) | | |
| P870-1G35140F1 | TGGATGCGAGAACGGACAAA (SEQ ID NO: 36) | AT1G35140 | qPCR analysis |
| P871-1G35140R1 | CATGGTCGATCTCCGGGAAG (SEQ ID NO: 37) | | |
| P281-AT2G39030F1 | GAGTCTGGTCTTGCCTCCAC (SEQ ID NO: 38) | AT2G39030 | qPCR analysis |
| P282-AT2G39030R1 | ATGCGTCTCAAGAAAGGGGG (SEQ ID NO: 39) | | |
| P962-5G51190F1 | CCAACGCAAACCACCTCTTG (SEQ ID NO: 40) | AT5G51190 | qPCR analysis |
| P963-5G51190R1 | CAGCCGCATACTTACCCCAT (SEQ ID NO: 41) | | |
| P862-1G13260F1 | GGTGTTTCTACGACGGGGTT (SEQ ID NO: 42) | AT1G13260 | qPCR analysis |
| P863-1G13260R1 | TTAGCTTCCCAACGTCGCTT (SEQ ID NO: 43) | | |
| P934-4G17490F1 | GGCGATTCTGAATTTCCCGC (SEQ ID NO: 44) | AT4G17490 | qPCR analysis |
| P935-4G17490R1 | TTGTACAGGCCACGACCATC (SEQ ID NO: 45) | | |
| P882-1G74930F1 | CTTTCGACGCCGCTCAATTT (SEQ ID NO: 46) | AT1G74930 | qPCR analysis |
| P883-1G74930R1 | GGAGGCGTCAACGACTTTTC (SEQ ID NO: 47) | | |
| P918-3G55980F1 | ATTGCAGACGTGTCGGTCCT (SEQ ID NO: 48) | AT3G55980 | qPCR analysis |
| P919-3G55980R1 | CAGCACAGTGAAGCGGAGTA (SEQ ID NO: 49) | | |

Hierarchical Clustering and Gene Family Enrichment

*Arabidopsis* regulated genes were used to generate HCL tree using Multi Experiment Viewer (MeV 4.9.0 version, TM4. Raw data were normalized for every gene. Hierarchical clustering was performed using Euclidian distances, average linkage and leaf order optimization.

Gene enrichment analyses were performed using AmiGO website.

Results

To uncover how salt stress tolerance is achieved in SA187-inoculated *Arabidopsis* seedlings, RNA-seq analysis was performed to compare the transcriptome of mock-inoculated to SA187-inoculated plants under non-saline (Mock and SA187), and salt stress conditions (Salt and SA187+Salt). Compared to mock conditions, 545, 3113 and 1822 genes were found to be differentially expressed in the "SA187", "Salt" and "SA187+Salt" samples, respectively. To obtain a global overview, the transcriptome data were organized by hierarchical clustering into 8 groups and analyzed for gene ontology enrichment (FIG. 4A-F).

Figures 5A, 5B, 5C:
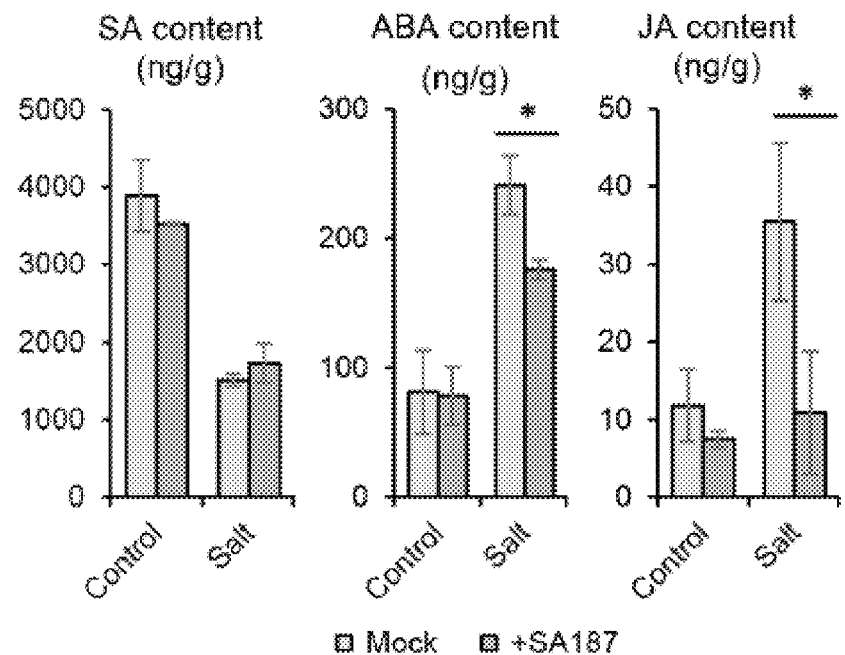
FIGS. 5A-5C are bar graphs showing (FIG. 5A) Salicylic acid (SA), (FIG. 5B) abscisic acid (ABA) and (FIG. 5C) jasmonic acid (JA) content of mock- and SA187-inoculated plants after growth on ½ MS with or without 100 mM NaCl (salt) for 12 days. Error bars indicate SE based on three biological replicates. Asterisks indicate a statistical difference based on Mann-Whitney test (* P<0.05).
Figures 5D, 5E, 5F:
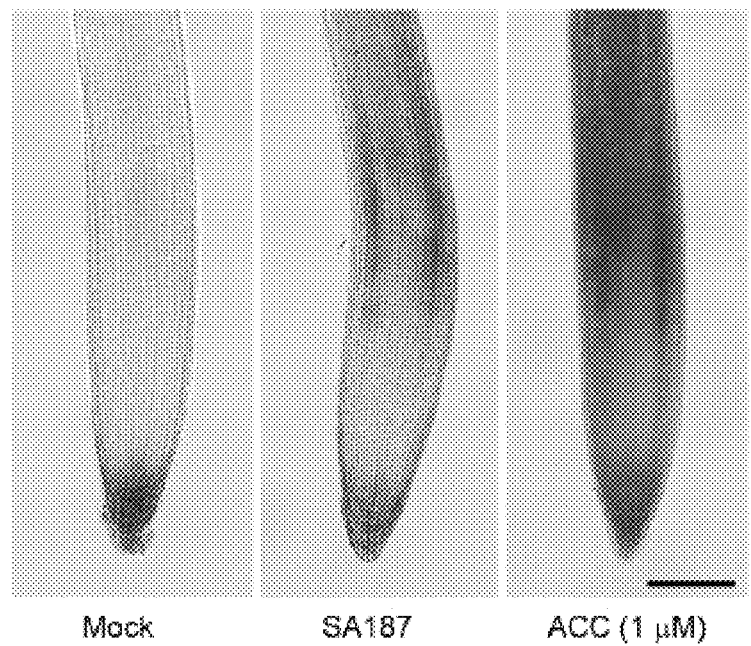
FIGS. 5D-5E are representative photos showing the ethylene reporter, pEBF2::GUS, in primary root tips of (FIG. 5D) mock- and (FIG. 5E) SA187-inoculated, and (FIG. 5F) ACC-treated 7-day-old seedlings under normal conditions (salt stress conditions provided similar results). Scale bar=100 μm.

Cluster 1 and 7 comprise the largest sets of differentially expressed genes with 1607 and 744 members, respectively, and consist of salt-stress regulated genes that were unaffected by the SA187 inoculation (FIG. 4B and 5F). Whereas Cluster 1 genes are strongly downregulated under salinity and are involved in water homeostasis, salicylic acid (SA) and defense response, those of Cluster 7 are highly upregulated and enriched in genes that are induced in response to water and salt stress or abscisic acid (ABA).

A specific effect of SA187 on the transcriptome of plants was found in Clusters 2, 3 and 4 (FIGS. 4C-E). Cluster 2 (354 genes) represents genes that are upregulated by SA187 independently of the growth conditions (FIG. 4C). This cluster was significantly enriched in plant defense genes such as chitin responsive genes but also in ethylene and jasmonic acid (JA) signaling (FIG. 4A-F). Importantly, Cluster 3 genes (246) are strongly downregulated in mock-inoculated plants under salt stress conditions but remain unaltered upon SA187-inoculation (FIG. 4D). These genes have a role in the primary metabolism, such as photosynthesis, carbon and energy metabolisms. On the contrary, Cluster 4 genes (464) are enriched in ABA and abiotic stress response and are upregulated in salt-treated plants, but not when the plants were inoculated with SA187 (FIG. 4E).

In summary, these data indicate that SA187 colonization triggers in *Arabidopsis* the expression of genes involved in defense response as shown by the significant enrichment for chitin responsive genes and ethylene and JA signaling. Moreover, under saline conditions, SA187-inoculated plants release themselves from the impact of abiotic stress (ABA), maintain higher metabolic and photosynthetic activity, and can therefore grow better than mock-inoculated plants.

Example 6: SA187 Modulates Abscisic Acid, Jasmonic Acid, and Ethylene Hormonal Pathways Under Salt Stress Methods Hormone Content Analysis For each sample, 10 mg of freeze-dried powder were extracted with 0.8 mL of acetone/water/acetic acid (80/19/1 v:v:v). For each sample, 2 ng of each standard was added to the sample: abscisic acid, salicylic acid, jasmonic acid, and indole-3-acetic acid stable labeled isotopes used as internal standards were prepared as described previously (Le Roux, et al., *PLoS One*, 9:e99343 (2014)). The extract was vigorously shaken for 1 min, sonicated for 1 min at 25 Hz, shaken for 10 minutes at 4° C. in a Thermomixer (Eppendorf), and then centrifuged (8000 g, 4° C., 10 min). The supernatants were collected, and the pellets were re-extracted twice with 0.4 mL of the same extraction solution, then vigorously shaken (1 min) and sonicated (1 min; 25 Hz). After the centrifugations, three supernatants were pooled and dried.

Each dry extract was dissolved in 140 µL of acetonitrile/water (50/50; v/v), filtered, and analyzed using a Waters Acquity ultra performance liquid chromatograph coupled to a Waters Xevo Triple quadrupole mass spectrometer TQS (UPLC-ESI-MS/MS). The compounds were separated on a reverse-phase column (Uptisphere C18 UP3HDO, 100×2.1 mm, 3 pm particle size; Interchim, France) using a flow rate of 0.4 mL·min$^{-1}$ and a binary gradient: (A) acetic acid 0.1% in water (v/v) and (B) acetonitrile with 0.1% acetic acid. For ABA, salicylic acid, jasmonic acid, the following binary gradients were used (time, % A): (0 min, 98%), (3 min, 70%), (7.5 min, 50%), (8.5 min, 5%), (9.6 min, 0%), (13.2 min, 98%), (15.7 min, 98%), and the column temperature was 40° C. Mass spectrometry was conducted in electrospray and Multiple Reaction Monitoring scanning mode (MRM mode), in the negative ion mode. Relevant instrumental parameters were set as follows: capillary 1.5 kV (negative mode), source block and desolvation gas temperatures 130° C. and 500° C., respectively. Nitrogen was used to assist the cone and desolvation (150 L·h$^{-1}$ and 800 L·h$^{-1}$, respectively), argon was used as the collision gas at a flow of 0.18 mL·min$^{-1}$. Samples were reconstituted in 140 µL, of 50/50 acetonitrile/H$_2$O (v/v) per mL of injected volume. The limit of detection (LOD) and limit of quantification (LOQ) were extrapolated for each hormone from calibration curves and samples using Quantify module of MassLynx software, version 4.1.

GUS Staining

Seedlings were vacuum infiltrated with the pre-fixation buffer [0.3% formaldehyde, 0.28% mannitol, 50 mM sodium phosphate buffer (pH 7.2)], washed with phosphate buffer and incubated in staining solution [250 µM K$_3$Fe(CN)$_6$, 250 µM K$_4$Fe(CN)$_6$, 2% Triton-X, 1 mM 5-bromo-4-chloro-3-indolyl-b-D-glucuronic acid (X-GlcA; Duchefa), 50 mM sodium phosphate buffer (pH 7.2)]. Tissue was cleared with Visokol (Phytosys) overnight and observed with Axio Imager 2 (Zeiss) equipped with Plan-Neofluar 10×/0.45 objective.

Results

Since the transcriptome analysis indicated possible roles of several hormone pathways in the SA187-induced growth promotion under salt stress, the levels of salicylic acid (SA), jasmonic acid (JA) and abscisic acid (ABA) were measured in mock- and SA187-inoculated plants. SA187 did not significantly change plant SA levels in the absence or presence of salt (FIG. 5A). Plant ABA and JA concentrations also remained unchanged upon SA187 colonization under normal conditions, but their salt-induced accumulation was significantly lower in SA187-inoculated plants (FIG. 5B-C), indicating a partial attenuation of stress responses in these plants.

To assess the level of ethylene in *Arabidopsis* roots and possibly confirm the activation of the ethylene signaling pathway observed in Cluster 2, the ethylene-dependent pEBF2::GUS reporter was used (Konishi, et al., *Plant J*, 55:821-831 (2008)). In contrast to mock-inoculated seedlings (FIG. 5D), the reporter line showed strong GUS activity in root tips upon SA187-inoculation (FIG. 5E), similar to the treatment with the ethylene precursor amino-cyclopropane-1-carboxylic acid (ACC) (FIG. 5F), indicating the activation of the ethylene signaling pathway.

Example 7: Ethylene Perception Mutants are Compromised in the Beneficial Response to SA187

To substantiate the phytohormone quantifications, *Arabidopsis* hormone deficient or insensitive mutants were analyzed. The JA-receptor coi1-1 mutant (Xie, et al., *Science*, 280:1091-1094 (1998)), JA-insensitive jar1-1 (Staswick, et al., *Proc Natl Acad Sci USA*, 89:6837-6840 (1992)), the ABA biosynthesis aba2-1 mutant (Schwartz, et al., *Plant Physiol*, 114:161-166 (2997)), or the ABA receptor quadruple pyr1-1pyl1-1pyl2-1pyl4-1 mutant (Park et al., *Science*, 324:1068-1071 (2009)) maintained the SA187 beneficial activity upon salt stress, indicating that ABA or JA may not play a major role in this interaction (FIG. 6A-B).

However, the ethylene insensitive ein2-1 and ein3-1 mutants (Guzmán, et al., *Plant Cell*, 2:513-523 (1990); Roman, et al., *Genetics*, 139:1391-1409 (1995)), impaired in ethylene perception, were strongly compromised in the beneficial effect of SA187, indicating that ethylene sensing could be of importance in SA187-induced tolerance of *Arabidopsis* to salt stress conditions. This result was confirmed by the up-regulation of the four ethylene-induced genes, ERF105 (FIG. 6D), ERF018 (FIG. 6F), RAV1 (FIG. 6E) and SZF1 (FIG. 6G), upon colonization by SA187. Moreover, application of 100 nM ACC during salt stress could largely mimic the beneficial activity of SA187 on plants (FIG. 6C).

Figure 6A:
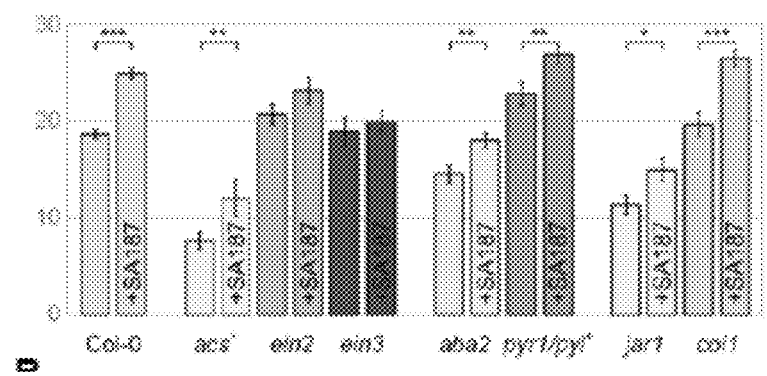
FIGS. 6A and 6B are bar graphs showing (FIG. 6A) the fresh weight (mg) and (FIG. 6B) beneficial index (fresh weight ratio between SA187-colonized and control seedlings) of mock- or SA187-inoculated mutants in hormonal pathways transferred to ½ MS+100 mM NaCl for 12 days. acs=heptuple mutant acsl-1 acs2-1 acs4-1 acsS-2 acs6-1 acsl-1 acs9-1, and pyrl/py1=quadruple mutant pyrl py/1 py/2 py/4. All plots represent the mean of three biological replicates (n>36).
Figure 6B:
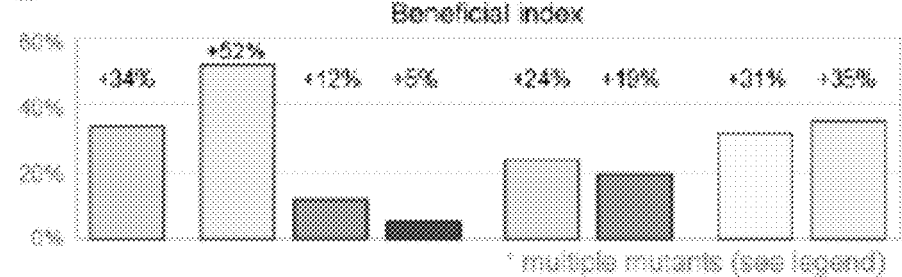
Figure 6C:
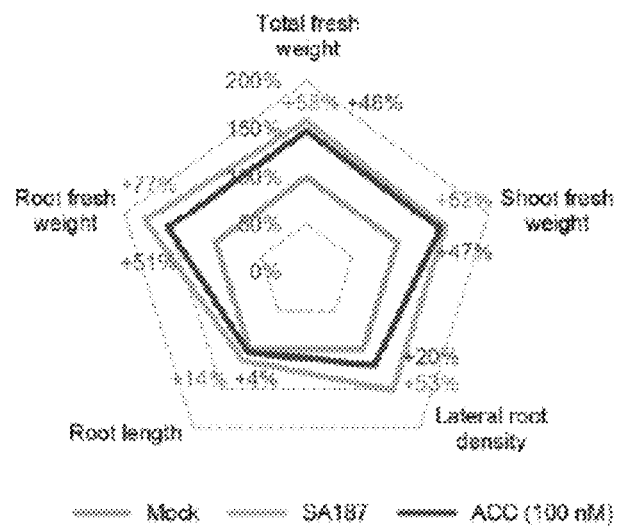
FIG. 6C is a graph showing *Arabidopsis* growth parameters under salt stress. 100 nM ACC partially mimics the effect of SA187 on salt stress tolerance improvement in *Arabidopsis* seedlings. Five-day-old-seedlings were transferred to ½ MS+100 mM NaCl with or without ACC and evaluated after 12 additional days. SA187-inoculated plants were used for comparison.
Figure 6D:
FIGS. 6D-6G are bar graphs showing qPCR expression analysis of four ethylene-associated genes, (FIG. 6D) ERF105 (At5g51190), (FIG. 6E) RAV1 (At1g13260), (FIG. 6F) ERF018 (At1g74930), and (FIG. 6G) SZF1 (At3g55980), in 17-day-old mock- (gray bar) and SA187- (green bar) inoculated *Arabidopsis* seedlings exposed for 12 days to ½ MS with or without 100 mM NaCl. Normalized expression indicates the linear fold change compared to mock-treated plants on ½ MS. Values represent means of three biological experiments, each in three technical replicates. Error bars indicate SE.
Figure 6E:
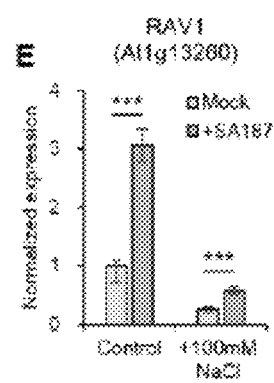
Figure 6F:
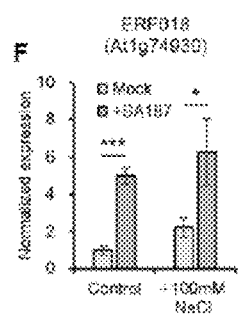
Figure 6G:
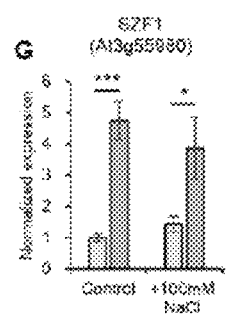
Figure 6H:
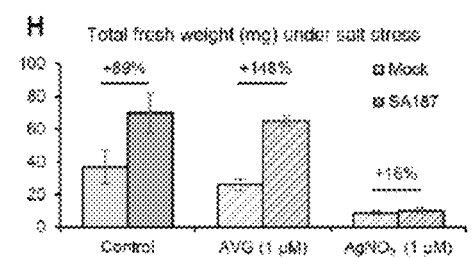
FIG. 6H is a bar graph showing total fresh weight of mock- (gray bars) and SA187- (green bars) inoculated 18-day-old *Arabidopsis* seedlings on ½ MS with 100 mM NaCl supplemented with the ethylene synthesis inhibitor AVG (1 μm) or ethylene signaling inhibitor AgN03 (1 μm). Error bars representing SE and beneficial index(%) are displayed. Asterisks indicate a statistical difference based on Student t-test (* P<0.05;  P<0.01; * P<0.001).

In contrast, the heptuple ethylene-biosynthesis deficient mutant acs1-1 acs2-1 acs4-1 acs5-2 acs6-1 acs7-1 acs9-1 (called acs in this study) still showed full sensitivity to the beneficial activity of SA187 under salt stress (FIG. 6A). Additionally, the SA187 beneficial effect was maintained when plants were treated with amino-ethoxy-vinyl glycine (AVG, 1 µM), an ethylene production inhibitor blocking ACC synthesis (Schaller, et, al., in: Ethylene Signaling Methods and Biosynthesis, pp 233-235 (2017)) (FIG. 6H). However, when plants were treated with silver nitrate (AgNO$_3$, 1 µM), which interferes with ethylene perception (Schaller, et al., in: Ethylene Signaling Methods and Biosynthesis, pp 233-235 (2017)), inoculated plants did not exhibit any SA187-induced tolerance to salt stress (FIG. 6H).

Altogether, these results indicate that the beneficial effect of SA187 may not be mediated by JA perception or the ABA pathway, but rather by ethylene perception, as it was found to be necessary for SA187-induced salt stress tolerance on *Arabidopsis* plants.

Example 8: *Arabidopsis* Upregulates the Methionine Salvage Pathway in SA187

Methods

Measurement of In Vitro Ethylene Emanation

A fresh SA187 culture was prepared by inoculation of 50 mL of liquid LB medium with 1 mL of overnight-grown culture. Subsequently, 2 mL of fresh culture was transferred to 10 mL chromatography vials and sealed with a rubber plug and snap-cap (Chromacol) after 0, 1, 2 or 4 hours of growth on a shaker incubator (220 rpm, 28° C.). The sealed vials were again transferred to the shaker incubator for another 2 hours to allow ethylene accumulation. Three biological replicates were prepared at each time point along with 3 controls to correct for background ethylene emanation. Ethylene emission was measured with a laser-based photo-acoustic detector (ETD-300 ethylene detector, Sensor Sense, The Netherlands) (van de Poel, et al., *Methods in Molecular Biology: Ethylene Signaling, Methods and Protocols*, 2017). Immediately after the ethylene measurement, OD$_{600}$ was determined with Implen NanoPhotometer NP80 (Sopachem Life Sciences, Belgium) to correct for the total amount of bacterial cells present in the samples.

Results

Figures 7A, 7B:
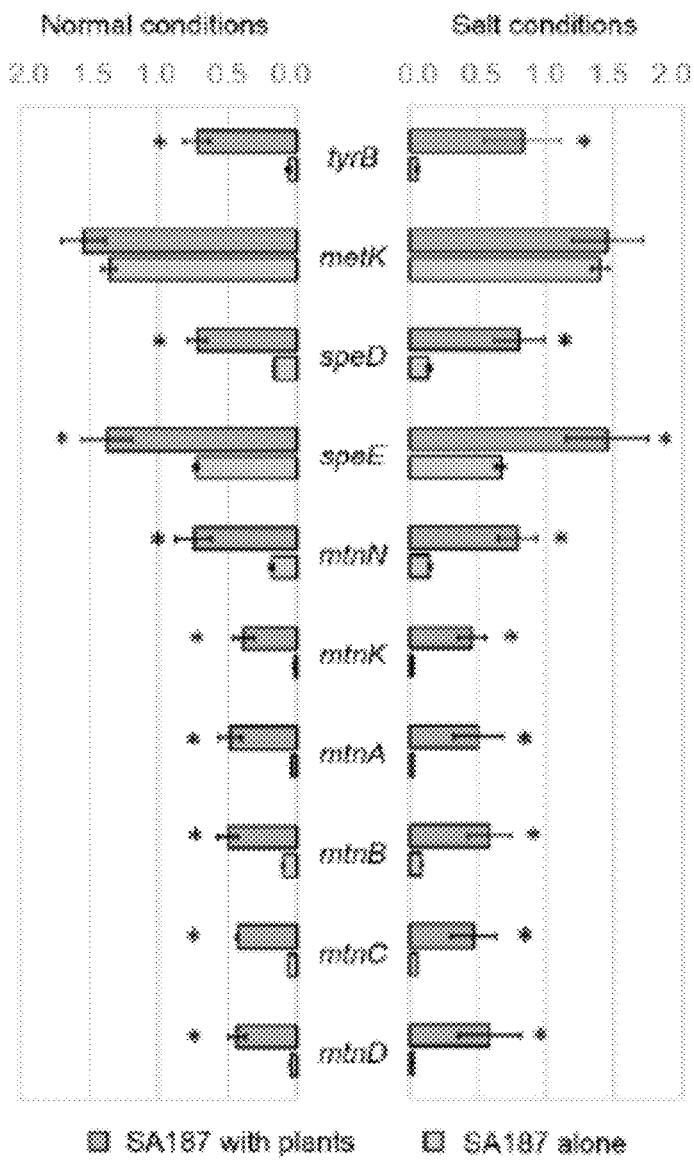
FIGS. 7A and 7B are bar graphs showing qPCR analysis of the methionine salvage cycle gene expression of SA187 colonizing plants in (FIG. 7A) control or (FIG. 7B) salt stress conditions compared to SA187 alone in ½ MS with or without 100 mM NaCl. Values represent means of three biological experiments, each in three technical replicates. Error bars indicate SE.

The previous results suggested that ethylene most likely originates from SA187 cells rather than from the canonical plant ACC synthase (ACS) pathway. To support the hypothesis that SA187 provides ethylene to promote plant growth, the genome of SA187 was searched for bacterial genes encoding ACS or ethylene forming enzymes (EFE). No ACS- or EFE-related genes were found in SA187, but the methionine salvage pathway is conserved in SA187, and one of its components, KMBA, is known to be an ethylene precursor (Eckert, et al., *Biotechnol Biofuels,* 7:33 (2014)). While SA187 alone did not produce ethylene when grown on synthetic media, the expression level of most of the genes encoding the KMBA pathway were upregulated in SA187 upon plant colonization compared with bacteria incubated for 4 h in liquid ½ MS with or without 100 mM NaCl in the absence of plants (FIG. 7A-B).

Figure 7C:
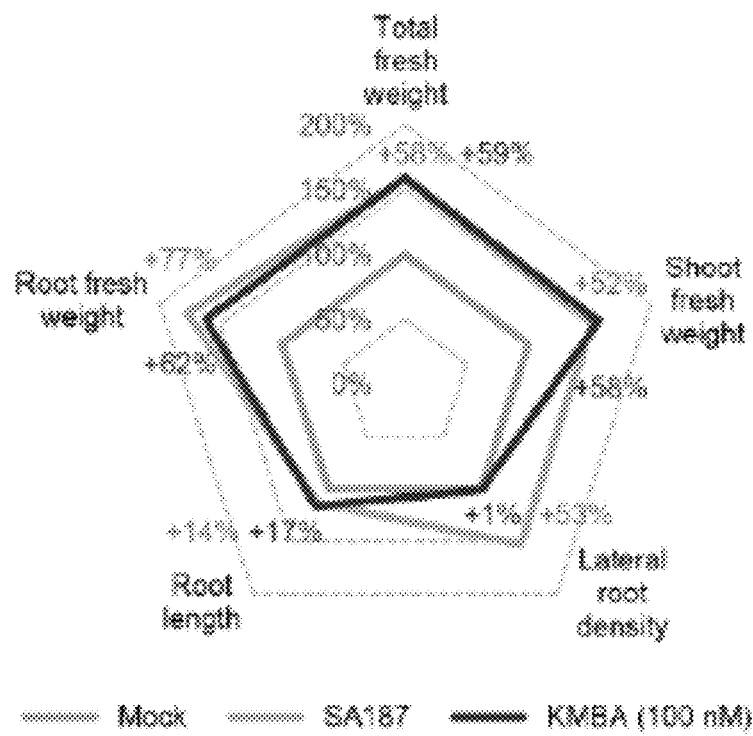
FIG. 7C is a graph showing *Arabidopsis* growth parameters under salt stress. Mock plants were transferred 5 days after germination to ½ MS+100 mM NaCl with or without KMBA and evaluated after 12 additional days. SA187-inoculated plants transferred to ½ MS+100 mM NaCl were used as a positive control.

To confirm that KMBA could function as an ethylene precursor during the beneficial plant-microbe interaction, the effect of KMBA on *Arabidopsis* in comparison to SA187 inoculation was tested. Under salt stress conditions, application of 100 nM KMBA induced a similar beneficial activity on *Arabidopsis* as SA187 with a similar increase in both root and shoot fresh weight (FIG. 7C).

Figure 7D:
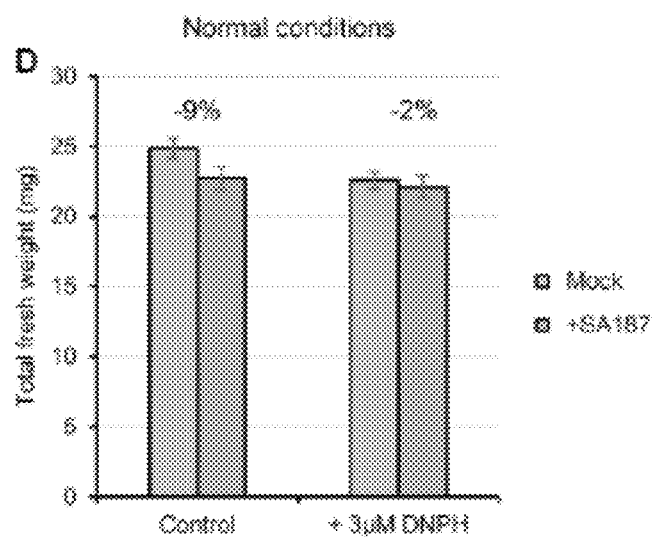

2,4-dinitrophenylhydrazine (DNPH) is a known interactor of KMBA in vitro that was previously shown to precipitate *Botrytis cinerea* produced KMBA and consequently impair the production of ethylene by photo-oxidation (Chague, et al., *FEMS Microbiol Ecol,* 40:143-149 (2002)). When plants were cultivated with 3 µM DNPH, SA187-induced salt tolerance was greatly reduced from 68% to 14% (FIG. 7D-E), showing the importance of KMBA in mediating SA187-induced plant tolerance to salt stress.

While in the foregoing specification this invention has been described in relation to certain embodiments thereof, and many details have been put forth for the purpose of illustration, it will be apparent to those skilled in the art that the invention is susceptible to additional embodiments and that certain of the details described herein can be varied considerably without departing from the basic principles of the invention.

All references cited herein are incorporated by reference in their entirety. The present invention may be embodied in other specific forms without departing from the spirit or essential attributes thereof and, accordingly, reference should be made to the appended claims, rather than to the foregoing specification, as indicating the scope of the invention.

SEQUENCE LISTING (49 sequences)

SEQ ID NO: 1 - DNA, 2127260 bp, Enterobacter sp SA187
cggagtggacgcatcactggtgttcgggttgtcatgccaatggcattgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagatgttttggcgtgatttgagagattttcagctgatacagattactgtttaatgccttaaggcgttagacgaacagaatttgcctggcggcactagcgcggcggtcccacctgaccccatgccgaactcagaagtgaaacgccgtagcgccgatggtagtgtggggtctccccatgcgagagtagggaactgccaggcatcaaattaagcagtaaaccggggtgacagccggtagttgtaaagaaattcggtggagcggtagttcagtcggttagaatacctgcctgtcacgcagggggtcgcgggttcgagtcccgtccgttccgccacttatttataagacgtcttttaacgtctttgcgaaagaaaccgtatcactcaggtgatgcggttttttttcgtctgtagaaaacccactgcaaccctgcgtattacggcgttgaggcaaatgaccaacggtattacctcaccgttggtcatctcattaccgtctgattaacccttcctgtttcccgccagcgccagcgccaaacacgccaccgcaacaggacatgccagccagataaacacatctgacagactttgtgcctggctgaacagcaatccccctgacaacgatccgcaaatagaacctgcccggcctgcgcttaatgcccaactgacgcccgttgccctggcatgggtcgggtagaaagttgaagcaagcacgctcagattgttcatcgttccggtcagggtaaagcccagcacaaatatcaccgccagtaatgcctgcggatgcgcaagctgcgcgccggttaaggttaacgtgatcgcggcgataacgctggcgactgtcagtacatgcaggctcgataaacgatccagcaatgtcgccattacgatcccgcccagcactccgcccaggggcaacatagctgcgatatgggtcatttctgccactggataaccgcttttcgacaggatcagcggcagccagctggtcagcagataaaacacaaacataaaggcaaaaaaggcgcaccacagcaccagggtaacgcggatagtgtctctatggaaaagcgccgcaaccggcgaggacacctgcacggtttcgttattgatataacagaccgtctcgttttttatgcccgttattttgctgacgatatggttgagctttttacggtatcgatcgcggcccgccataaagcagagggattccggcaaccagactatcgctatcgggatcagaataagcggagcgaggcctcccaccagtagcagaccatgccactgaaagatcggtaaaatgatcccggcgatccagcctcccgctgcgagtcccagcgtaaaaccggaatagctcagggtcactaacaatattttgctgcgtgacggagaatactctgaggcaagcgtaatactgttgggcagaatagcgcccatgccgatccctgtgataaagcgtaacaccgtcatttccatcaccgaatcggtcaggatggtcgccagcgtgccggtcgccacgatcataaggcttaagatcagaatgatctttctgccgtaccggtccgcaagaattccgaacccggtcgccccggcgaacatgccaaataatccggcggcaaacaccggagccagttgctgcggcgaaatgtgccaggctttggtgagcgtcggcgcaatatagccaataacagcggcgtcaaaaccatccagcactaccataatgcagcataacagcagcactcttatctggagcgcggaaagcggcgccgcattgattacgtcagaaatagccagacgattgtcgtccatgttaattttccttgaagatgattatgttaaagagcaccgtcctgtccgggaataaataaggcagggcggtttgggtgattacagataaagcgtgaacagtaaattgagctgcgtgtcgaatggcgctgcgccatagagcgtatctttgccaggtgaataatgctgccactgcacagccgtatcccagcgcgtaaagtggtaacgaaattcgccccagtacagattgctgtcgttaacctgatcaagacgaaccatggcgttcacatccagcttatccatcagactgtcctgccagttaaaaaagaagaagatcccctcgcgggtggcgatttcctgtgaacggacgagataagcgctataagcggcctgcatagccggaggcgacgtcctgagtttttcccattcgtcacggttgggggcggcttcgttatactgatactcagcggtcagcgagattttactggcggaggtaaaggttcctccgacggccagctgtgagcgaaaatgcccggcggtatcccgttgccaggctttgtcccactgatcctgctgtttgcctcccgcccactctgcatagagcgtcgtgttgtcattcagcaacagacttaaattgacgcccgtctgcaaagcttcgtcttcggagaagagcgccagaaactgtggcttgagccggtcgtttatctgtggactgtaactcagctgtccacggtgctggttattggtgctgcccaaatccgcgctgaaggaggcggtgctgctttcctgcgacaggcgcggcgaccagagcagggacaccgcgccgctgtcccacagccactgactgttcagcatcacgctgccctgacgattctgccgcaggctggtcggatcgatatcggtaacgacgcgggttgcgccatcgcgaaaccagtcggtcggcgaatagccagtcgcaacgccgttgcggatgttgatccgtccggcatccaacgccagcccttccacgggctgccagttcaggtaaccctcctgccaggtatttatggtgtggtggcccgtcaggccagcggtatcaaggtgatccagccggtcgcgaaacaccagtcgcagggtgtcggtcaggccgctgtcgaggctgaactgctccgagccgcgccagtagcggctctgtccgtcgtcacggttctgatagcccgccgcgccgtcgatttgcaaacgccaggcttttggcgcggctgattcaacagccgcttcgtccgccagcgccagcgccgccagcgaactgtcatcagcctgcgcccccgctgccattaacagcccgcaggctgaagcaatgatgaacggtttcatggcgtcgcatctgcccggaagttgaccagatagtcgcgctggaaccagcgttccgggatgtcacgaaagtgataatcctgattgcgcataatagtgacgagctgcggatccagtccgtcaatgatcacgatttcagtcggacgcgatgcccccagctgttgctgataacggcgataccaggcggttttcagcaggcgctcgctctcgctgtaaaactgcgctttgatcggatcccagccctcttttttcacccacagctcaatgtggtgatagaccgcctgtggcgtgctggcctttaacgtcaggcggatgctgacctgctgcttacggtggccgtcttcaatgacttcttccgcctgggccgtggctttatagtcggcggcaaaattggtggataccacatcgccattggctgcctgtcccagcaggcgctgctgcggcgaaatacgcacgctcgctttgctggcgggctcatagaaccagatgtcctgatcctgtttaagcatcagcttaccggcatcgcgctccggcgcggtaaagcgcagcagactgcggtactgaccgctgcgcggatccggacgggaataaacgatcaccgtggtggcgtctttctgtttgccgttctgataatccagcaactgagtggtcagtgaaaaactttgcgtcgggttacggatcgcatcgctggcagagaggatcgcctgtggatcctgggcggcaaaggccgctggcagataacacaacaggccgcagaccatcaggcgagcgcgcttccttgtaaaaaacatacacttttcctttcgtttgattcagacatgccgcagggcatcgataatgttcagaccggccgcccgtcttgcggcaaagccgacggcgaatacggccagacaggccgcgccaaggctgacctgcgcgataagcgccggatggctcgccacgttcgccagtaatggcactgaataggtcatgcccggcggcacccagcgcagggagaacaggcgcagtgctgcatcccccgtcagcgccagcgcaatgcccgcgccgcagcccagcagcaccatcagcaggctttcagtgacaaacaggccgatcacgccgctacgctgtacgcccatggcgcgcagcgtgccgatttccgtggtgcgctccatcaccgccatactcatggtgttgccgatcatgaacatggcgacaatacccaccagcagcgacgcaaggccaaaaaaggtatcgaacatatgcataatctgaccgtgcatcgggttaagctcgaaaacgtcatgcagctccaggcgctgatcggcaaaggaggtcgccatcagcatgtcgatccgcgcccgcgcggcggcaatctgatcggtgtgcgcaagctgaatgataatgccggtcacgcgacggtctcctgcgccgaagaccagccgttgcgctgtcgacagatgcatcgccagatagacgttatccagcggctgtaagccctggtttagggcatcgatcaccgttagccgcgcaatatcaggcgcgccggtcagacgcgtggtcagcacatctacctggcggtcggtttgttgcgccaggctttgcgtctgctgactggcaagcgcggcgatatcctcatccagcacggcggcggcctcgttatctgccacggcagccgacggcggcggacagtcctccagcttcagcgtatggcacagtccgaggatccgggcaacgccggtaccgataagcgcgctgttctccccggtgcccgccagcgggtaggacggtgtggtgatcgggtagttatagtcattccactgctgcaactggttttgctcgtcagggatcacgccgctgatcatcacctgggtggaggtctggcgcaggaaattaccggcgatcccgccggtatccagcaccggcgtcaccacgcgcagcattggctttaacagcggatcgttttcgagagtcgcgatcagccgatcgctgtcggcaatgctgaaggcggtgggattgccgctgccgagcgccatatatcccgcgcggtgaagttgcagatggcccgcgcgctgcacataggcggtttccagcccgctggcgatgtcgctgacaaaaccgccgaacagcaacagcgcggcggtgccgatggtcagcgccagctgcgttgaaagggtacggcgaccattacgccgcagattacgtaacgccagacgcagcaatttcatgacgcctcccggactaactggccatctttcagggtaaagaccctgtcggcatgggcgatgagctgcggatcgtgcgaggaaaaaacaaaggtggtctggtgctcgtgctggagcctgcgcatcagcaggataatttgcagcccggtggcgctgtccagattcgccgtcggctcgtctgccagcaccagttttggggtatgcgccagcgcgcgggcgatcgccacccgctgacgttgcccaccggataattcccccggcatggcgtcggttttacctgccagcccgacctcatcaatcaggcgggccacgcgcgcgcggcgttgcgccggcttcatgccgcacatcagcagcgggtattcgatgttctccccggcggtcagtaccggcagcaggttgaagttctggaacacaaaaccaatgtgggtggcgcgatacgcggtcatctggcgatcggaccagccgcgcaccgactcgccgtgcagataaatctcgccgtcgtcctgcttgtcgagacagccaataagattgagcagcgtgcttttaccgctgccggaaggccccgccagcacggaaaactggttcgcagggatcgcaaggctgacgtcgctcagcgccgctacccgctcccggcccatctgataatattttgcaaccttgctcagggtgacggcggtcatagtgcctcccggtactgccagctgatgtccgccaccgaggcaaaacgcgcgggcacccgccagcgcagcatattttgcgtgatatccagcatgtgcaggctcatggccgccatcagccgtggcgcggaaaccccggcgaacatatcgcgactgcgggcgatctcccgtgccgtgtcggcacgctgttcggcgctggcgaaacgcgcttttgaacgcagcatgcaatgaaagctgcggatatccccctcatcgggcagcagtacgggcgcgtcggcatcccgggcgttcagcagcctggccccggcgttatccagcaacagcaggccgttggtggcgcgcggattacactctacgatggccaggccgtcccgcgtctccatcagatcgaagctgatttggccgctgagggaatgctgagcgataaagcggcggcagaaggcttcgacatcagggtgacgcagcgcctcaaagccgaaggccgcgctctgtttccagcggtggcggggcagatagcaggcgtgggccagcagtttacccttatgcgcgaggttgtaggtgcaaagttcacgaccgatcagcttttcctggattagccagcggccgccatcgcggcgggtgagttgcgcttccatttgggggatggacggatccatgaataccccatgaccgaagctggaaaactcctgtttaagcagcggggcgcgataatcgacagaaaagcggcgccagtctgccacgctgcccaccacctcagtgcgcggcgtaatcagccccgcatctttcgccagcgccagcacctcgtatttgctgtgcaaacgggtaatcagcgtatccgacagggcaaagagttcgatggacggatccagccgcccgagggcatgctgccgcgccagccagaagctctcttcaaacatcggaataaggcgtgtcgccggggcctgttgcgccagccggtttaccgcctcaagaaaacgctgcggatgggcgcgtaaacagggcaggcgaatgaaaggcacgtccggcgcgataagttttgaaagcgcggcgcggttgctgtcgatagccgtcacctgcgcaccggcctcctgtaacgaacgggcaaaccaggcggcgaagggaaagcgaaagccgctgattaaaaaccgggatgtattcataacgatgcttcttccctgagccagtcgatcatgctcgccgcaacctgcggcagagcgtcatgtttaagcatttcatagtggttagcgttcacgcggcgcacttccacggcggcggtaaattgtccccagccgtagtcgcgctgttgcaggttttgccggaactggttcatcgcctgggtcagcgtttcatcgcccagcagccgcagcgagagatgagaaaaccagtcgatgcgattgcgctcgccgcgcagcaacagcagcctgaccgggcaggtctgcggccggtagcgcatgacggcgttattgatgctgatataggtagccagcgtgcgctggatttgctgcggactgagccgccagctccgcccgccgacgcgatagctgataaattccagcgccttccagcgtggaccggcaggcaccaggccgagcagcgagccgagcacgcccgccgccagggttttcccccattgcgggatcaggcgcagcagcgggcgttccgcggataccagaccgagaaaatcgcgcaggaacatctggaaatagagtttttccgacggcggcggaacgtcataaatacagaaggcgtcgataaaacagaggctgactttttccccggcgcaggccagctgtcgcgccatctcaaaggcggtctgcgcgccgaaagagtaagcgccgataaaataaggcccgctgggctgcgtgctgcgtaccgcctgaagatagtaagcgctcatctcctccacgctgtcgagcggcgtggtgccttccgcaatgccggaggcctgcaggtaatagacgtcggcataaggccgcaacagcggcgtcaggccggtgtagtgtgaaatattgccgtccccggcgtgaaccagaaacagcgatggccgcacggtggcgttggtcttacccattattcatccctgatgtcgttatgtttagcggcggcgcgtccttccccgctgcgccgccgtagtgcatttacgctttgataagcgggcttgccacagccggtttcagcggcctctgttcttccaggagctgtttcgcgttggggcggcggtacatatcctccagctctaacgtcagaccataatcgctgcgcagttcatagaggatctgcacgatcaccagcgacgtcgccccgtaatcgaggaagttcgcttcataaggcagatcctggccgatgtacttctggaacacggaaaacgcctgcgggtgcgcggcaggtttttcagaatcgctggtggtctggctgatgagcgtcaatagcgcccggcggtcaaatttcccgttagcggcattgcgtggcagttcatccaccagatggatatgctgcggcaccagccactccggcagatggcgctgacagtgctggcgcagggtggcgacatcgcagccgggggcgaccaccacgctgtgcaactgttttagcgccccctcgctggcaagcgtggtgcagtacaccacctgcggatgcgtcatcagcgcgccgtcaatttccagcgggttaacccggtagccggaaatcttcacctgaccgtctttacggccgaagaaggtcagcccctcttccggcgaccagcgcaccagatcgccggtggcgtagcgttgcggcggcaacaggccctcccctggcgcgatgaacgggcgatcgcagtagccgcgtgcgacgtgacgccctgcgacaatcagctcgcccagacatcccgccggtacaggcaggccattttcatccgccaccataaaggcgcaatggggcaggggctggccgatgggcacgccggttttgcggtacgcctccattttttgcgcctcgacctgcccggcgctgacgatacaggtggcttcggtcgggccgtaggtgttgaatagcgcaggcgtgcgcggcagcgcgaaccagtgttgcagcgtttcgtagcgcatctcatcgccgccggtaatgagaaacgccaggctggccgggaagcgcgcctgtctctcctgcatccagggcgtcagtagcgaccagaacggcgtcggcagcgaaatgtgcgtcggctgccagcccatcagcagatcaaggaagacggcaaagtcacggcgtacttcccggtcatcgcttgtcagcagcgtgccgcccgcgcacagcgtgccgtacacttcttccacgctggcgtcgaaggtcagcatgttgaattgcagcatgcggctgttgcgatcaagggtatagagcggaatggcgctggcgataaaggtcgccagcgcagagctttgtacacagacgcctttcggttcgccggtggagccggaggtgaaaataatatacgcatccacctcgtccagcgccgtcaggtcgggctgccagagcggtaacccggcgctgtccagacgcaggcggtgtttacgatacagcagcttgcctgcgggttcggaggtatcgccaatgatcatccggcagccgcaacgcgtcagagcggcgtcaagccgaccgctgcgcagatcttcacaggccagcggaatgtagcagacgcccagcgacaggcaggccagcatagcgatgatggcatggtggcgtgtcgacagacagagcgccacccgatctccggtcttaagcccgtaggtggtcagatcctgggcgcagagatagaccgcctgccacagttcgccataggtgagcgtcagcgtcggggtttccagcgcgatacgccaggggtcatcagcggcatgctggcggatgaggctcagcacgtgaggggccacgggcagatcctgctccggctgaagcgcaagcgcgggaaggctgcgccttaccttttccagtgccagccgctcgcctgcctgacgcagataatgcacgcagctttgcgcgatacgttgcagctgtggcgcgctgaacagcgtcccgttgccgatgaaattcagttcaatatcgttatccgacgcattcaccatcagcgacaccggcacgtcatcgtcttccgcttcgtagatccactctacgctgacggggagatcgccaaattgcagggtttcctccggcacatagttgaagtgcaggctggctccccgggcggtcggcgcgtcggcgctgcggatttccagggcaatatcgtctgccagctgttgcaggctcgcgcgggtatctatgttgagcgacagcgtgcgcggctccatcatcaggccgaaagtctcgcgccagcgtgccgctttgcggttatgggtaaaaatgccgatatccagcgtggattgctggcaaacatcggcaaaggtggcggcaaacgcggccagcagcaggtttgcctgcgcctggtgtgggcgtgcgggcgaaagggcctgcgtcagttgccggaaatggcgcagcgcgtcaccgctgattttctcctgcaccagcaggttatgcccgctacggcagtgcgcggcggcaatgccatggaagctcagcggcgcaggcggctgtggcatcagtgcctgagacgcgctgaacgccccgggcagctgcggataatgacactccggcagaacggcatcgggcgcgtgatagcggcgggacaccgccgtaaacatcacccgcgcggcgtggtgatcgtaaatcagatggtggcagcggaagaaccagacaaactgctgctccgccagctggaacagccacgagcccgccagcggcgccagcggcgaccagggctgcttattcagacgggcgatctccgcctgcacatccgcatcgctgttgcgtaaatcgataaactggtgagggatcccgcacatctcgtcgtgccacagcgtgatgtcacggccctgctgctgataaacggtgcgcagtgcggtgaagtgacgcgtgacgtcacgcaccgcctgcgccatacgtccggcatccagcggcgcgttgatgctgtagctttccccccagttgtaggtcagtacggcaggattgcgcgccatggcgttaagcatgggctgctgctggcgggttgggttgagtcgtttcagcggtgccggacgcagatgcagcggttcgatagccggaagcggctcttgtgccggaacggcgatcagcctgctcagcgcctgcgccgcgcgtttgaccagcacatcgacatcatgctgcgccgcccattgcgcgttcatatccacatgcagcaccaggccatcgcgacgggcatcggtgcgcagggagaacaccacggacgcaccgtgcagaccgccgcccgcccagtcattcagccccgtcagttcttcctcatcctggcgggaggtggcgggcagaatggtgaacaccacgtcactgttgatcggcgcgccggcaatctgattaagctcgctcatggagatctgccggttgcggaacaggcggaacagcaccttctggcaccgggcgatccattcctgtaacgagcagggttgcggcacggaaaataacgtcggcagcagggtaacaaagtttcccagcgcttccggatccagtcccggtttatcacacactggcagccaggcgaggaagtcagtttcatcgctgaccacatgccacagccagctcatcacgctgtaataaagcgtattgagctgattttccggcacgcccgcgtgtcgcgccagctgcgcctgatcgcagggaataaaaaagttgcggcggatgatgcgagtggacgacagcgccggtttactgaacggcaataacgtaggcagggtttgctgccagtagcgggtgaccgcaggcggtgtgatttgcggcccgcactgctccagataatcgcagcgcatctccggaagcgcaccggcatcgtccacgcgtttgcggctggcgctgtagtccagcgccatggttttcaggcggcacagcgacagtccatcgacaatggcatgatgaatgcggaaggtggcgaccaatcgatcgccacagtaaaacaggcgggcgtcgtacagcggcgcgtcaaacagctctgcgggttcatattgccaggcttccagcatcccggcgatggtgtgggcgtcgcagacagtgggcgcggtgtcccactgcggcatcaggccgtccacatactggcgaataccctcgtcggtgcgggtaaagcgcacacgcaggatcgctttatcatgccacaggcgcgtcagcgcatccgtcacccgctgccagtcgtgaccggcagggaaagacaccgctgaaaccatctgaaagcgttcgctgtgcccgtggatcgcctggctcatgacgatttcagtttgctgtcggtataaagggaaggttatacgcgctgtcacttttgccctttctcccagttcgcgatgtgcttgtgggcggcggccagcttatcggcgtccattctggtctgttcaggatggaagcccggcaggaaccagggcagaaaatctttgatgatggtgacgtacaggcccttccagccatacagcttccacagcgtgccgggaatgctcgccagggtaagttcaccgcgggctttcatcgcgccggtgctgagttttaacagcagcagggcgaagatgaggaaagacgccagcgaccagacaattcggtgtggatagctgccgccggttttcatataaatatcgaaaggcacgctgcggtgctccacttcttcaatggcgtgccagtaccacagggctttcatttcatcgctcgccccctcaagccagcggggattgccgatcacctgtttgccgccgatggacgtcaggtgctccagcgcacaggtgactgcgagctggttacgcggcttaaggctgcgcagccaggtgaagcagcgacccagcaggcgttcgtttttttccacgaagcgctccggcaggcccagcgaacgattatatttattgtgccagcgcgtgtgctctgcttcctgatagtaaaaacggcgggcaatctcctgcgcctcttccatatcgggatgggctttcagcgtctgttttaccgagttgataaacaggcgttcagcttccggaaacatcaatgacagcgcgtcgagatttgccgcaagcgaggcgtcgcgttttaaccagtaaggatgctcttcatccggcgtgaatgaaaagtccatatggcgtagcgtaagttctgaagttaaattccctttcatcgtcattccttaatcagtagtggttatcaggcctttgcagtggaggaggtgcggccatgtttacggtgcgccgtcgcccaggtgtggctggccatcgcacaggccagcgaaagttcgcccgccagcacagtggcggcgacaatttccgccagtttgttggcttttcctgcgccctgacagcccagcagggcaagacccgcctgagcatagggctggttcacgccgccgccgacggtgccgacgatcagcgacgggatggtgatggcgactcgcagatcgccgtccgtcgtctggcgacagtccatgatcatgctgctggattccgccacgcaggcggcgtcctgtccgagggcgataaacagggcggcgataccgttggcgctgtggcaaccgttgctggtggcacccgccagccagccgcctttggtcgccagccagtacagctccataaactgttccggcgtggttttcatcaccttgtaaagctcgttcgcgggcacaacgatctcggcagatacccggcgtccacggccgctgatcatattgagggcggagtgctttttatcggtgtcgaaattcccggacagcaaatagcggtagggccacgggcagtggtcgaggagccataaacagagcttctcggtcacgatagtcaccatgttttgcccggcagcgtcgccggtggtgtagttaaagcgcacaaacaccgtgcgatccagcggctgcacgtcaagggaacgcagttttgcaaagcgcgaatgctcgctcacctgctgctgtagcgccggaagttgcgacggcaaccagtgggcaaaggcggtggcatcgatcatgctgtcgaagcaaaagaccggcgagcgctgcatgttctcgccgctgatcaccgtttttaccggattgtcggcgttgaacagcttcatcccccggtgatagctggcgaccattgagccttccgtggtggccagcggtacataaaatccgccgctggcgtactggccctgcacatgtaacggcccggcgatgcccaccggaacggacgccgtgccgatagcgttctcaatattgccttttaaggtttcggcattgagtgactcatcaaacagcggcgccagcgacacgccggtgtgctgttccagaaactgatgacgttcatgaatatcggcaggcagaaagtgttgcttgctgaagcggcgcggcaggggcgcggcggcggcaatggcctggcgtttgcgcatcagcttgccgttgccgttacgcggcagcgcagtgacgatatgaaagcagtgcggcagcttgtagtaactgagctgtgtggcgagccactggcgcaggacgcccacatcaaaggtggcggggtcttcaggcaccaggctggcaacaatgcgctgagtgatctctttgtcgtcctcgcccgttaccatgcactctttgacagcgccggatcgcagtatggcgttttcgatttccgtcggatcgagagtgaagccgcgggtaatgataagattgtcgattcgccccagatgacgaaaatacccgtcgctgttttgctcggcgcggtcgcccgtgatcagccagcctgcaaaggggccgcttttggcaagcgctctgtccgcgatgagaccgcgtactgccagataccccggcatacctgccggcagatgctggcctgactcatccagcaccgccacttcatagcccggcagcgctttgcccgtccagccggggcgggcgtcttcttcgcgggtggagataaaaatatgcagcgcttcggtgcatcccagcgcatcggttaacaccagcccggtggcttcacgccactggagggcaagatcttccgacagggtttcacccgcagaaatgcatttgcgcagcgttgatgtcgaccatccggctttcagtaaacggcgataggcggtaggcgcggtaaacagcaccgttgcctgaaaacgcgcgataatctctggcagcgttttaggcgacacttcccgaagtaataccgaactggcgcccaccgtcattggcgcaaagataagcgagcctaaaccataattaaaggagagcggcgcggtgcagacaataatgtcggcaggctgaggttttaatatattaacaacatagctttcgcagttggctttaatatccccatgactgtgaagcgttattttaggtttgccggtactgcccgaggtaaaagcaatgagggcaatgtcgctggcatggctttctggccagcaaaaagatgcagggactgcctcgagcagggagtcggagataaattcattattttccttttctgaatcaatgctaatcattctggaaaatagcggatggtgctcatcggggatatatttttcccgcaggctttcatcaataataatgagcgcaggggaggccagttcaataatattatcgaattccaccttgcttgatgccgggttcagggtggtgatgacgccgcccgcccgtactaccgccagccagcacagcgtctgggcaatactgcatggggcaagcaacgctactctgttgccgggcttaaagttatgtttaatcaacaaattcgccgcaatgagatctaccgttttcttaacatcacggtacgtccagttattgttaagcgttctgaaacaaagattatccgggtgcggcgtctgatttattaaccaggctgatatattaagtttttctgcttcctgcgaaagaaaagatgaagaactattggcaacgtccattgttgtctctgtaatatataaatgatgtgaatatgtttcttgtgaaaaatccttgagggacaggaatgtgcgtaatttcctattgcacttgtaactaagtgtataggtaacagaataacagtgtcaatgggggactgaaaattgaaatgtctgcggcaattaaagaccgagttgtgaaacgattttatcaattaaatgaaagagtttcctaatgcccgaaatataataaaaaatagcgattaatattatatccaccaggataaagcctaagccaggcggctaataagatacgctcttttttaacgggtatgctcgctgagaaaatcaataaaggcgcggatgcgggtacttaccgcccgatcgctgtaatagacggcgctgaaaggcatatccaccggcaggcgcttcgcaggcaacacttctaccagctcgccgctggcaatttccttatcgatcatataatccgacaggcaggcgatgccgttgccgccgagacacagctgtttcagggtttccccgctgttcgatgaaatgccgcaggtgatctcataaagctgtccatccgggcaggcgacaggccaggtattcagcgaaaccggctcggtaaaaccaaggcaggtatgcttctcgagatcctcaacggtttcaggtgtgccatagcgtgccagatagtccggcgaggcgatcatgcggcggtagctgctgaacagcgggcgggcgcgcaggctggagtcggtgagcttacccacgcggatcgccacatccactttacgctcaatcaggttgatgaatgtttcggacgagaccagcgacagcgtcatttccggatagcgttcgcggaagggtttgatgagcggcattaagtaatgcagcaccaccggtgtggcggcatcgatgcgcaacaggccgcggggcattaatctggcttccattacttcattttccgccgccgccatctcctgcaaaataagctgtaccctgcggaaatagcgctcgccttcttcggtcaggctgagctggcgggtggtgcggttgagcaggctgacgcccagcttcatctccagctttttcaccgcccggctgacggcggagttagcctggcctaattgttcggctgcccggctgaagctgccgctttccaccaccgccacaaaaattgccatctcttccgatgtcgccttcattattgcccctgtcgcaaaattattacgctattttaatgataactgacacttatgcatcatagttttacgggggcgcaggcggagggcctggtcccattaatgatgttttacccgaatagcgttgaaagtgtgcgctaaaatccctataacagaaaggctactctgcttccggggcggctcacagcgacagaggtttgaaaccaaaagtgcgaaagaatacctatgctatgcgctatattgccggtcaacctgctgagcgaattttgccgccaggttcattcgcgagcattggtcaggcactgccacctggcgcgcccttaagcagtgacgataagatccgcgtgctggtgtggaacatctttaaacagcagcgggcggaatggctctctgtgctgcaaaacttcggtaaagacgcccacctggtcttgctgcaggaggcgcaaaccacccctgaactggtgagattcgccaccaccaactatctggctgccgatcaggttcccgcttttgtgctgccgcaacacccctccggcgtgatgacgctctcctccgcgcatccggtctattgctgcccgctgcgcgagcgcgaacccatcctgcggctggcgaaatcggcgttggtcacggtatatcccttgccggattcacggctgctgatggtggtgaacgtccatgcggtgaatttcagtctcggcgtcgatgtttacagtaaacagctgctgccaattggcgatcagatcgcgcaacataacggcccggtgatcatggccggagattttaatgcctggagccgccagcgtatgaacgcgctgtaccgtttctccagagagatgtcgatgcgccaggtgcgctttactgacgacaaccgccgtcgcgccttcggtcgtccgcttgattttgtcttctatcgtggtctgaacgtggatcaagcctccgtgctggtgacccgcgcctccgatcacaacccgctactcgtcgaattcagtcccggcaaacctgataaataaaggcgtgtcaggtctgcccctgggcaggcctgcaaccatggagctgcccttcatttaactcacagaaggatgacaccatgaccacgcaatcccatcacgatcacgtcgaaaaacagtttggctctcaggccagcgcctatttaaccagcgctgtacatgcctctggccgcgatttacagcagctgcggacgcggctggccgaacatgccggctcgcagcttctggatctgggatgcggtgcgggacacgcgagttttaccgccgctggcgttgtggcgcaggtgacggcttatgatttatcggcacaaatgctggaggtggtggcgaaggcggcgcgggaaaaaggactgaacaatattgatacgcagcagggctatgcagaagcgttgccttttgccgatgcctcttttgagttggtgatcagccgctattccgcgcatcactggcatgatgtcggccaggcgctgcgtgaagtgaaacgcgtactgaaaccgggcgggacgctgattattatggacgtgatgtcgccgggccatccggtacggaacatctggctgcaaacggtggaggcgctgcgcgacacgtcgcatgtgcagaattattcatcaggtgaatggctgacgatgatcgctgaggccggactgatttgccggacgctgaccaccgatcgtctggtgctggagtttgcgtcctgggtggcgcgcatgcgtacaccgcagccgctgtgcgaggccatacgcttataccagcaaagcgcatcccatgaggtgcaacgttatttcgaattgcaggacgacggctcctttaccagcgacatcattatggtcgaggcgcagaaagcgcaataaaagcgggagaaataaaaaaggcaccggggaagcggtgccttttttcatcatcaggagtcaggtgtcgcgctgttcttcacaaacagcgtcagctgatcgccaggtttcaggttatcggtactgtcgttccagcgcatcacatctttgatgttcacgccgtgacgtttagcaatactcgacagcgaatcgcctttgcgaacgcgataggtaatgctatcgctgttgttcgccagggtctgcgcgctgctgcccgcaccgacggtcaggttctggccgaccttcaggcttgcaccccgcagattattccattgctggagatctttggatgtcacgccgagacgtgacgcaatgccagaaagcgtatcccctgaacgtactttatagcttcggctggtcagcggtttattatccgcgagcagcgtcggctgtacggcagcgatttcgccggaagccagtgattcacgcagctgttctgcatgtttctgcggcaccatcacatactgagggccgctcgaaccgagcgtcgagcctttaacgcctgcgttaaaggttttcagcttgttcacgggtattcccgccatttcagccagctggttaatctcaaccgggctgttcaacctgacgcgcgccagcgcacgactttcatctgtagaaggcagacgaacgccataacgcttgctgttcttgagaatatcgctcaaagccagcatttttggcacgtaaatcctggtttcctgtggcagtgaaagagaccaaaagtccgtgggtttaccccgggctttattcgctttcattgccttcagtacacgaccttcaccgctgttataggccgcgactgttaataaccagtcgccgtcaaacatacggttcagacgctgcatcatgtcgagcgcggccgttgtggacgccactacatcacgacgcgcatcgtaattgcgtgtctgttttaaaccataattgcgccccgtgctcggaatgatttgccaaatgcctgcggcattggcaccagacgtcgcgtgtgggtcaaaagcgctctccactatgggtagtagtaccagttccatgggcatgttacgtttcttaacttgccctgctatccagtacatatacggctctgcccgtaaagttacatcgtggagatagctcttattgttcaaatacttctgtttctgttcgcgaatccggccattctccggaattcccatctttagctcgtcgccaatgagagcccacaagtcttgatcctgcgcgaaggatgtcccatcgtccatccagcgtgcttgactcgtaaactttcctgcttccccttgaccagctgcagaaaggctctgtgcgtgctgttgaacgttgccatcttgattagcctggcaacccaccagcaggacagaggcgagtaatatcgcttttgccttcatgtgtgtgtcaatagttgcttaaaagacgaccgatcataacggcgatgtttgcagaagacaagcataaccgtcagaagtcatctttctttgcccgcaaccaggcaaaacgctgctcaggctgttgcaaatttgtttctttatttatttgatcaattaaaacagggtcttgcgtacgtaaaaataaatttatatggcgttcatttttcagaaaaacgggtaatgtcttttctttttttgcgcgtaagtctttaactttattgtagtaatcatttatgagcgaatcgtgcggtaggatgctgcgggcaaacttcatattggctaacgtgtattcatgtgcgcaacaaacgagcgtttcgtccggaagggcggcaattttgacaaaggactggtacatctgctccggcgtgccttcgaacagtctgccgcacccgccagaaaacatcgtgtcgccggaaaaaagataagggaaactgaagaaacagatatgtcctaaagtgtgacctggcgtggaaaacaccgcgaactccatacccaaaacggtgattttatcgccctcggttacaatttctgtcgtgcctttaccctgggtttccgccggaccgtagaccggaatatcgggatactgttgcagtaacgtcttcatgccgccgacatgatcattgtgatgatgcgtcaggaaaatagcggcgggctgccactggttttctttaattgcatccagcaccggcgcggcttcgcccggatcgacaatcagacagcgtccttcgtcgttgctgagcacccagatgtagttgtcctggaaggcgggaatactgttaagattcataattacctctcaaagcgtagcggaaggttgtgatgaaggcggcaaggatacctcaaacatttgtggcacccgaacactggagtgactttcccgcaggcgaacattatcgtgccgcgctggaactgcaactcaagccatggctggcgaaaatctatggatttcacctgcttaagattggcaatctcagcgcagaaatcaatgtcgaaacttgcgctatctcgcatcaggtcaatgtagcgcctcagggcgacgccttacaggtgagggcggatccgctgcatttgccgtttgccgataaatctatcgacgcctgtttactggcacacacccacaactggtgtggcgatccgcacggcttattgcgggaagcggaccgtgtgctgattgatgatggctggctggtgatcagcggctttaatccggtaagcctgcttgggctgcgcaaactcgtgccgatacgccgacagtcggcaatctaccgcagccgcatgtttaccatgatgcgccagctggactggctatcgctgctcaactttgaagtgctgcactacagccgctttcacgtcttaccctggcgcaggcagggcggaaaaatgttgagcacccatttgcctgcccttggctgtatgcagctgattgtggcccgcaaacgcaccatcccgctgacgctcaatcccatgaaacagagtaagagccggcaacgcgtccggcaggcagtgggtgcgacgcgtcagtttcgtaaaccctgatcaggcgtctggctgataaccgatgtcgtcctgagtgggattcatggccgccgcgcgcgccagctcatcgcagcgttcgttctccggatgtccggcgtggcctttcacccactcccagcggatctcatgctgaccaagggcggtgtccaggcgcttccataaatcgacattttttaccggttttttttcggcggttttccagccgcgttttttccagttatggatccactgcgtgatcccctggcggacgtactggctgtcggtgctcagcaccacttcgcagtgctctttcagcgcttcgagggagacaatagcggccatcagctccatccggttattggtggtcagccgatagccttcgctgaaggttctttcatggccgcgatagcgtaatattgcaccataaccacccggacccgggttaccgaggcaagatccatcggtgaaaatttctacctgtttaagcatctctggtagacttcctgtaattaaaaacggcaagtaaaacgataagtctgacataaatgaccgacatgagcactgcaattacacgacagatcgtcctcgataccgaaaccaccggtatgaaccagcttggcgttcattacgaagggcataaaatcattgagatcggcgcggttgaggtcatcaaccgccgtctgaccggcaataacttccacgtttatctgaaaccggatcggctggtggatcctgaagcttttggcgtacacggtattgccgacgagtttttgctggataaaccgacgtttgccgacattgccgatgagtttttagattatatccgcggcgcggagctggtgatccataacgcctcgtttgatatcggctttatggattatgaattcagcaagctgaatcgcgggatcccgaaaacggaaaccttctgcaagatcaccgacagcctggcgctggcgcgtaaaatgtttcccggtaagcgaaacagcctggatgcgctctgctcgcgttatgaaatagacaacagcaaacgtacgctgcacggggcgttactcgactcccaaatcctcgccgacgttttcctgctgatgaccggcgggcaaaccagcatggcgttttccatggaaggggataatcagcaacagcaggatgaaaccgggattcagcgcgttatccgccaggcgagcaatctgcgcgtggtttttgccagtgatgaagaagtgatggagcatgaaaagcggctcgatctggtgcaaaagaaaggcggaagctgtctgtggcgcgcctgatatccgtcgaaaagcgctaaaaatcagcatgtgggcgatttttgcagcaactgattcaaaactgaagaaaaagcgttgacgccctgcatggtaaaccgtaatattcgcctcgttcccacgggaacagtggagcggtagttcagtcggttagaatacctgcctgtcacgcagggggtcgcgggttcgagtcccgtccgttccgccactattcaaaagccctgaatcagcaatgattcagggctttgtcgtttctgaaaccatcgttgtattttgccctctcatgacagaaagagggcagcacggatttactccagcgtaaaaggatccgcatcctgccaggcggggaacttctcgcggtactccttcagcgccgtcagggacagttccgcctcgatgcgtgtcgccatatgcggctcagcggtcgctaagatctcaccctgcggactgacaatacggctgtcgccccgataatgatgcccgttgccgtcagtgccgacgcggttacagcccaccacgtacgccaggttctcaatcgcgcgcgccaccagcaacgactgccagtgcagcgaacgcggcgcaggccagttggcgacatacagtgccagatcataatcgttgcgattgcgcgaccataccgggaaacgcaggtcgtaacacaccagcggcagaatgcgccagccgcgccactcaaacaccacacgctcatttccggcttcataatgatgatgctcgtcggccatacggaacaggtggcgtttgtcataatgatgcagcgtaccgtccggctccaccagcaaaaagcggtttaccggcccacgctcgctttgcagcgccgcgctccccgccaccagcgcattggtctgccgggccttgtcatgcatccaggtgaccacctcatcctgcggcagcgattgctgcgcggcttccatcgcaaagccggtggtgaacatctccggcaggacgatcacatcgcgcccggtgagggtttccagttgtctgtcaaaatgacgcagattggccggaccatccatccagaccagcggttgttgcagtaacgtaattttcaaaccaggcacattgtgtctcccgaagatccgtattttcacactgtagcacggcgttcagagaatgtgttggcaataaaaaaccccgcacggggcggggtttgacagtgcgctttaacgtcaggcggcttcgattttacggatattctccggcggtgatgactgctttaccggctgtgtcgccagcgcttccggctcaaagtcatcgacgttgatgctgcgtaagcggctctcttcggcttttgtcaggatcgcggcttcttcagcggtaatgatgcctttcgccagcgcatcacgcgccagttcatccagacgggtaaacggcagattacggcccgcttccttacagatgcgctggtggacagggtccgcggccatcacgtccagcagcgcctcttccagcagaccaatcgggttgtactcgctcggcgtcagatactgaccgcgaccaatacgcgaccgggtggcgctcggcgtttgcaggatcttcgccactttatgatccagtttgtccgacggagcaaggtagtggcggccagtcgggaagatcacggctctcattaatccggcgaccgcgcggttcgggaagttagccagcagatcgtcaatcgcctgttcagctttataaatcgcatcctgcacgccccagtgcaccagcggcagatccgcttcgtgacgcccttcatcgtcataacgtttcagggtcgcagaggcgaggaacacctggcttaatacatcgcccagacgcgcggagatacgttcgcggcgtttcagactgccacccagcaccgccatggaaatatcggacagcagggcgaggttagcgctcaggcgattaaggtgctgataataacgttttgtcgcatcatgggccggcgaacggctggtcaggccgcgcgtcaggccgagccagaagctgcgcaccatgttgctgccgacgtgcccgatatgtttgaacagcagtttatcaaaggcattcaaatcatttttctgcgcggcgttcatctcatccagcacatacggatggcagcggatcgcgccctgaccgaaaatcatcatcgtacgggtcaggatattcgccccttccacggtaatggcgataggggagccctgataggcgcgcgccaggaagttgccttcgcccagcataatgcctttaccgcctgcgatatccatggcgtcaatgattgactgctgaccgcgatgggtacagtggtatttcacaatggctgacagcacggccggtttttcaccgagcataatgccgtaggtgatgagcgatgctgccgcgtccatcacataggcgttaccgccaatacgtgccagcggctcttcaataccttccattttgccgatcgctactttgaactggcgacggatatgggcataagcgccgatgcccatcgccaccgatttcagaccaccggtagagttggacggcagcgtgataccgcgacccaccgacagacattccaccagcatacgccagccctgaccggccattttcggaccgccgataatgtaatcaataggcacgaaaatatcgtcgccgcgggtcgggccgttctggaacggcacgttcagcgggaagtgacggcggccaatttccacgcccggcgtgttggtggggattaacgcacaggtaatgcccagatccacttcaccgccgagcagtttttccggatccgagagtttaaacgccagacccagtacggtggcgataggggcgagggtaatgtagcgtttgttccaggtcaggcgcataccgagcacctgctccccctgccagtcacccatacagacgataccggtatccgggatcgcgcccgcatctgaacccgcttccgggctggtcagggcaaagcaggggatctcctgcccgcgcgccaggcgcggcaaatagtgatttttttgctcatcggtaccgtagtgctgcaacaactcccccggacctaatgagttaggcacgccgacggtgatcgccagaataccggaaacgccggacagtttttgcagcacgcgggactgcgcataggcggagaattccaggccgccgtactcttttttgatgatcatcgcaaagaaacggtgctctttcaggaacgcccacagttccggcggcaaatccgccatctcatgggtgatctggaagtcgttcgccatgcggcaggcttcttccaccggcccgtcaataaacgcctgctcttcagcggtcagacgaggctgcggatagttatgcagctttttccagtcaggattaccctggaacagatcgccttcccaccaggtggtacctgcatcaatcgcctctttttccgtgcgcgacatcggcggcatcactttgcggaagctgcggaaggccggtgccgacatcatggacttgcgcatggatggcacattgaacggcaccagtatgatcgccagcggcaacagcacccagatggaccataaccccgtcaggcccagcaaggcggtccacgccagcagaataacgctacttaataccagactgacacggtgataaaacagcacgccgagcagcgccacggttgcgaggatactcaaaatcatcatagaaaattgctccctgtcttgtaggaggtctgaccacttgtgatgttatggttgtagtggatgtcattttatttagcaatgtgtttacaagataattacaacctggttcacattgttagggcagggaagcgcacgaaaaccgaaaaggcccggtgatatgtcaggcttatacttctcgcccgaaacgctatccggtacactgcgacgagttaacctcatccatttttaaggataccctcatgtaccaggatctgattcgtaacgaactgaacgaagcggcggaaacgctggccaattttctgaaagatgaagccaatatccacgccattcagcgcgcggcggtactgctggcagacagtttcaaagcgggcggtaaggtactttcctgcggtaatggcggttcacattgcgatgccatgcattttgccgaggagctgaccggtcgttatcgtgaaaaccgtcctggctatccggcaatcgctatttctgatgtcagccatatttcctgcgtcagcaatgatttcggttacgattatgttttctcgcgttacgtggaagccgtgggccgtgaaggcgacgtgctgctggggatctccacctccggtaattccggcaatgtgatcaaagctattgccgctgcgcgtgaaaagggcatgaaggtgatcaccctgaccggtaaagacggcggcaaaatggccggttctgcggatattgaaatccgggtgccgcatttcggttatgctgatcgtattcaggaaatccatatcaaagtgatccatatcctgatccagttaatcgaaaaagagatggttaaagcataactctcatcgggggcagacgcccccgaagcgtggtggaggtgttgtatgtgcgaactgctcgggatgagcgccaatgtgcctaccgatatttgcttcagctttaccgggcttgtacagcgcggaggcggcaccgggccgcataaagacggctggggtattaccttttacgaaggcaaaggctgtcgcacgttcaaagatccacagcccagctataactcgccgatagcaaagctggtacaggattatcccatcaaatcctgctccgttatcgcccatattcgccaggcaaaccgtggcgaagtggcgctggaaaacacccatcctttcacccgtgaactctggggtcgcaactggacctacgcccacaatggccagctgaccggctataaatcgctggaaaccggcaacttccgcccggtaggggaaaccgacagcgaaaaagccttttgctggttgctgcataaattaactgcgcgctatccgcgtacgccaggcaatatggcggcggtgttcaaatacatcgggacgctggcggaagagttgcgtgagaagggcgtgtttaacatgctgctgtcggacgggcgctacgtgatggcctactgctcgactaatctgttctggatcacaaggcgcgcgccctttggcgtggcgacgctgctggatcaggacgtggagatcgacttccagaaagaaaccacaccgaatgatgtggttactgttatcgccactcagccgttaaccggcaatgaaacctggcacaaaatcatgccaggtgagtgggtcttattttgcctcggggagcgtgtagtttgacgccagctgaggctgcactgcgcctttagcaatcggcttgctcaccacataacgcccgtccaccaccgacacaacaggcggctgatgggtgctggcgaaatagtcatatcccggcttcagctgcttccagaaatcggcatagtaagagtatttatgacgcgccatattggcgtcggtcatgcggaacgggtaaatgctcacctgcacgctttgctgaccaaaaatcagcgcgccggtcacaaactggaagatctcatcaatgccggaatcggtcatcgcatagcagccgacagagacacaggcgccatggatcatcaggtatttgccttcataaccgtgagcacggtcgtaggcgttcgggaaaccgatattgatggctttatagaagcggctgtccggcttcagctggctgcgctgaacgttataaaagccttccggacttttgaaatcgccctgacgctgtttcggccccagtccgcctgaatagttacagatcttataactatcaagaagctgatactgctcgcccattttgacgtagagatcaagggtgcgttcttctttgaagatctggatgtaaaccggcgaccccattaactgctgcttgtactctttgctgaccggcgtggttgaactgttgctgctaagcagcccggcaaacgagacgcacgggatcaaaagcatcgcaagaaataatgcgattttgcgcatactgctggttccttgataaaacgtaattcacattgccaggacggcaaaagggatccgaaatcagactaatctgtgtcaggagcgctcacattagcaccccggtagtttttcgcaagtccggataagcgcgtttacactatgtttaattgcgccattgccgttgattatcccattgctcacaaaatcattacaactgcttctcataaacggcagtaaggctgtatacttatccagtatgggtgagggtctgcgatgcgtaaaataatacacgttgatatggactgctttttcgcagcagtggaaatgcgcgacaaccccgcgctgcgtgatattcccctcgccatcggcggcagccgggaaagacgcggcgtgatcagcacagccaactatccggcgcgcaaatttggcgtgcgcagcgccatgcccacggcgatggccctgaagctctgcccgcatctcactctgttacccggtcgttttgatgcctataaagaagcttccgcgcatatccgggagatttttgcccgttacacttcgcacgttgaacccctttcccttgatgaagcctatctggatgtcaccgacagcgtgcactgtcagggctcggccacgctgatggcccggcagatccgccaggccatttttgatgaacttcagctcactgcctcggctggcattgcgccggtaaagtttctggcgaaaattgcctccgatcttaacaagcccaacggtcagtacgtcatcaccccgaacgaggtgtcgcagtttctgcgcacgttacccttatcgaaaattcccggcgtcggcaaagtgtcggcggcgaagctggaaaagctgggattgcgcacctgcgaagacgtacagcgcgccgatctcgctatgctgctcaagcgctttggcaaatttggccgcgtgctgtgggagcgcagccaggggatcgacgagcgggagatcaccagcgagcggttacgcaaatcggtcggcgtggagcgcacgctggcagacgatattcatgagtggtcagaatgcgaagcgcaaattgattttctttatgacgagctagaacggcggctggcaaaggttaaaccggatctgcgcattgcccgtcagggggtgaagttaaaattcaatgattttcagctcaccacccaggagcacgtctggccgcgcttaaacaaagccgatttgctcgccatcgccagaaaaacctgggatgaacggcggggagggcggggcgtcaggctggtggggctgcacgttacgctgctcgatccacagctggagcggcaactggtgctggggctttaattgggggaaacgtgccgggtggcgctgcgcttacccggcctacagtgttcatgcaggcccggcaatcccgtacaacattgcacgggcgagctgttgtaggcccggcaagcgaagcgccgccgggcgtttatcacaaagcttacgacttagccgggatcgccttcagcagttcagtgagcagcgtccagtactggcccacgctttcaatatgcacctgctcatccggcgagtgaggcccggttatggtaggcccgatagaaaccatatccatatccggatatggttttttgaacagaccacattccagacccgcatggatcacctgaatgttcggcgttttatcaaacagacgctgataggtttcgcgtaccagcgccatcaccggtgaactggcgtccggctgccagcctgggtagctgcctttggcggaggttttcgcgccagccagcgtcccgagggattccagcatgctgaccacatactctttaccgctgtcgatcagcgaacggatcagacagatgatctctgcgctgtcgtcctgcatggtcaccacgccaacgttcagcgaggtttccaccacgccttttgccacgtcggaattgcggatcacgccgttcggggtggcattcagcaactgcacgaacgcatcgcgagactgactggtcagcgccgctttatccgtggtggtcgcttccagaaccacgttcaggttcttctctttcgcttccagctcgtttttcagaatgtcgaggtaagtgctcgccagggttttcagctcatcagctttgtcagcagacacggctacggtggcgaaagcttcacgcggaatggcgttacgcagcgtaccgccgttgaaatccaccagacgcagatccagcgctttcgcgtgaccggccaggaagcgggccagcagtttgttggcgttgcccaggccgaggtgaatatcgccgccggagtgaccgcctttcaggcctttcagcgtcagcttaaaggtctggaaacccgccgggatggcttcacgggacagcggcagggtggagataaaatcaatcccgcccgcgcagcccatgtagatctcaccctcttcttcagagtcggtgttgatcagaatgtctgcctgtagccagttggcctgcaaaccaaaggcgccgtccataccggcttcttcggtcatggtcagcagcacttccagcgggccgtgcgccacgctgtcgtctgccagcacagccagcgcagaggccatgccaataccgttatccgcgcccagcgtggtgccgcgtgcttttacccattcgccatcaatataaggctggatgggatctttggtgaagtcatgcacggtgtcgttgtttttctgcggcaccatatcgaggtgcgcctgaaggacgaccgccttacggttttccataccggcagtagccggtttgcggatcaggatgttaccgacgctgtcgcgctcagcaaacaggcctttctcctgcgcccagcccataatgtgcgcggccagttgttcttcatgataagacggatgcggaatggaacagattttggcaaaaatatcccacagcggctgtggagataattgagacagttcagacacgataagtctccttgacatagacctgtaaaagaaatgtacaggttgcagggttagcaaataaacaccatgtgcaatgcttgcgcgataggctggcagaataccactttattggcggcctggtactgtggcgcacgtaaaaagcagcgcaggtgccccgtaacactggtttttagtgcgtcggatctctataatctcgcgcaacccattttcccctcgaacactttttaagccgttttaaaataggctgggacacttcacatgagcgaaaaatacgtcgtcacctgggacatgttgcaaattcacgcccgcaaactggccgcgcgcctgatgccgtcagagcagtggaaaggcatcattgccgttagtcgtggtggtctggtgccgggcgcactgctggcacgtgaattaggtattcgccatgtagataccgtatgcatctccagctacgaccatgacaaccagcgtgagctgaccgtgctgaaacgcgcggaaggcgatggcgaaggtttcattgtgatcgacgatctggtggataccggcggtaccgcggttgctattcgtgaaatgtatccaaaagcgcattttgttactatttttgcaaaaccggctggtcgtccgctggtagatgattatgtaattgatattccgcaggatacctggattgaacaaccctgggatatgggcgtagccttcgtgccgccgatctctggccgttaatccccgcatctattatgccttttcagcgcccggttatgccgggcgttgttcattttagcgcccggcaggttacaatagtcattagtgacgtattcatggaggctgcgcgcaatgacccaggctaatcttagcgaaaccctgtttaaaccccgcttcaaacaccctgagacgtcgacattagtccgccgttttcagcatggcacgcaaccggcggtgcagtcggcgctggatggcagaaacattccgtgctggtatcgcatgaacaaccgtctgatgtggatctggcgcggcgtcgatccgcgtgagctgctggacgtgcaggcgcgcatcgtgatgagtgaagccgaacgcaccgacaacgccctttacgacaccgtggtgggctatcgcaacggcaactggatatatgagtgggccacccaggcgatggtctggcagcaaaaagccagccaggaagaagacgccgcacttagcggccgtcactggcttcatgcctctaccctctacagtattgccgcctacccccatctgaagggggacgatctggcggagcaggcgcaggcgctggcgaaccgtgcctatgaagaagcggcgcgacggctgccgggctctctgcgcgagctggagatccccattgccggcggcgcgcccttaacggcgtttctgcacatgccgaaaggcgacggccccttcccgacggtgctgatgtgcggcgggctggatagcctgcaaagcgactactacaccctttatgagcgctatttcgcgccgcagggcatcgccatgctgacgctggatatgccttcgattggcttctcatcaaaatggaagctgacccaggactccagcatcctccaccagcacgtgctgaaagcgctgccggatattccatggattgaccatacgcgcgtcgccgcctttggcttccgctttggcgcgaacgtcgccgtgcggctggcctatctggaatcgccgcgcctgaaagcggtggcctgcctggggccgatggtgcatgcgctcctgaccgacagcgcccgtctgagcacgataccggaaatgtatcttgacgtgctggcgagccgtctggggatgcacgatgcctcggacgaagcgctgcgcgtggagctgaatcgctattcgctgaaaacgcaggggctgctcggacgccgttgcccgacgccgatgctgtccggcttctggaagaacgatccctttagcccggaagaagagtcgcgtttaatcacctcgtcatctgccgatggcaagctgctggagatcccgcagaaaccgctgtatcgcaatttcgaccgtgcgctgcgggaaattaccgactggattaatcataaattgcgttaatgcattgctaatttatgccggtttggtaaaacagtggctacacataaggagattgcaatgacgttaccgagtggacacccgagaagccgacttattaagaaattcaccgcacttggcccctatatccgggaagaacagtgcgaagataatcggttctttttcgactgcctggctgtttgcgttaacgttaagccagcgccggaaagccgcgaattctggggctggtggatgataatggaagcccaggagaagcgctttacctacagctatcagttcggcatgtttgataaagaagggcactggcagcccgtcgcgatcaaagacaaagaagtgcaggagcgtctggaacatacgctgcgcgattttcatggtcgtgcccgcgatatgctctccacccttgagctgaagcttgaacctgctgatgacttcaaaaaagagccggtgaagctctcggcctgatttatcgctaaacctcacgcataaaaaaacgcccttcatcgctgaagggcgttttcttttctgtcatcagaactgataggtcacgccgaccgctaccacgtcgtcgctgctcagacccagctgattgtcgtcatcgatctggttgattttgtagtcaaccatcgccgacatgtttttgttgaagtagtaggtcacgcccacatcaatgtatttaaccagatcttcatcgccgatcccgccttcgatgtctttacctttggactgcacgtagcccagagatggacgcaggccgaagtcgaactggtattgcgccacggcttcaaagttttccgctttgttagcgaaaccacccgagatcggggtcatgttgtgagacaccgcgtacatggcggccaggtaaacgttgttggcatcatacttgatgctggtgccccaggcgtcggctttgtcgccctgaccacgtgcctgcaactgttgcagatctgtacggtccgagctggcataagcgccggtgatagtgaccgggctgccgccgaaatcataggccagagaggtgccccagccgtcgccgttctgtttgttcgccgcgcgggtgccttcgtttttaccctgatactgtaaggtcatgtccaggccttccacagcgccgaacaggtcggtgttgcggtaggtcgccacgccagtagtacgcttggtcataaagttgtcggttttacccagagagtcgccgccaaattcagggaacatatccgtcgccgcctgcacgtcgtacatcacgccgaggttacgaccataatccagagagccaaaatctttgattttcagacctgcgaaggccagacgggttttctgcgcgtcagatgcgccttcgattttgttaccggcaaattcggcttcccagcgaccaaaaccggtcagctgatcgttaatctgcgtttcgcccttaaagcccagacgcacataagtggtatcaccgtcactgccagcatcgtcgctgaagtaatgcatggctttaactttgccatagaggtccagcttgttgccgttcttgttataaacttctgccgcctgtaccgatgcggaagcgacaatgctcatcaccactaatgccagagtactctttttcattttgattcctgatttgaaagacacgctaatattcgctgggcttatagccccgtgaaaaaacatgaggggttttaacgctctggaatgaaggttttatgacaaagtcggattaatttgaaaaaaatggatttatttgctactgccataaaagtgtcaaattctgccgttaggcttgctgatcccgcgcaataaaaaacgggctttttacgcaggttattggcaagcgcgctgactcctgttaaaacgtcctttcccatcttttttcttatttgtttaacggcagagaatcatgagtgacagccagacgctggtggtaaaactgggcaccagtgttttaacgggcggatcgcgccgcctgaatcgcgcccacattgtggaattagtccgccagtgcgcacagctgcatgccgccgggcatcgcattgtgattgtgacgtccggggcgattgctgccgggcgcgagcatttaggctatccggaactgccggcgaccatcgcctctaaacaactgctggcggcggtggggcaaagccgtctcatccagctgtgggaacaacttttttccatctacggcattcatgtcggacagatgctgctgacccgcgccgatatggaagatcgcgaacgtttccttaacgcccgcgacaccctgcgcgcgctgctggacaacaacatcgtgccggtgatcaacgaaaacgacgccgtcgctaccgctgaaattaaagtgggcgataacgataatctctcggcgctggccgcgatcctcggcggtgcggataaattattgctgctgacggatcaacaagggctgtttaccgccgatccacgcagtaatccgcaggcggagctgatcaaagatgtttacggtattgacgacgccctgcgcgccattgccggagacagcgtttccggcctcggcaccggcgggatgggaaccaaacttcaggccgctgatgtggcctgccgcgccggtatcgacaccattattgccgcgggcagccgtcccggcgtgattggcgatgtggtggaggggatctctgtggggacgctgttccacgcccagacctcaccgctggaaaaccgtaaacgctggatctttggcgcgccgcccgccggtgaaatcaccgtggatgagggcgcgaccgaggcgatcctgcaacggggcagctccctgctgccgaaaggcatcaaagaggtgaacggcaacttttcgcgtggggaagtgatccgcatccgtaaccaggaagggcgcgacattgcccatggggtaacccgttacaacagcgatgcgctgcgtcgtatcgctggccaccactcgcagcaaattgatgcgattctgggttatgaatatggcccggtcgccgtccatcgtgacgatatgatcacccgctaaggagcagacgtatgctggaacaaatgggcatcgctgcgaaagcagcgtcgtacaaactggcgcagctatccgcccgcgaaaaaaatcgcgtgctggaaaaaatggccgattatctggaagcgcagacggagacgatcctgctggcgaacgccgaagatgtggcagaagcacggcgcaacggcctgagcgaagccatgcttgaccgcctggcgcttaatcccgcgcgcctgaaagccatcgctgccgatgtccgccaggtgtgcaagctggccgatccggtggggcaggtgattgacggcggtctgctcgacagcggtctgcgtcttgagcgtcgccgcgtgccgcttggcgtcattggcgtgatctatgaagcgcgtcctaacgtcaccgtggatgtcgcctccctgtgcctgaaaaccggtaacgccgccattctgcgcggcggcaaagagacctggcgcaccaatgccgcaaccgtgaaggtcattcagcaggcgctggaagagtgcggtctgcccgccggcgccgtccaggcgatcgaaagcccggatcgtgcgctggtgaacgagatgctgcgcatggacaaatatatcgacatgctgatcccccgcggtggcgcaggcttgcataaactctgccgtgaacagtccaccatcccggtgatcaccggcgggatcggcgtgtgccatatttacgtggacgacaccgccgaaattgacccggcgctgaagatcatcgttaacgccaaaacccagcgccccagcacctgtaacaccgtggagacgctgctggtgaaccagcatatcgcggatacttttctgcccgcgctcagcaggcaaatggcggaaagcggcgtaacgctgcatgcggacgacgccgcgctggcacagttacaggatggcccggcgcaggtggaagcggtgaaagcggaacaatacgacgatgagtttttgtccctcgatctgaacgtgaaaatcgtcgcggatctggatgacgctattgcgcatattcgcgagcacggcacccagcattcagacgcgatcctcacccgtacgctgcgtaacgcaaaccgttttatcaatgaggtggattcgtcagcggtctacgtgaacgcttcaacgcgcttcaccgatggcgcacagtttggtctgggggcagaagttgccgtcagcacgcaaaagctgcacgcccgcggcccgatgggtcttgaagccctgaccacctacaaatggatcggctttggcgacgataccattcgtgcttaaatgaaacggggtgatgcaaaagtagccggttgattagaaaggttattgacgcatcgccctgttagttttaaccttctacaccgtcattcacgcccgtgaatacctctcagggccgatatagctcagttggtagagcagcgcattcgtaatgcgaaggtcgtaggttcgactcctattatcggcaccattctaacgtctccccaagtctactaaagttcactaaaaccccttataatctgcgctttacagccccttttagtgtttctacgtctactaaagttccctgaaatctacggtcgtttgggggggagttatgggggtatttgctgttcggtctagaggtggtacccccaagtgaaactaaacgcccggcaggtggatgccgctaaacctaaagataagccttacaagctggctgatggtggtggtctgtatctcctgatcaaacctaatggcggcaaatactggcggctcaaatatcgtgtagccagcaaagagaagctgttagcgctgggtgtttatcctgaagtcacattggccgatgctcgggcaaaacgtgaagaagcgaaaaggggtatcgctggaggtatcgatcctatggaagcgaaacgggaggagaagattgcccgtgaaattcagttaaacaacaccttcaaagatattgcccttgaatgacacagcagcaaactaaaaaaatggtctgctggttatgcttcagacatcctcgaagccttcaataaagatgtgttcccatacattggcaaaaaaccaatagccgaaatcaaaccgcttgaactgttgaatgtgctgcggcgcattgaggggcgcggcgctaccgaaaaggcaagaaaatttaggcagcgctgtggggaagttttccgttacgcaatagtcaccggtcgagctgagtataaccccgccccggatctcaccagcgcgatgcaagggcatgagtccaatcattatcctttcctcacaccgaaagagttgcctgatttcttcaaggcgttgtcaggatatacaggaagcgcgttagtagttttggccgctcgtctgctgattatcaccggcttgcgtaccggagaactccgtggggcattttgggatgaaatcaatatcagtaaggcagtctgggaaataccagcctcacgcatgaaaatgcgtcgccctcatgtggtgcccgttgtccaggcaagctcttacgcttattggccagctccaagagctaacaagcaattgtcagcctgttatggtttgttatgccttactagggaaaactaggaggaaagtgtcaaccactaccgcttcagaaaacttcagatacacgaactcgtgaaggggaggtgttaagcacaccctctttgcaaccatcctcaagcctctttcagatcgatgttccagtttacccggaagttagcgttcagattgagttgtcaaaacttgtcacccaccggcacagccagtggggatttttggctgtagccgctctaagttacagtttcttccaacagtaagctgattcaaaattgtttcgaactaatcgtgggaatatcatcctttaaaaggaactttggaagtagtgatatcaactttattgtatttgtatacatcgagcataatttcaattccattgattagttcttctatgttttgtcctgggccaatcatgatttttttcaatggaagttttccaccgtgcggaccatgtttattcattttaagttcaatgtaaggtatgattcctttgtttccaacgcgaatcttcacatcttgattcttattttgcgtgtatattacaaagcgatattcaagttcttcttcgaaatgttttactttaaagaacgggggaagtagttgggcaagggttattgcatggtaaagttcatccaaatcacttttagtaatgtcttcaataactttttcgttattaaagaattcaactatgccatcaattgcttcaattgttgaattctcttcagtatagatgacatttctgtcataaattactttgtcactagtgtctattgcttcaaaaagctcgttggaatcgaattccagacataccttttgggcttgtccataaccacgccacatgcttaataaatctggttttaaacaaaacgatatattgtaagcatgttttgatgtaacttccttaaagaattgcactgtctttttaactaattcaatatgctcattttttatttttccgtgaatattgtctaaggcattgatgatacagttgataccatgtttgatttcttgagagtcgtttaggaatgcatagttcgtggcccataaggaattattttcaagtattccttttaagccatttaaatctgtatagtggtaaattttcattttcaatggattgtgatttgcgtgattttattaaaattaattttcattaattgtccaatatggaactaaatcttttaattaccataaggaatgttattacagtagtgaagaaagaagagtaagctataaagcttaaaaagtaagcaggaatggcaaagtgtattttcccaagtgagtatgcatcatccgggaagaatgatattatcactgatgatatgacaagtataacagatgttaggattgcatatgccacgttgtggcaaagttgctcatatactgttctatttatctcaagagttggtaaatttgttttggatttattattctcaataatatcggtaattttgaaagcggttttttgtttttgatcatatatcattatcactgcactcataagcaaagctgtggtaatggctccgaaatttacaaatatagctgcgattgatggtttcattgtaccataaaaataacaaactaaaaaggaagttatcgcgggcaagaaaaaatggataaatatatcttgtgctagagtgtttcctttttgatctgacatagttttataatgtttcaacagaacttgccatatatttatcttgttcatatgattactcccatgttcccgctgtgaatttctaaaagtaaatcattggtgatgactttgacagtgtcatcaagggctgtcaagtcaggtattccagttgtagggtctattttaatatcattgtcatcaagttctactgaaatgccttttttaaggattgagtcataactaaagacgatcgtcctattacctagtagcaacgaaaccttcacctcatcacatttatcttcgacaatttcgatgacattacttaattttttatctctcaagtcacgaaaactacccatcattccttcattatatttgatgactaagtcagttttcacattcgttttattgctaccgaacgaatcggctatgtcagttggtggtttataacctacagctttaatttgtttaacttcagagtcaagtatatgttgcggaatgcttctgtgacaaagaggattgaccctggcctcaagttgatatttggtgataaaatgctcaaccagaaaatcagtaaatgctgatttagctgaaatattatcactagtatgaaatgcaataattccttcctcaagagcatttggaagataaataagaatgtagcgttcacgcaaaataacatcatcaacttttgtggtataatgcgtttgagataattgtgtatcctttatttcatgagtttcaccatatttcccaaccttaatgaaaccatgaacaagacctttatttgaatcgaaggttagtttgttatgttgttctaaagaaatctttgtctttgttgcactatcttccatgggagtgattttgtaatttgtaaggaattcttcaattatttcaaacgctgttttattgttactcaaaccaagattacctaaggctttactatatctgctaccttttttaactaaaattctaaaagaataaaaactcacattatgcataatatttccctttatatgatatatctttatttagtttcgggtgaatatctttgatgcaggctaccgccagagtatgaacacccaactttagaagtgatgattaaggttgagcatacacgaaaaaaggagaccgtaaagttcatggtcacggttttgagaagattacaataggattaagagggtttagttgcatgcggtcattaagaacgcatagtcatctggtaagagctaacgtgctggttgttttttgatcaagttagagtgagaaaactaaaattgggggtactattgggggtatcatatgattttttattgatattaatcttttgtatcaataggttattgtttatgtattgttcctattatcgcaccaatcatcacgcgggttcacgcggtattgaccagttcagcaaaagcgccttgtgccatatttgtaccattccccgccagaaatgagtcaaattgcatcgcatgttgcgtcaggtgattcggtgccaggtgcgcataacctggtacaaatagataggctttatgaatgtaattcataaagcctgcttcggatcttacaaaggatgagtcggtcgttaagcatgcgacaggtctattaacctttgcgccgcctgtaagtctgccagggtatcgatatcgtgggtgataccgtaatccgacaggaaaatatctttaacctctccccgttgtcgtgcgcgtctcactatttcttttgctcccatatttccggaaagggcgcttaattcagcacggtatttgtgccagaatccgaccggatgacccggattacgctggtagtgaggcaccacaatcgaattttcttcgagctccgcggcgacgcgttgcaatgatgaaggctgaattaagggaaggtcggctggcagaattagccatcccggagcctctggcgtggcgtgaatgccaagagaaatagactcgcccatgccgcgcgtgccaccttcagggcagaccagatgccatttcagcttcgcgttttcgacggcttccagcacatgttctaaaaccggcttgccgttaagctgtgcggctagtttatgggtgctaccccctgaagtaagaaagcgctccccacgcccggctgcgaggatcaggacgacgggggcaggcatgaatcctccttctgatggagacgtacagaggcgatctctgccagcacggagagtgccagagtatgcgcatcccgggcttttgggaatatcccgacaggcgctctgattcgctctgtctcctccttacaccaccccagctcgtggagcttttgcagacgcaaagtgtgcgttcgaaaactgcccaacgcgccgagataaaagggttttgcctcgcgcgcggcctgcagtactggcagctcccggttgagatcatggcatagcaaaactaccgccgtgtcagtatctatcttagcgctggctgaggccggaaaacggtcaaagatatggctgtcatagccagttgccgccgcaaggcaggcggttgcctgtgcttcaagagaacttccgtaaatcatcagccttacgcaaggcctgaaccctacctcaaagccattgagattccagcccgttcgggtttgcgcgggcaggcacaccagcgattgtgcttgcggatcgtagcgcagccccgccggttttctttgttccagacggttcagcacggcaagaaggggccgtggtgagcgcagtttatggagcgtcagagtgatcccgccaccgcagggcagaataatgtcgaaccatggcgaaccctctccgtagcgaatgtcgcgatcgcggcctgagaccatcacctccagtgcttcaaaagcagtggcggcttccacgcaaccgccggagacaaaaccgcagtagcggccatcttcgcgcaccaccatctgcgccccgagtggtcgcgccgcgccgccgcgtatctcaaccagcgtcactaacaccgccgctttaccggccatcagcgcttccaccgcaaaacgcagaatggtcacggggtcatcggtaagaaacgccagttccggcttatgcaagcgctcgtctatatcaaaaagcgagtatgacattgctcctccttaaaccacatccggcagcttatcgagcagcttatccagggtgatggggtaatcccgtacccggacaccagtggcgttgtaaaccgcattggcgatagccgcgcccacgccgcacaggccgagctcacccacgcctttggctttcatcggggaggaaatggggtcggtatcatccaggaaaatgacctcctgtaacggaatatccgcatggaccggcacctcatatcccgccatatcgtgattaacgaagtatcccagacgagtatccacggccagctcctccatcagtgccgcgcccatacccatggtcattgcgccaatgacctgactgcgggcggttttaggattcagaatgcgccctgcggcacacaccgcaagcatgcgatgaacacggatctcgcccgttgcgctgtgcacaccgacttcaacaaaatgtccggcaaaggtcgactgctggtacttctcgctgagcgtcccgaattcaatactctcttctgctgtcagcctgccgccagacgtagcctcacgcagcgcagcgctgcgcgtaccgctgataattttgccgtcggtaaactgcgactgctcaggatcaaacccgacggctgaggcaatcatctcacgaagcttcacgcaggcggcgtacacgccggaggtggaggtattcgcgccccattgcccgccagaccccgcagaaaccgggaaactggaatcaccgaggtgaacagtaacctgctccagcggtacaccaagcatttccgccgccgtctgggccagaatggtgtagctaccggtgccaatgtcggtcatgtccgtttccacgataacggtgccgttttgctcgaggtgaacccgcgcgccggatttttcgagcagattattgcgaaagcccgccgcgacgccgacaccgatcagccactcaccatcgcgcacctgcccgggtgtggcattgcgctgcttccagccaaatttatccgccccggtgcgtaagcactcgataagctgacggcgcgagaagcggcgtgtcggattggcgggatcaacctgagtgtcattcagaatgcgaaactcgacaggatcgatgcctgctttttccgccagttcatctatcgcgatttcgagtgccattaatccgggggcttcgccgggtgcacgcatggcgttcccttccggcaaatcgagcgtggcgagccgcaggccggtatgacgattcgcccccgcgtagagaaattcgctttgctgcaccgccgtttccggcgtgccgccgggcagattgccagaccagctttcatgggagatagcggtgatttttccgctttggtcggcaccgatacgcaggtgctgaagggtcgcgggacggtgagtggtgttattgggaatgacggggcgggggagcatcactttaaccgggcgttttaccgcacgggcggcgagggccgccagcagcgcatcgcttctcaggaacagcttgccgccaaacccaccgccgatgtacggggagataattcgcacattctccacgggcactttcagcgttttcgccagatcggtgcggcaccagtcaatcatctggtttgaggtccatactatgaccttattgccctcccagatggccatcgaggcgtgcggctccatcgccatatggctctgatccggggtggtgtaggtggcatcaattctcaccgctgcggaggagaacgcgccgtcaaagtcaccgacgttcttgtcaggcgtatcttccggtggctgactgacagtcggtttctcatccgcaagagaataagcccctctttcgcggcgatagtgcccctgtaccagcgaggccgccgcccgcgcctgttcgaatgtttctgccaccaccagagcaatggcctgatggtaatgctcaatcgtggggccgcccagcagtctggcggtgtttttgtcccctttgccgagtgccccggcgttatcggcggtgatgactgccagcacgcctggcgctttttgcgcggcgtctatatcaagggcggtaagccggcctttagcaatggcggaaccgacgatatagccataggcggcgttgggcgctatttcgtgccattcgtaggcgtaacgtgccgtaccggtcgttttcagcgcgccatcgatgcggtcatgaggacgaccgataaccttcaactgatcaatcgggttttccccggcaggtttatcaaatttcatgcctgagccctcgcttctgtcattacggaggcaagcgttcgcttcgccagcaggagtttgaaggtgttttcagcggtgggatgtgcgctggcaaacagcgtgtcatacacggcctgcgccccgaggggcatttgcgcgtccgcagcctcaacgcgccagggcttatgcgccactccgcccagcgcgacgcgtccactgccgtctggctggatgattgccgcgactgacaccagagcaaaagcgtaggaggcgcgatcgcgcaccttgcggtagaaatgtgccccgccgacaggcggtggcaacgttaccgcgacgataagctcgccgggtagcagagcggtttcaatatgaggtgttttctccggcggccgataaaaatcagccagcgcgatactgcgcgcctttccatccggtgtgatggtttccaccaccgcatccagcaaccgcatcgcgaccgccatatcgctcggatgagtggcaatgcaggcttcgcttatgcccactacggcgtgctgacggctaaagccttcaagcgccgagcagccgctgccgggcaggcgtttattgcagggctgattggtatcgtaaaagtaggggcagcgcgtgcgctgaagcagattacctgcggtggtagcctggttacgtaactggccggaagcgccagcgagaagggcgcgggagagtacggcataatgctgccgcacgtgctggtgggctgccaaatcggtgttccgcactaatgcgccgatgcgcaggccgcccgcgtcggttgcctcaatcttatccagccccagcccgtttacatcgataagatgggtaggtgtttcaatttccagcttcatcaggtccagcagattggtgccacccgcgataaattttgcgccgggaacacgctgagcgctgagcgccgcctcagccggggtattcactcgttcataggtaaatgccttcatgattttacctcccccgcagcgtcttcgatggcagcaaggatgttggcgtacgcgccacagcgacagaggttgccgctcatacgttcacggatctcatcggctgtcatttcaggcggggaaaccaggtcgcgggtgacgtggcttggaatgccgtccttaatctctttcagcactgccaccgatgagcaaatttgcccggaggtgcagtagccgcactgaaagccatcatgccggatgaaggccacctgcatgggatgaagatggtctggcgaacccagaccttcaatggtggtgatctccgacccctgatgcatgactgcaagcgtcaggcaggcattcagcctgcgaccgttgaccagtacggtacaggctccgcactgtccgtgatcgcaacctttcttggtgccggtcaaatgcagattttcccgcagcgcgtccagcagcgtggtccgggtatccacctccagctgctcgcttttaccgttcacttttaatatgaggggcattatttcaggggccggagttgcagccggaacgctggctgcaagcgttgaatgaggataaacgacagctgttgccgccgtcgcggcactgactttgattaggtcgcgacgggtcagactcaaatcgtgcggttcatgattgccaacccgattatcttcggggtattcgccgtggttgctcatgccaggcctccggtatgcaaaaggggaaataagagtgcgttgcgagaatgctgttcgtttttttaaacgttaagcatagtcggcgagagcaaaaagaatattcttaaaacgcgaatgccgttatgtgtggcctgcatagcagaaacgcatcatcagccttaaaaaagctatttttgtacaacaaagttacgccgtctgtgtcgggataataagtagccattaaatcgctttgtatggaacctttcccgacaggaatgtggatatgttaaaaaatactcagacacgtgcgtttcatgttatggcaaaaccgtctggttctgtctgtaatcttaattgcagttactgcttttatcttgaaaaggaagtttactatcaacaacataatataatgagcgataacgttcttgagacgtatgtgcgaagttatattgaatcgacgtatcctgaagatgaagtcgcctttacctggcagggcggagagcctgcgttagccgggcttgaattttatcaaaaagcggtctcgctacaggataaatacggggccggtcggaaaatatctaacagttttcagaccaacgggattttactaaacgatgcgtggtgtcagtttttttctgataacgattttttgattggcctttcgctggatggtccggcagcgatccacgataagtatcgtcttactaaaagcggtaaacccacccatcatcgggttatgcgggcgctcgccctgctgcaaaagtacaaggtaaaatacaacgtactgacatgcgtaaatcgccatagcgctcagtacccgctggagatttatcattttttgcgtgacgccggggtagagtttattcagtttatcccggtcgtggaacgactggcggatgatgacgccctgcaagccgggctaaaattacatgctcccggcggggatggaagccgcgtgacgccctggacggtattgcctgccgattatggtcattttcttgttaacgtattcgaagagtggcgtaagcgggatgtcggcagcatttttgtcatgaatatcgaatgggcgtttgcccgctttatcaatgcccccggcgcggtgtgccaccatcagcccacttgcgggcgctcggttattgttgagcacaacggcgatatttatacctgcgaccactatgtctatccgcaacaccggttaggcaatattatgggggcaaccctggcggagatgatcgattcagcgggccaggtaaaatttggtactgataaatataactcgctgccacgccagtgccgtcaatgcagggtgttacaggcctgtcagggggggtgcccgaagcatcgctttatgcgcagcaaagaaggcgaacccggactcaattatttatgcgagggctttcagctttattttaatcatttgccgcgctggttaaaggcgatgaccgatcttatcgccagtggtcggccagtgagcgatataatgcatgcggatctcattcacattaacagcgcatcaaagaaatgaaaataaaaaacggccataccagatggccgttttgcgcaaagcttacaaatgaatctgtactgaaggcgggtacttattgaggatgttgttatagtttttgatttcttcctgcaggattatcccgacaggaatatggcgaatgccaatactctcatcttcctgtggattggtatacagattaaagatcattgatcccgctgtcttactgatagatcctgtaaaccctccctgatagcctttactggtgaaagcataaggttgctggatcagcgtatggtatttaaattcatcaacccgtacggcggaaagctgaccgtttaagaagtaatgctcagcccgacgattagattgccctgtatttccaacaaaccaggatgcctgattaaccccatcgataaaggtacttttgggaaccagtttcgcaagttcagcgcccgattttcccgccagggcaaggctggtggggaagatatcagtcagatcaaataagccatctgatttgcggggctgtatcatgcctttccagtaaacaaaagtgggaacacggacgccgccttcccatgtcgatccttttgatccgcggaagggtgtccgaccatagggggcgacttcggcttccgggccattatcagaagtaaagacaatcagtgtattatccagttggttggtttcttccagtgacttgtagagtcggttaaagacatcgttcatttcaaccatacagtcgctaaatgacgtttttgccggagaacgaccggcgtagtacgcattcgggtaattatcgaaatggcagccgcgggtgccgtagtaaagaaagaaaggcttatcgctcttctgcatcgtacggataaaatctgcaccatactgcgaccagcgttgatctaaatcttccatatatttgggagtgatctccgcaacttcattaaatgttccgctacgcgtcgcatgaatatcgctcttattaaacggcagattttttatatattcctggcgggaggggctaagggctatctctgggttaacattggcgtcccgccattctgtatacatatctgaaacggagaggaagccacggaaatcatcgaagccaacgttctgaggttgagactctttattttctcctatatgccatttaccaatagcctgagtgacatagccttgatcgtgtagcagctggggtaatgtggtgaagccttgtaatcctcctttctgaccgtacatagggggcaccagaatgccatggtgggctgagtattgcccggtcatgatagaggctcttgtcggcgatgagctgggctgcgaataagcggatgttaaaataagcccctgttccgcgaccctgtctatatccggcgtcgggttacctactgccacgccgccaccattaaaaccgacatccatccagcctacatcatccatgataaaaaccagaatattaggttttttacccgttttcttttctaattctgcaagtttttgtgccgtttccttttcctgcccggcgttatagatcaccggcatcatattatcggccagagtagtggttttagtgaccatatactgcccgggcgtgtcatagcctttataggcctcagtcggttgaccattcgcggcattaaccataaacgggatagcaagtgtaatagccgacgcgactgttttcatcataaataacttattcatagggtactccatgttaaaggcgattaaataaaagctcgacaggcttttttattaacggccgaaggtaatgttcaatcctgtaaagagagtaaattgcggctcatattccccattatgtgccacggtccactgaggttcgataaaggtattgattatgttactgcctgatttccatgcccgaccaataccaaagccaacgggcagatagtaatcatcgttttgcacgttataagtcattatccctgacgagcgcagataccatccttggggaagattatggaaaacaaaaggttgtaatgtgagagtctcaacgttggtccgatctttatcacccgcgaaacttttctgccattgcaataatccaccaaacagaccgctgccggaatcctgtacgacaacagcggaaaagcctgccagccatttaccggagcctgtttcgtcctgtgaggctgaatccaatgttaataaggggccgacaccgagtttaacgcctttttgcttaagcaaaagaatgtcaaaaatattaatatcgccgatgccggtattatatccgccggaaatttgcggtcgtgtgacaaccggtactgacattctgaaaatttggggcacagggatcaatcccggcgctatggggatcgtcccgcgcaggaagaaatcatcagtatgttgttcgctgccatagagttcaggggtgtaataattatgaaaagccagggcgaaagccggatgcagcgggttattagattgattcgcaacactggcactctcaccccatgcataacaggataatgccagcagactccctgcccagaaaagcctggagtgatgagtaaaagcgatcattttttcgcgtccttttaccaggcgtactgtaagcggaacgtccagccatcgacgtcagcagaatattcccgatgctcaacaatattgctgtatgccaccatgccgccaaactgcggggataactgaaatcctatcgatgtaccgagcatgacgttgttattccggtcgtcctgcactaccccattgattttcgtttcaccgccaccggcccaggaactatccagagagatccataattccggggagagggtataactcacatgcccttcagcagcataggatggtcgttgtgacagtgtgttattacctgaataatcgtcattgtcggtgtaaaacgtcgcccaggtattcagttccagccagacagggcctatcggataaccggacgctaactccggtttaaacacccagcgattagcgccagcatttaagacgttattactgtcatactgaccatccggcaccgtaagccagaatgcaccggttaaaaagggctctggcgtccattttcgaaactcacttttggataaagacgggccgccaaagatgttatgcgcaaatacaatctgggtatcgccggggttttcattgataaaacttccggggaagcgggcgttgtccggcgtggccgacagccgggtataaggctgaacaatctgtatagccgacgtgcgcccgtcaatcgcaaaggtatagccataacggaagagaaaggtgtcagcatcaatattgatgccgggagcatcaacgttcattggcgcataatagccaaacacaatattgagatcgttcggtaagttcatccagtcacgggcattgtcagcagacgcgcccgcggatacgcataaaaaaaggatgcaggcataagaaagcctgttacagcattttctcgcctggtgtatgcaatgcgttatgttcataagcaatccctgtagacacatgatgtgcacaggaacataaacgcaataaaatcgtacaggtggatattataaaaacagaaataacctaacgctgaacgtcactttctcataacgcatggataattcaagctttttttttgtgcgggatatttttattgtttcagtatcaggtaaaccaacaaaaaattacaagcggaaataaaattatcaactggtaatataagtaatcatttcattattaattttccgcagattaagcaaggatcatcaagtaataattaaatcgctttttaataaaactgtctgactgcggggtgtaacaggttcgcctgatgatgttacttctcaccggcgaacctgcggcttcaccagccggtcacaacattccgtacagcagcgccgagacggtcagcacaccacccgttaacacaatcagcggcgtaaccccgcgcaggggacgcagtgcatcgcgggtataaatcagaaagaccgggatcaggaacaggaagatagcaatcattggcccgcagacggtttcaataagattgatcacattcgggttcacatagaccacggcaaacgacacggcgaacatcagcagaaacgcgattgttttgcctttgctctcggttacgccggttgtttcagtaaccagatcggcgaaggtttcggcaaccggcaggcaaatccctaaaaaggattttgtcatgccgataatggcgatcagcggagcagcataaaaaagtaatcctgagcgtccttctccttccattaccgataagacgttaaggttctgcgctttcgcggcgacaaaggtgttatggggaatgctcaggatacaactcaatacaaagaatataatgctgaagaagatcagcgtataggcaaggcgcacaacccgcaccgctttattttcgccgccgttatgcttttcgcgataatgcgccgccaggggggaaatcaacggcgtggagcaaaaagcgaaagtgatcagcggcagcgtaagccagaggttttttatcgtctcaccggttgccacattattggtggcgctcagcgccgcagtgaaatgatccagctgccagtgagggatctggattgccgcgataatcaccaccgtcagggcaaagggcagcgcgagagtgcttaaaatgctgaccactttctcacgtcctttactcaacaccataaacagacccgcgacgataataaatgccagccatgcgcggctcattatcgtaatatgaagatgatcgttcaggagattatccagcgcgtttaccagcgataccgcgtaaaccagcgtgacaggaaaatgcgccagacaaaaataaacccgtaccgccttttgtcctttcgcgccgaagaaagtgccaaacatcggcagggatttatctgccgtctggtgatcgcgcataaacacgcggcaaatcagcacgtgcggtactatcgacagcgggaaggcgagaagcagaagcataaagaacaccagcggcccacgcgtacctatttctacgggcagaaacaacgtccccgcgccaacggtggcaccgtaaacaccgagcatccagatggtatctctgaatttccatcgaggtcgggaagtggcaatgttttctacaatttgcgtagtcatagtgtcatctttcattaaaggttattcagaatgagcttaagcgtggctgatgtatatatgggtggccagcagtaaatggaaattttagttaacaaccaaaggcaattgttaaattattcctttggaagctaggatccattctgaaaaaacgcttcaatttaaataatcacctgctatttaattatcatattcgcagggcgatggaaagggaatttgtctggcatcaattgcgggacgccgtatgtactaaaaaatcggctgaatgttacagttttaaataattctgcaacattcactggtgcattacactaacaatgttttttagcggttaattatcgcgggtgcgatgtaaacgaagttaactaaagttaaactgataatatgttaagcagcattaatacttgatccaatgtcggctgtgcgttattttttgttgccgggtgcatccaatgtgccgtcattccttattaataacgatttaattttatgaaaaagacgcttttaactttggctattttattgcctgtgggaaacgcgtatgcgcatgataattgtgctgcgctggataactggcagtcggaatgcagcgccgcagagcaggcggtagaggataaaataaaccagacgcaacaaaatggtatagacagctggttaaacgatattaacaacgaagcggatcgccttggcgtccattttgacagccccgaagaggttaattactggaacgagcatcattacattacgtggggcgacaccagcgtatccgatgatttacttgctcagttgcatgatagtattacggggcatcacgacaccagtaatcccgataataacggcagcgataataacggcgataacaataataataacgccgataacaataataaccccgacaataccgacaaccctaatactgacccggcggataacggcgatacctcactggcttcggtgatcggttacgcggatgccgtttccgatcacgccgaagccgccgcagaagggcacgccgatgacgccgccgccgcagctgaaaagcacgccgacgctcatgcggacagcgccgcagctcacgccagagcgcaggctaacacctataccgatgaacagtttgccgctgcggaagcctacgccagagtgctggcggaatcctccgcgcgttatgttgatcagggcgtgcaggatgcaaaacgctataccgatcgcgtcgctaaaggtttgcaaaagcaaattgatcgcaataacaaagcgattaaacgcctcggtgccagcgcgcaggccaccgctaacctccattacaacgccaaccgcaatggctatgccgtatcagtaggtgattatcgcggcgaaaccgcgctggcgggcggtttgcagttcagagcgggtaatcacagtgccgttacggtgcagggcagttatgacgctgaagcctttggcggcagcgtcggtttacatggagactggtaacagatgtcaccttacatgaagctttttctttatctgcttatcgttggctggggattgtttgagggcgtacgaaataaccctgataaataacctccctggaatttactcacccgcataatgttcatggcgggccatcagtatcctcatcagtgagatgaggatactgacctcatttgcagtgctgcctgatgtcaatcactatccacaatcacccaacataaaatctgcgaaactagacatttgtcgacttttcatcttaaagtcgggattctgctgtcagacaacgctggtgttcagttaacaaatggttaaataatattttgccgggtgtaaatgaccgacctaaaacctccatggtcggcgtacatccggtgtttgcagtcgctacgacacacctctttgggagaatttatgcattcctctgttaataaaaacgaaagccggactttcttcgggcatccttatccacttggctcgctgttcttcacggaaatgtgggaacgattctccttttacggcattcgcccgctgctgattttgtttatggctgccaccgtttacgatggcggtatggggctggcacgtgaaaatgcctcggccattgtggggatctttgccggtagtatgtatcttgccgcgctgccgggcggctggctggccgacaactggcttggccagcagagggcggtgtggtacggctcaattttgattgctctgggccacctctccatcgcgctgtcggccatgatgggcaacagcatgttttttattggcctgatgtttatcgtccttggctccgggctgttcaaaacctgtatttcggtgatggtcggtacgctgtataaaaagggcgatgcgcgtcgtgatggcggcttctcgctgttttatatgggcatcaacatgggatcctttatcgcgccgctgatttctggttggctgattaaatcccacggctggcactggggctttggcattggtggcatcggcatgctggtggcgctggttatcttccgcctgtttgccgtaccggccatgaaacgctacgacagcgaagtgggtcttgattccacctggaacaacccggtggcgaagaaaaacggcgtcggcggctggctgctcggcctggcggcaggcgtggcgattgtcgtggcgcttatcgcgcagggcgtgattgtgattaacccggtcgctgtcgccagcgtgctggtatacgtcattgccgcctcggtagccctctactttatctggctgtttgtctttgccgggcttaaccgtaaagagcgcgccagactgctggtgtgctttatcctgctggtttccgccgccttcttctggtcggctttcgaacagaaaccgacgtcatttaacctgttcgctaatgactataccaatcgtatgatcggtgattttgagatccctgcggtgtggttccagtccattaatgcgctgttcattatcattctggcgccggtgttcagctgggcatggccgatgctggcgcgtaaaaatgtgcgcatgagcagtatgaccaaatttgtgatcggcattttgtgcgctgcgggcggctttgggctgatgatgctggcggcgcagaacgtgctggcgaacggcggggcaggcgtatcgccattctggctggtgggcagcatcctgatgctgaccctcggcgagctgtgcttaagcccgattggtctggcgaccatgacgctgctggcgccggaaagaatgcgtggtcagatgatggggctgtggttctgcgccagtgcgctgggcaacctggcggcgggtctgattggcggtcatgtgaaggcggatcagctggatatgctgccggatctgttcgcgcgctgctctattgcgctgttgatttgcgcggcggtgctgaccctgcttatcgttccggtgcgtcgtatgctggaaaatgcccaggtgaaaactgaagcaaaaccggttgctgatgcctgagtgatataacaacgctatggcaggtgtaagcctgccttagcgtcttgccgtatcaggcatagcgaccaaagacatgataaagacccgtcaggttattgactgcaaatttatgataaatgttgcgacgatggtggctcaccgttttgccgctgacgtccagataacgtgagatttccttattatttcgccctgaaataatgtagggcaataaatcactttcccgcttcgtcaggttcttctctttttcaatatgatacagccgcctgtttttggtgacgataatatgctgattgccggaggcaaaatccttcaggcacgcctttaatttgcggatggcactgacgcaatcaattgagtaatcggaaacggtattgataagaatattttcaatggtgttttcgaagcagctttcacgcgtaataaatataaaataactatctggatacttattcttaacaaccagcagatcgatgagttgctgaatgtctgactgcccataatccaccactatcgcttttgtttgactaagtattttcttggtgaatgtattaatggtatcgctgtacatcacccgtgaaaaggatttgcactcggtaagtagttgacgggaaagctcatgaaacccttcacgaaagaagctgcatgacgttattacagcgatcattatccataacctttattaaaaatattcatggtggcaataattacctgtgacggcaataaaaggcaattaagaaataggatttggattataagaaaactcttaccaaaaaagaagcatatcgtgcggcgacattatttttattacgatggtgcttaataactgtataaaaaacagatggctatatttttctttaagataaatcgtattagggcagcaactgtctgaatggatcgcgaactttcctctgatatgtttggagtcgtaacaaaatgtgaactcattaattaaagtacaggcccgctgtcggtaacgggaacgccgtaaacaaatcgcggcgcattaccttaaataaggctgaatacttaaggagtatggtatggagaagaatttccgcatcacccgcattgccagaagtgtagggctggtattaggtggcagtcttatcgttcctcacctcagcgctgcaaatacctgtgtcccttttagcgccggaacctgcgggcttaaggagttgcaggtcactaccagccttaatccaaaaccgacagcctggtattttaccagcccaacccaggatgccgccattaacggcgatgcggccgcgaaaagcatctatttcgccagcggtacctcgtcacgtggcgataatgacattcaaaacctgttggttgatggcgcgaaattagataacgcttatattaacgccagtaaaaaaggcaccgccagtattacgctggcgaataacgcgtccgtggactggctggaggctggcggcggcaccacgcatttacagataaaagtcgatcgctccaccgtgaacggcgcgcaggcggacgtggactacgataagaacggcaaaacccctgccagtaaaaactatgccagaggatcggcgctctacctcagtaccaccgataacggtaatcaaaaaatcgatattgttaacggcagcgtgctgaacggcagagtgttaaccggcggtggcggtattcatgaaataaatatcgaagagagccagttgaataagggcggcgtggtgatctccggtagccgcaataacaataccatcgcgttgaaaaatagccgtattgataccgccggcgcggtggtgccaacggataaagcgctgcacattaccagcttcgccaccacggaaatccagaacgacattgcgctggaaaacagccagcttaacggcagcatttcggtcaccaacccgaaaaccggtttaaataccctgacgctgaacggcagtaccgtgacgaaaaccactaatgccaatggcgatgcgattatcgtgaacggcggcacctccacccgtctggcggcggcgtccagcacaattaatggcaatatcgcgctgaccagcagcgatcgtgtgcaggttgatctgcaaaacgctcagcttaacggcaatatgacgctcggcaacgccagcggtattgatgtaaaactcagtaataatgcgcatatcaccggcgatgtgatcctcgcgggtgacactgtgcagagcgcgaacgtgctgctcgacaatgccgttatcgacggtcacctctacggcagcgtcaacagcgccctgacgctggcccgctcgatgacccgtctggatggcagtaaattcagcaatatcagtaagctgaatattatcggccagaccgcgatacagggcggctttaccgacggtaacgtcggccaggcgttgcaggtgaacggcggcaaagtgaccgcccccgtcgatctgagcctgggaaaactgacgttcagtgcggcgcagattatggcggatacgctctccctgcgcgatggcgcctcgcttgagctgactaacaagagcctgctgcaaacccggtcagcacagctttttaatcaggacgccagcactgataccactggcggatttaacgctaccggatcgcgcatccgcattaatgacagcaccctggtgttaaccgacagcacctatcagctcggctacgtgaagtcgataaaccagctgctggaaggccacaccaatggcgcgctggtgatgaccggacaactggtcaacggcgatacggccgtgggcaccgtcactatcgccgacgccgcggttgccggggcggtactttcagaggtgcaggtcacggcggataaaaaccatctggtgataggcgcgtccggcgcgccgctgccggaggatgccatcggcgtggaaaacagtttcggcgccgcgcagctggtgctggaaggcacgcaggatgcagaggttgaaatcaccggcggccagtcgctgacgctgaccggggcgatgggcggcgcgctgattggcgtcgccggggcgcctgaggcaaatgtgaatatcaacgtcagcaacggcgcgctgaacctcggcgccagggccaccggtaacaccagcggcacgctgcatggcaatatcagcgtgggcagcgacagccagatgaacgtggtcgccggacaccacagcgtgacctccggcaacagcgaagcggccattgtcagcagcggtacggtgaatatctatcagaacgctatttttgacgccgacctggcgttgcaggatgaggcgcaactgaacgttcagggggcgcttaatgcggagcatctgatcgcagggcaggacgccatgatcacagtcggcaatctcaccgccgcgggatcgctggtgatcggcgatgcggatctgcagggcgcgcggatgtttatcgacccggcgtggaagagcggcgcaaccctgaaagacgcctcgcaggtggtgatggccggtcgcgaggtgaatggtcgcctgaccaccgggcagaatgccctgctggtgctgggggacacgtccagcgcagctgcgctgcaacacttcgccgacagcgggcttcgctggggcaaagagagtattaccgcggcactggcgattggcgcaccgcaaacgctggcggcaggaacgggcggtctgcgtattgatggctcgctgaccagcgcatcggcttcccgtgacgccacggtgaaccacgctgaatttggcgaacattcgctgctgatggtgaacgcttccgccgccgcagggcacggggcgctgaacgccactgacggcacgttaaaagtggcagactcggccgcgctttatatcgccgacgccagagccaataaaacctataccattgcgaacggtttcagtgacatccagcgggaagggcagggctggcagggggcgaacctggtggtgaacaagctgcttgacgccaccacacaggaaaataacggcgcggtaacggtcaccacctccgccaaagcgtcgcaggtggtcctgccgggcgtggcgatcggtaatgcgctcaacagcatgatcagcagcgggtcgaactcgctggccagtccgcacgccagtattcgcctgctgtcgaccgccattgaagatcccaaagtgcacaacagcgaggtgatcaaaaccctcaacagcgtggcgcaactggctattgcgggcggggtgcagagcagcacgctggcgaccgggatggccgctgccggggcgattcaggacaggctgtcggtcaccggtaacgggctgcaagcggataaggatgccagcgtctgggtgcaggcgctgtatggcaaccagcgcaaccgcgatttgcacgcctcgcgcatgacctacggctatgacaccgacttcaccggcctgatagtgggcagcgatatggcttatgacagcgcgctgggggcgatgcgcagcggcggcgcggttcatgccggtaacggtgaaaccgactccaccggtgacttcaacgccaccagtaatgacttcagcttctggggcgtcgcgctgtatcagaactgggcgagtcagggcgcgaacgtcactgcggacatcggctacagcgaaaaccgtaacgaccttgaacagcgtattccggcatggacaaatctggatggcaaagtgaagggctcggtggattcgcatttgttcaccgtcggcatcactggtgaatatcggattaacacgccgctggtggagattgtcccgcacgcgggcgctcgcttcaaccaactgaccacccgcgggttcgatactaacggcagccgtcgcgacagcctgttcataacggatcaaacgcgtcaggatatctggcagttcccggcgggtgtgaagtttactaaagccttcgcgctggatgcgggctgggatctgcgcgcccgggctgatgtcggagtgattgctgtcgcaggcgacacgcgcacgcagagcagagtctccgcacctgggatccaggcttctgacgtgattgccgccgatgtggtcgacaacaccgcgttcaacggacaactgggcgtgaagctgcacaaaggcaacatggccttcggtgttggctacaacatcacggcgtctgaacacagcaccggtcagacgataggcgcaacctataaactttccttctgataacatgaggatcgcgggcgtcaggcccgcgatttttttagcttaaatcatgcagggctttatcgagcggcggcgtaagcgttatctccggaaactccaccgccagcccgcgccgttcaggcgtacagcacatcacgcccactttcgccgggccacgcggaaaccagcctaaacgcagcagcggccagtgctggccatcggtggaatactgtagccgcagactgtcgcctttacgcgttagccgcagccagaaaatgcgcggatcgcccggaaaaatccccgtcgcccagtctgaattctcccgcgtcagcacgctgccgatagccggcgcgccatcgttatactcaatgccggcttttaaccagtagtgctcgtcgatcatcagcatgatccccgcctggtcgtacagcgtgttgaaatcggcgcatacctttacctggaaggtaaagtcatcggcgacctctgttgcgaaaatatgcccggaaaagcgctcaaagccataccaggttttttgccagaagtctgtcttttcgtcggtaataacctgtaatttaccgttttcgtaatgccactgtgcgggttcattgatccagttaaaatttactgacatgcagcctccagcgtcgtcaggatgaagtctcagtgtagaatctttcatacaaaacagcctatggcgtacgcaccatttcatactgggcaatcaccatttccttaaagcccgccccttcaaacaatgaagaaaaagcggacggaacggcgacgggcgttccaatcccaggatattgcgcgttgattttttgcaatagctggcgggcaaggccctgacggcggtgcgcgggatccacgaaaagatagcgcagctgcggcgtggctgtcagcgtggcgatcaccccccaggcgtgctcgccatctttcaccacccgacacggcagcgacgggaagcagagcggatcgagctgccagggcgtattttcagccgggccgcgataaatcgcgcacagcaggccatccagcgagtcgtctgccagttcagtcctgggttcgacaagcttgccctgatagccgcacagttcgcgcgcgacgcaaaatcccagcgattgatacagcgcaatggcaggcctgttctcgcggatcacctcaagcgacagagaggtgacctctgttagcccggcaaataacacgctcagcatcggtttggtcagccctttaccgcgccagccaggctggatcgcaaaggccgccagccgcgcgcggttgccccgccgcgtaataagcgcgatcgccacaggctcgttatccgcaaaccagacgcaggaatctgcaaagctcagcccctcggcaataaagcgggcggcaaagtgctctggcgttagcgtaaaaggaacaaaataatcctgaaaacagcgcccgagaatatccgtcagctcagtgatgctgagcgcgtaagcgggtacggcggtaaaaggcatcgcatctctccatgaacaaatgagtcacttattctacagggtaacgccgacggttactgttgggttgacggcaaaaggcagctacactcagtttgcagataacattgcgcatgttgcgcgcttttgccagaggatatgacaatgcaccacacgatgaaaaacgatcctgaagatacgtcaaaagaagaaacccagggttccggcctgttgcagcaaaaaatgctcgcctcccgctcgatcattatttccggtgagatcaaccagacgctggccgaaaaagtagtgacgcagctgatcctgttgcaaagcatcaacaatgatccgattaagctttatatcaacagccagggcggtcatgttgaagcgggcgataccatccacgactttatcaaattcattcgtccggaagtgcatgtcattggtaccggctgggtcgccagcgccgggatcaccatttacctggcagcgaaaaaagagcaccgctattctctgccaaatacccgttttatgatccatcagccgttaggcggcgtgcgtggtcaggcaacggatattgaaattgaagcgcgtgaaattattcgcatgcaggaaagggttaacaagctgattgccgacgcgaccgggcagccgctggaaaaagtgaaaaaagattcagaccgtaactactggatgtcaccggagcaggcgctggattacggcgtcgtcggtaaattaattcagcactatgacgatttaaacctcgactaagcctgtattgcgcgcataaaaaaagctccctcgggagcttttttgtctggcggcgccaggacaggctcgctgacttattttgtcagttcagcggtcatgtgcacgttattactgacgttagcttcagtaattttataggatgcgccagctttctctgcttttgcggcaatctgcgcttcagcggcgtccagcgtggaggcagaagcggtaacggattgtgcgaaagcgccgaaagacatcagggacagagcggctacagcggccagggttttaacgtttttcatgataattccttaaacagtatattcggtaagagcgttaactttttgttcagggatcgccagttactggagatcgcctgcggtcaggttttcaggatcgaaagcgtgactgtattccaggtggttccgatgcgcggtgttatcgatattcgaaccggcttcaggacgcggtgtagagttattggctgccattgcgccaaaggagacggtggcggccaggataaaagcagtaactacgctgatgtttttcattttttgtaccttctttcatcaagggtcgttatcggcgacttatttataaattaccgcagtaccgtgcagcgtattcgggccggtaatagaagtgatgcggtaagacttcgcgcccatttcatcggctttctgtgccagttctgcttccagtgatgcgatgttagtgcccgcgttagctgagatatgccccactttctgctgaccggcgggagtcgcatcaacctgcaccgcagcgacgcttgcgaaagagagtgaactcaggatggcgacggcgaacagagctttaacgtttttcataatcagtaccttcagtattcggtgtaatgagtgtcgtaagtaattacttaacgatcgatagacaaatgatagatgtgatctgcatcacacgtcaaccttattttttaatgaccgttaatataattattaaacccatataaatcatttagatacatggaaaaattttttgtataaaacctgctggtcatcgctgccgacttgtttttataatgattactatataaatcactgaaagcagggggccgaatgaccatgcagatgacaagttgtacgaagaaaggcaggggacgacccaaagtgtttgaccgtgaggccacgctggatcgggcgatggaattattctggcagcacggctacgaagcgacctcgcttgccgatctggtagaggcgacaggcgcgaaggcgccgacgttatatgcagaatttactaataaagagggactgttccgggcggtactggaccgctatgtcagtacctttgccgccaggcacaaagcgcagttgttctgcgatgagaaacccgtggagcaggccgtgcgtgactatctcaccgcgctggcccgttgctttaccagcacagataccccggcaggttgttttctgatcaatacttccgccacggtatcggcatcttcagagcaaatcgcctgtgctgtgcgtacccgtcatgcgcaggaagaaaagatgctgctggcgtttttaacgcaacggcaggaaaagggtgaactgcccgcccacaccgatttgtcagcattgaccgcttttataagctgcctgatccaggggatgtcggtcagcgcccgtgaaggggcgtcgcctgaagatctgatgcaaattatcgatacgacgctggcgttgtggccgacgttagtttcgtcttaagtcattaaaatgattggttttactgataaatggcgatatggccggaaatgtgaccggatacgataataaaaaattttcagataattctgctaaaaaagcacaattttaaggcggtctggtataaaccatctataatctctattcatacctttgagggtgaaaatgtgaacaatggtttttaccggatccggtacaaaggtatcgtgcagctcgcattctatacgaatgaagaagtagaaaaccttgacaccggtacgcagacaatgggtttctggcgctttgttgagggctttgaaatcgacaacaatgacgagattggtgtactgggtgggccttatgacgcctttggaaactcgctgacgagcattgtattaagcaatgaacctgtttatacgggtggcattttcggcagcggcgaacaaacggaacaaatataatctcagataggccgatcggacgatcggcctttctttttactgcttaaaagcagcagatgaaattacgcctgctgttcagcaaggatcgtcagtttctcatctgtggctttttcttcttccagggtttcacccagtaaacgggcagcttctttataacccagtttcaccgccagtgcgcgaagcgtaccgtaagtggcgatctcatagtgctcgaccttttgcgcagcgccaatcaaaccagcgtcacgtaccgggcccgcttccacagaatcgatgatttcctgggcttcctcgaccagaccttctaacgcatggcatttcattcgcttaatgcgtacaccctcagttgcttccaccagttgatcaagacgctcaatctgaccttgcgtctcttcaaggtgttgtttaaacgcggcgaccagtttctcatcggtggctgcgcgagccattttcggcagggcacgcgtaatttgcttctcagcgctgtaaacgtctgataaatcgtgaatgaataaatcttctaaagtcttaatggtcattttgtattccttaaataatcattggagaaacaatccgcaaattatgcgggattacgcgatggtcagatttcagtttagacgatcctcaaaatttgcaatgaaaataaaaatttagattatgggatgattcctggtgaaaatcaggcgggggataattacgtcacctgtataaactatgtgaaagtaatacttctttattaattgccgggccgggaaataccagaacagcggcatgataagttggcaagtaagaattttcctttaatccagtacggaaaacgatacacttcaacatacgttgtaatgaagtcgttgaggaaagaacgatgctttcgaatatccacacccgtaccgggcagccgtcgctgttccgggcaggtgtccaggcctgtttccctacgctccccggttactggagtatcggtatcgcggcaggcgcgatagggacgttatccggcttttctgttgtgcaaatcacgctgctggcagggtgtctttacgcggggtccgcgcatttccttttttactccttatgggccgccggggcagaaaccgcctccatcgtgctgagcgtgctgctcgtcaacctgcgttatctgttgatgagttcctctgtcagcctctttttccagcacagcaccacgtatcagaaaattgtcagcggcctgctgttgaccgatgaaacctttggcgtggccgtacagtatggtagtgaagcaggtgaaattccctttaaatggatgcttggcctgaacctcacggcctggattaactggatcatctcctgcgtactgggagcctggctggcgtcgtcgctgcctgccgcactgatggaaggcctgagctttagcctggtatcgatgtttatcgggctgatcctgatgacctggtttgccagtaaacgacaacgtctggaaacgctgactatcgtcaccgcgatggtcataaccctgttatttcactcatggtcgaacaccagcctggttgttatttttgccgcttcagcggcagctactctggccacactggtgttgatcaaaatggaaaaaaggggcaaataacatggacagaaatattattctggcaattgcgctggtgtcgattgttactgctgccatgcgcgtcatgccgttattgttattatcccgtatgcgtttatccttcacgctgcaacaatggctggcttttattccctccggaattatgactgccatcgtggtgactgagctgctccagaaaccagcgatgaccgcctccgggctcagcgtatcgctgctggcggcgattgtcgcaaccctggtcggcgcgcttacccgcagcttattcgccaccgtgattagcggtatggtcgctttttccgtgctgcaattaatgagctggctataattttttacctgttacttttagtcacagcttttctggcgcaggggataacctctcctgcgccatggacggcggccagatcgcgccataataaatgaaatttgcgctaagcgcgttttgtaatgtaaaagccacaataattaaaagtgaatagccctatttaaccgttttaatttcgatgatataaatattccgagcatgtcacatccccaattcaggtagtgcgaatttgcctaaatgagataactacgcatccgccagcacgtaaaaatgaaatatgcttaaccgctgttggtttctggatgtaatagaaacaataatctacatgcaattcgcgaggcctgaatgattattctcattaccctcagtcagaggctgtgcctgtgttaatgatcgctgttcgctttcgggagcaacgccagtaaaaatgatgactgatgataaaaaaacctttaatcccagggatgtagacctgaaacacctgaacgatctgcttaatcataattccgactggatttgggaagtggatgcgcagggacgttatacctggtcgtcggaggtggtcaccagtctgctgggatacacaccggacgaagtgattggttgtacgccctttgattttatgccgccgggtgaggccgagcgggtggccggtgcgtttctggctattgtgcagcagcagatccccttttccgggctggttaaccgcaataagcgggcggacggggaagtgatcgtgctggaaaccagcggcattccgctgttcgacgagaagggcgaactgcgtggctatcggggtgtggatcgcaatatctccaccctgggcgaacgcgtcctgcaactggaaaccatctacgataccacgccggtggcgctgtgcatgatcgaccgcaacgggcagatggtgatgtccaacaaagccatggcgcggctgttaaaccgcaccagcaatgaaataaacggcaaacctgttgttgagctgatgccggcctgctggcagcacttcgagcgggattttacgctggcggatagcggcgctgagctcgccgggcgcgaaacccactgggaagggcgtaccttctcattgcatccggtgccggtacatgatgcggcgggtaacgttgtcgggctgtccgtcacctgggtggatgtgaccgaacggtatcaggccgaacaaaaactggcggatgccaatcaggtattacagcagcacgcccagcatgactatctcaccgggctgtttaaccgtcgctttatggacgagtgcctgaaccgtgaaattatccgcgcctgtgaaaagggctattttctgtcggtttgtctggcggatattgattatttcaaacgctttaacgacagtcagggccaccaggcaggggatgcctgcctgcgggatgtcgctaacgcgctgaccgccgtgcgtcaccggcccgatgataacgtcagccgttacggcggcgaagagtttctggtcattttaccctgcaccgatcgcgaggaagcgcaggccattgccgaggggctgcgtgaaagtattgaggcgctgcggatcccgaatgccgcaagcccgaccggttttttaactatcagcatcggcgtcgccacgctcaatggcagcaaaacgctgccgcaggacaaaccgctgcctattattgccagtggcttaattcgccgcgcggataacgcgctgtatgccgcgaaaaatcagggcagaaaccgggtggttatttcccgggagccggaaggccattagccctgcacgttatactgatgttgttaaccgttttttaggatctggagcatgatttctaccctgatttaccggagtcgcctgacaagcagctttgacccttcaaagctgggcgaactggtatgcgtctcccggacccgtaacgccgctatgggtatctctggcatcctgctgtttgacggtagccattttttgcaggtgctggaaggcccgctggagaaggttaaccagctgtacgaaagcattaacgccgatccacgccacgactccgtggtcgaactgatgcgcgactatgcgccaaaacgccatttccagactaacggcatggcgctgtatgatttacgcaccggcaatccgcgcgccatcctgcgctcggtgatcagcgccggggcgctgaatttcagactcgccagcgatgcccgggtgtacaagtttattaagtcctttatgcgcgggcgctggcgcgatatcaatccacggctgtcagagcccgctaactgggaatttgttgcggaaaatttgaccttcacgcaaccgcaggcgatgctgtttgccgatcagccctgccagtttgccatccagccgattgtcgagccgctgcgcgggcaaattagctcctttgaagcgctgatccgcagtcccaccggcggttcgcctcatgattattttgcctccataccgccggggaaaattcacgaggctgatttgctgtccaaggagtatgcttttgcgcttgcgaaaaaaatcggcattggcagcaataaactttccattaacctgttgccgatgtcgctggtcaaaatccctgacgcggtaaatatcctgctcgatcaaattacccgcaacggcctggtgccggaacaggtgatcgtcgaggtgacggaagatgaagtgatttccggctacgacgccttcgcctttgccattatgcaactgcgctcggcggggattggccttgcaatcgacgatttcggtgcgggctttgcggggctgtcattattaaccaaattccagcccggcgagctgaaaatcgatcgcagcattattaccgatattcacctgcacggcccgcagcaggcgatcctcaatgccatcataaaatgctgtgccgagctggagatcgacgtggtggcggagggcgtcgaaaaggttgaagagtggtgctggctggaggccgcaggcattaaacatttccagggatatttatttgcgcgtccgggtctcaaccgtgtaccgccaatccgctggccggtaaaaatcaaaaactgacgccgctttttccatcctgttgatttatctgcgccttaaccctaaagatccgcccgataatgccgttatgctttgcagggttatatttaatgtctggcaaggatccgcattatggaaaataaacaccaactgctggctacgcgtcttggggaaattctcgggcgttttaataatggcgagacgctgtacgtaaaccaactggcggaagagtatggcgtgcatccgcgcaccattaagcgcgatattctcgaacgcctgagttttctggatattgagccacaggcggaacgcggcggttacaaaattgcgcccggactgctgggacgcttcgatgccaacagcatcgatctctttgcgcggctggcgggcgtcagcgaactgtttccgggctttaataagcgcatgctgtcatccatgcattcggccaccgccagtcagaccatcacggtacacgggcatcgctatattgacagcgaacttcaggccgttcacttttcccgtttacagcgcgccattgacgagcactgctgcgtcaacttccgctacctgcgtcgtaacgaggagcgccgttatgcggtggagccttatcagctcaccaatctgaacggcatctggtacctggcggcgcgtcatgaaaaccgcatgaaaaacttcaccttaaccaagatcaccgcgctggattgtacctttgaaacctttgagccggatggagaactactggcaaaaatgcgtcaggaaccgagcgtgtggggcgtggaagataagttcagcgtgacgctcagcgtggcgccggaggtggcggagtatttccagcgccgggatctgctcaacgagcaggtgatcgaacagcacaccgccgatggcggcctgatcgtcaccactcaggtggcgcataaaaaagagatcctgccggtggtgcagtactggatcccgcacctgaagatcctcgcacctgcatcactgcaaagcgaaatggaagcggagatcaaaagctggctgacggcgtaaacgcgtttcaggtcagcggcacgcgcggcttcaccaggccgtgcagcgccggattatcgctttcatcctttagttttacgccggtcagacggcgtaaaaacgcctgctccagcagccatgccagcttaaacgccgccgcgtcgtggcacagcccttccggacggatattggaaatgcagttgcgctccgactccagccgcgtgcggcccggtttccacgtcaggtaaacgcccaggctgtccggcgacgacaggccggggcgctcgccaatcaaaatcgccaccgccttgctgttcagcgtttcgccgatgtcatcccccagcgcgacccgtgactgatgcgccagcaccacaggcgcgagggacaatcctagcgtgtgcagatacggcagcagggcggcgatcagcggcaccgcctggcgatgcaccgcatgggacgagagcccgtcgccaatcaccagcagcagatcgtgtgcggcaacgggatgatcacgcagtgcgtcacggctttcctcactcaatttgcggcccagatccgggcgatttaaataaatatgccgatccgccgccgcgctgtgaacggtcagggtttgcaggccgagcgccgctaattcgttttccagcgagcggctgtcaaagggctggtggatggcgtcgcgcgcctgcgcatgggcgagaccaaaattcagtacctcgcgggttggcaggctggccccgctgcggccgagggcgatacgcgcatcggtaaattcccgcaacagtgaccaggcatcgggatttttcatactgtcgctccctgcggcagaatgctgagcaacgggtgactggcaccggttaagcgcagctggccgctattgtcgatgatctgcatgcgggtcagccattcgccgaactccggggcatgtttcaggccgagcagacgccgggcgtagagcgcatcgtgaaaggaggtgctctgataattgagcatgatgtcatccgcgcccggcacgccaatcaggaaggtcagcccggcgttgcacagcagcgtcagcagggtatccatatcatcctgatccgcctcggcatggttggtgtagcagacgtcgcagccaatcggcagtcccatcagtttgccgcagaagtgatcttccagcccggcgcggatgatctgtttgccgtcatagagatattccgggccaataaagcccaccacggtattcaccagcaggggatcaaaatgccgcgccaccgcgtaggcccgcgcttcgcaggtttgctgatcgacgccgtgatgcgctcccgccgacaggcaactgccctggccggtttcaaaatacatcaggttactgccgagcgtaccccgtccaagactcagcgccgcctcctgcgcctcgcgcagcaacgccagattgatgccaaaaccgctgttcgccgcttcggtgcctgccaccgactgaaataccagatcgacaggcgcgccgcgttcgatcagttgcagcgtgttggtgacgtgcgtcagcacgcaggactgggtggggatcgcaaagcggtcaatgatatccgccatcatatgattcagtcgctccagcaccggcaggctgtcgctggcgggattaattcccactaccgcgtcacccgcgccgtacagcaggccgtcgagcatactggcggcattgccttttaaatcgtccgtggggtgattcggttgcaggcgcacgctaaggtgccccggcagaccgatggtgttgcgaaaacgagtgatcacccggcatttactggcggcgaggatcagatcctggttgcgcataattttgctgacggccgccgccatttccggcgtgatggcgcgggcgacgcggcttaatgtctgcgtgtcggtactgtcctccagtagccagtcgcgaaaatctcccaccgtcaggtgactgatgtcgcgaaatgcttcctggtcatgggtatcgataatcagccgggtgacttcgtcctgctcgtaggggataagcggatccgcaaggatgttacgcagcggcacctccgccagcgccatttttgccgccatgcgctcttccgcagactctgcgctgacacccgccagcacatccccggagcgcgccggggacgctttcgccagcagatctttcaggctggcgaagcggtaggtccggtgcgccagagtggttttatacatggtgtctcctcaggagagcgcccgcaattgcggatccagcgccgcctgctcgcgggccgacgcggttttgcgaaaccacagataacccgcgagcatcatggcggcaaaaatcagcgccagcagcgggttataccagaccatcgccaccagacagagcaccgccattgcgagcgcgaaggctggcgcatacgggaacagcggcgcgcgaaatggccggatcagccggggttcgctgcggcgcagtttgaacagcgcggccatggaagtgatatacataacaatagcgccaaataccgacatcgtcacaatgcaggcggtaagcggcataccgctgatggtgatgagcgaatcggagaagatcgccgcgatccccaccacgccgcccgcgaggatcgccagatgaggcgtgcgggtgcggcggttaagggtggcgagccgcgccggtaagtaacccgccctggccagagagtagatctggcgggaatagcccatgatgatgccgtgaaatgacgccaccaggccaaacagcccgagccacaccagcatgtgcagccagccactgctgctgccgaccaccgctttcatcgcctgcggcagcggatcgttaatgttcgacagggcgcgccagtcgccgacgccgccggcaaatatcatcacgccgactgccagcacggtgagcgtcagaataccgccgcccagcgcgcggggaatggtgcgctggggatctttggcttcttcggccgccatggatgcgccttcgatggcgaggaaaaaccagatggcaaaggggattgcggcaaacatccccggcagcgccaggctgctgaagctttccgcgccagcccagccgtgggcggtaaagttgtcccatgagaagccaggcgcaaccacgcccataaacaccagcagttcgaaaatcgccagcagggtgacgatcagctcaaaggtggcggcgatgccgacgcccataatgttcagcgtcataaagatgacgtaagcgccgcaggccacccattttggatcgagcgacgggaactgaacgttgaggtaggcgccaatcgccatggcgatcgccggtggcgcaaacacgaattctatcagcgtggcgaatccggcaataaacccgccggtcggcccgaaggcgcgatacgcatacgcaaaaggcccaccggcatgaggaatggcggtggtaagctccgtaaagctaaaaataaaggcgcagtacatggcggcgatcagcagggcgacaatcaaaaacccgagcgtgcccgcctgcgaccagccgtagctccagccgaaatattcccctgaaatcaccagtccaacagcaatgccccacagacggaagctgccgagcgttctttttaaggtggttgtttctgtgttcatcgtgaagtgcctcgccattaaacccagtcggaaaaggcgttgcaaaggcgatgccagaaataaacctcatcattttcatgtggatagcgtaaaggtgaacacccactgcaccgtcatgaacgttatgacggtgcagtttgctccggcgtagtgaaagggcgattaaaatatccaggtgagatcaagcgccgcattgacgccagtatagttttccagcggcatatcgtaccactgcttgccgagggtaatgcccagcacccagtgcgcattcagaggctgtacgcggcgcaggctgacgctttgcgtggtgccggtgtagctctccggcgcccagtcatagttataggcaccgctgccccaggcaaaccacatctgggtgctgcctttgccagcggcgtcgttgagtttcagcgacaccacatgactgtagctgtccccggcgccgtgtgagtcgtaccaggtataacgccagttggtgatggtcggccccgcgtaatacgttaaccctgcggaccaggcgtccacatcgacgccgccataataccgggcagtgcgatagcctcccgtgaccagcagtggtttaagcactttgagcgttacatcctgctggagatcctggcgggcgaaaacgggcgtatcttctgccagcgcgatgctgctgcgggtggacagcctgtcattccagcgatgccagagggacgcgcggccccgcacgctgtgatagcgctcaccggccgcgtattcccgctccccttcgctgagattaaccaccagcgcgcccttatccagcgtatttttgatttcagcaaacagcatattccgcgaaccatgggagccggaatagtcgttaaaatcatagccggcggtcaggctggtgagctccgcgtgcaacggcgcgcacatcagggttgccgttattgccagcgcaattcgcctcatctgtcatctccttatgaatgatttcctgtttcaggctgtagcggccggatggcagatttttctccaccagaatacgcggccccagcagggtatccggcgcgattatgcgtcccggcaaaatgatcacctggatgcccagccgcgcaccccggccaatccaggcgccgagcttttcacagccggtgtcgatccgctctcctgctatatcgacgctgacggttttgccatcaagccggtggttgctggtgcgtacctgcgcccccagataggcgtcctgcccgatcgccgagtcggcaataaaacattgcggcccaatggcgacgttcttttcaatgaccgcgtttttgatttcagtggcgaagcccaccctgacattgttgctcagcacgctgccgggacgaataaaggcgtagttgccgatcaggcaatgagcgcctatcaccgcgggcccctggatcaccgcgccgtggcaaatttttgtgccctggccgatgcggacttcccccgcgctttcgtcgatcagcgccgtcggggcaatctccacaggagcggttgccgaaggctcaagcctgagatagctgatcatcagcggcgacaggtttgccggttgaagcgggcggcgtttccaccacggcagcataacgggtgggtttgtcgcgctgaggttcacgtccagtgaaaaaggcaataattccataaaccatccatatggcgtaggccagtaatacgtaaaacacagagagaggtgccagcggaattaatagccagcagcgatgataccaggcgctgaaggtgccgatcacacagacgatccccacccagatcagcgggaagacagactccacaatccctatgggcccgtgcgtaatgatgctccacgtccagaccatcgcgtaggtcatgacgccgtaaatcaccaccagcaccatgggcaggattgaaaatatgccgaagcggcttaagatcagcgatttatgcaaacgcatgcagacggcgtaacccacaatccagcgtcgccagcgtttccactcatcccgaaaggtattgcactcctgggggtaaaccacgcagcgattggcctggcggatgcaataaccgttggcgatcagcgtccaggagagatcgagatcttcaactttggtgcgatcggaaaagccatatttacgcagtacccgggtacggaacatgccgcaggccccgctgatgatgaagggcgcgccgccgagaaactgctgtaaggtgcgtttcatgacgatcatcggcagctttaccgtggcgcgaatatggggaagaatgcctgcaccctgaaggtgggttgatgggataccgccaacggcatccgcgccgctgtcaatttccgccagcatgtagccgatcccgtcctgatcgtagggcacccaggtgtcggcatcgctcagaaaaacctgatcgcaggtggcgtattgcagaccattcatcagcgcgccgcctttaccggtatttttttgcgtcacggctataaaacggtcgccccatttttttttcacctgcgccattacggcttctgtattatcggttgagccatcattgacgcaaatgaccgtgcggaaataaggattacgcagcagattatccagtgactgggcgaggcaggggccttcgttataggcgggaataatggcatccacttcaccatatcgccggctgggttttttatttaagcgcagcaggatccagcaaaggatagtgatactcatcataataaaaatgatagttttcattttttctcacaaaatcattttttgcacaacgaaaccttcgcacaaattcatgcctgcctgtaaaccacgaaattgagccagcgctcttatggactcaggctgcatataatcgcgatgtttctggctttgatgaaatttaagggcggcaattttattcgtcagcgccttctcatcaaactcttcaaaggcttgcggaataaaagacagacgacagcttggcgtttcataacacaatatttgcggtatggtgcgacaggcgaccatcgaggcctgataggttgcgcggtggtcctgatggcggtctttgtcgtgcatggtgtaagtacgcacaaacctgataccagcgtcttcctgtgcttttatcacttcaccgatgctgttgataatggcatccagataatgatcggtgcgggtatcctgataatgaaacggaaataaatcctgacagcccagcgtgttcagcgccagccgggattcatcatgacggcttattcccgcagggcaaccggcattacccgcagtaagaataatagcggtaatgtgaaagccttttgcagcaagattagccagggtcgcaccgcagccaagttcaatatcatccgggtgcgcgccaattgccagaataccaggtttacggttttgtataaaatgatcagaaataccgacgtgcattttactatccacaatagtcatcctttattgtagtttttttgttgtttttataatggtgcgggtgcgcgggctattgtgtttctgaacgtagtaaaatgtcctttgtcgatagtttgcatcttataaacaacaggcatgattttatcttgaataaaattagaagttgagaacgttaacgatattaatttggggtagggtaagtgtcaatcattatgttttagtgcatcttttaacaagatttattaattgtctggtaaatatatccctgcgctctttttcacaatttttaggattctatttagataaaaatgatgcgctattcacgaaaaagggattgttttattaagtgaatggcatcaaccctctcttaagccaaagtatgagggaaaattaattttgtaaacattcaccggtgaaatgaaaaaaatgtcacaccattaaccgaaaaatggcgtctttcccggcgggaagacgctgcaggtttaacggtgcaccccaatgtagcgctcgtagcgattggttttaagataggtgagatccaccagcaccagcccgtccacgcagtggttaaaatcgggatcgctgccgaaatcaataaactgcacgccgcccggctcgcacagctcggaatactgtttgtacagcgggggaatgccgcagcccagattgccgagcagggatttcaggcgcgtaagatcggaggtgtaatcttcgccggtaaactgtgccagcacatccggcagactggcaggataagggcggcgcgaggcggcgaaggggtgcgcaggcgggaaccacaggcggtaaaaggccaccagcaaatcccgcgcggcgggaggcagaccgccggaaatggaaaccggtccaaacagatagcgatactgcggaaaacgcgccagatacgccccgataccggaccataaatagtccagaccccggcgtccccagtagcgcggctgaataaaactgcgccccagttcgatgccctgttgcagaatatcggccattttgtcgtcgtaatggaacaggctgtggctgtaaagcccttcgatgccctgtgcgttaagggcgctggcagcaggcttaaaacggtatgcgccaaccacttccagatccgcttcatcccacaggatcagatgcagatagtcatcatcgtagcgatccgtgtcacggcgtttaccgctgccttcgcccaccgcgcgaaaggcgatctcacgcaggcggcccagttcgcgcaggatcggcgcatcttcttcgccgttgcgctgccataaatagatggtttttccgtccgcggtttgccccaggcattcggctttgcccagcgcccgcttcagggtgagacgatcttccggacgggcaatggcgcactcggttcgcaagatgccgggctggtttttgcttaaatgcatcaggtgctgacggcatttttcggccatctcccgcgaggcgctttgcggactgtaccagctatcccagggaatgcgctggccgatgttgatcggcaggctgctgttgcgacggcggaacatctgttgcattagcagcagcaacggcagcgtgcgggaaatcagcgtactggcgtaaaacagcgcgctgttgtgggcacggatatgcaccggcagcagcggagcgcggaatttcgccgccattttgacaaaacccgcctgccagctgcgatcgcgtatgccgctgcgggtcaggcgcgacacttcccccgccggaaagaagatcagcacgccgccatcctgtaactgattttccatctgttgcagcgaggcttttcgcgtgcgcccgcccagattatcgaccggaataaacaacgagctcagcggctccagatggctcagcatgcgattggtgaccacttttacatcgcggcgcacgcgggagacggcatacagcagggccaggccgtcaagcgtaccggtagggtggttggcgacgatcaccagcgggccatgttcggggatttgttcaaggtcgtgagcggaaatggtgcagcggatctgtaagtgttcaagcacctgctcgaccatctccagccctttcagatgacgatgccgggcggcgaattgctgaaactcttcttcatagaacagacgtcgcaacgcatttttttgccagggcgccggtctggcctgcggccagaggtcgtcgagtacattatcgaggctaaacatgttggctcctcctcccgtcctgatgcagacagtagaagggcatgatgacgtttacatttcagcggtatgaataaataaaatcgttaagcgggaatataaaaggcataaaaaaggcgggatacccccgccctgttgattagaggatcttgcgttccgccagatccagcgcgaagtaactgaagatcagatctgcgccggcgcgtttgatcgcgcccaggctttcgaggatcactttatcttcatcaatcgcgcccgcctgagcggcgaatttgatcatcgcgtactcgccacttacctggtatgcgccaagcggcagctgcgtgcgttcacgaatatcgcgcagaatgtccagataggcgccagccggtttcaccatcaggcagtctgcgccctgggcttcgtcgagcagggattcgcggatcgcttcacgacggttcatggggttcatctgataggttttacgatcgcctttcagcgcggtaccggcggcttcgcgaaacgggccgtaaaacgaagaggcgaatttggtggagtaggacatgatggcggtatcgttgaagccagccgcatcaagcgcctgacgtatcgcctgtacctgaccatccatcgcggcggacggggcgataaaatcagcgccggcggccgcggcgactaccgcctgcttgccaagattgatgagggttgcgtcgttatcgacaccgtgctcgcaaagcacaccgcagtggccgtgggaggtgtattcacaaaaacaggtgtcggacatcacgatcatttccggcacggcatcttttgcgatccgcgacatacgcgccaccagaccgtcttctttccaggcatcgctgccggtggcatcagtgtggtgtgatatgccgaaggtcatcaccgagcggatcccggccttcgcaatgcgttcaatttcgcgggcgagaaacttctccggtatgcgcatcacgcccggcatggcatcgatggccttgtagtcggcaagttcttcttcaacaaaaattggtaacaccaggtcgttaaggctcagtgttgtctcttcaaacatggcgcggagtgcgggtgatttgcgcagacggcgcgggcgggtgattaagtcggtcatgatttgcctgatgttggtgggacaccatggcattttacctcaatttgaccgtgatgtttcaccaaactggccttacagaccgccgtggcagactggcgtaacgtgaactcgtaatatatttactgcactataaattcgcattcatatatttatttgctaactacgtttttcatttttataaataattataggtttgctaaatgacgatttttaaataatcaccgatatcaatgtatatctggattttaatcttaaaaaatcgtcccctgatgaaaataagctggtataaccagttgttttgacaggataattcacatgttggctgtcgtgcctgattattatgtctggattcgtactttatgagcggattagttgaactttcctaaccctccaccgcataattcccggggtggcaatattattgctgttctatttttacgagctaacgaattaaatccctgaggagggatgacaaatgcactcctggaaaaagaaactcgttgtatctcaactagcattagcctgcactttggcaatcgcttctcaggcaaatgctgcaacctataatacctggggctatcacgacaatacttatactgtactggactggggtaacatggatgctccaggttctgatggcaactatgtcacttacagtggttttatttatcataacaacaccaacgctgattatgatcaatccttcaacggtgataccgttaatggcaccatttcaacttattatttaaatcatgactatgtgtcaggttcagataatacggtaaacatcgcaaactcaaatattcatggttccattacctcagaattgccgtttggttattatggtataacccctgcctccaccgacccggacacgggcgactacctgcctcgcacctatgaagggtattctttcaacgacggcacgaccatcgttgatactaactggtacgatggcgatatatttacactgaacgtcgccaattctaccattgacgatgactctgaagcgctttactttacagacatttatctggatggtacgacagggaaatccacgaacgagtctttctatacctcccgcggcgtagccgttaatctggatgtagaaagcaatattaatatgtctgataactcacgcgttgcaggtattgcgttgagccagggggataccaccaatacgaattacggctccgaatatcaccagtgggataacactatcagcgtgaccaattccacagtgacttccggttcgcaaagtccgctggaatcgtatgaggacgataatttcggcgagtttggtggtcatttcggaaactctgaagagccgagtgattacgcaggcaacggcggtgcaaatgacgtagccctgtctttcacagacaacgcggcttcacattactcaatgaagaacaacgtctatttcaatcattctactctgctgggcgatgttgaatttaccagtaactggaatgatgacggcgagtttttctattcaacgggtcatgattctaatggtgacggcattctggacactaacggtggctgggttgacgacgcacagaatgttgatgagctgaacattactctggacaacggcagcaagtgggtaggttcagcaaacatttatgctgacgatattgcgccagcgacaatgtatgatgtggcgactaatagtcttactccgggcgctatcgttgaagccaacgactggggacgcgttgtcagcaatcaggtattccagagcggcgtgtttaatgtaaccttaaataacggttctgaatgggataccgttaatggttctgtcattgatagcctggcagtaaataatagctctcaggtaaacgtaactgactctggtttaacttcagataccatcgtattaaccaacggttcatcaatgaacattggtgaagatggacaggtaaacaccgatcacctgacgattaataccttcagtaccgttgcgctgaatgatgacgtcactcactatggtgattactctctgtacgccaataccatcaccgtaacaaacggcggcgcattagatgttaatgtcgatcagtatgacaacggcgtcttcagcaccgataaactggaactgaccagcggtaacgttgcggataaccatggtgatgtggtgtccggtgtgttcaatatccacagcagcgattatgtactgaatgcggatctggtcaacgaccgtacctgggataaaacgcaggctaactacggttacggtactatcgccatgaattctgatggtcacctgaccgttaacggtaacggcgatatcaataatggcgatgaactggataacagctccattgacaacgtcattgctgcgaccggtaactataaagtgcgtatcgataacgccaccggtgccggttctgttgccgaatacaaagataaagaacttatctacattaacgaccagaacagtaacgctaccttctccgctgccaacaaagccgacctgggggcttacacctatcaggctgagcagaacggcaataccgttatcctcaagcagaaagagctgaccgattacgccaacatggcgctgagcattccgtctgccaataccaatatctggaaccttgagcaggacacgttaggcgctcgcctgaccaatggccgccatggtctgaccgataacggcggggcatgggtaagctactttggcggcagctacaacggcgataacggcaccattgcttacgatcaggatgccagcggtatcatggtgggtgttgactccctggttgaaggaaacaacgctaaatggaccatcggtgctgcggcgggcttcgcaaaaggcgacatcagcgacagaacgggtcaggttgatcaggacagtcagtctgcctggttgtattcttccgctcgctttgccaacgatgtcttcctggatggttcattaagttacaaccgtttcaataatgacctgtcagccactatgagcaacggccagtatgttgatggtgattcttcaacagacgcctggggcttcggtctgaaaatgggttatgactttaagttcgataacaccggttatctgacgccttatgccagcatcaatggtctgttccagtcgggcgatgactatcagctgagcaacgacatgcgtatggacggtcagtcttatgacagcctgcgttatgaactgggcttcgatgcgggttacaccttcaattacggtgccgaccaggcgctgaccccgtacttcaaactggcgtgggtgtatgacgacgccgacaacagtgcagaaattaataacgacgacatcgacaatggtgttgaaggttcagcggttcgtgttggactgggtacccagtttagctttaccaaaaacttcagcgcttacagcgatgcaacctacctgggcggcggcgacgttgagcaggattggggcgcgaatgttggtgtgaaatatacctggtaagaacagtatcgtttttgttcacctgttgtgtaataaagcccgccaggcaactggcgggtttatcagcaaggaaagacagtaaaaatgatcaacagccaaccggtagacgagtttcatcgtctgaatcatcggttaatgccttcaggaacgccctttgaatatgcccagggcagcgttatcgttccggaagagagtaatgaactgcgtacttacgttttccttgaaggggcaatttctttagaacgtcagaataatcggttgctgcttggcgtcgtggccgcaccggggatttttgggctcggtatcggcgcaatgccgacgcaggaacactatcatctgcatgttgaaacatcctgtcgcggctatcatcttcctgccagtaccacgttacaacttctggataaacatcagctttggcgggacgccttctactggatgacctggcaaaaccgggcgctggaagcgcgcgaccagcaactgattggcaccagctcctatgcgcaaatacgtgcaacgctactgacgatggcgaaatgggatgatgctttgcgcgcccgtataggcgttatgacctatatccagcggcgcacgctgatttcacgttcggtcattgcagaggtgctggcggcactgaggcagggtgattatattcgcatggagaagggcaagctggtctgcattaaccgcctgcccctggattactgaacgtgcgcagcggctcaggatgccgggatcacttccggcttatggccactcagctcactgaccaggtcgtttacgccgtcgctcatatttacaaaacgcgtcagcggtgaacgggtgaccacaacaaaaacgccgacattgtttttcggcaccatcgccatataggtaataaaaccgccgccaccgccggttttttgaatgatcccaggacggccatttttaggcgacatgtacacccagccaagaccgagcgcatcagccttgccggggacgtccattccgatcactcgcgtaagctgcgtgcgctgatagatcagcgtctgcatccgatcggcctgattattacgcgcataaaaatcggaggagaggaactgctgcatccagcgcatcatatcgcccggcgtcgagtacacgccgccgctgcctatggccgccagagtgttattgcagggactcgcgcctttctccgccaccatcaaccgcttgcactgatccggcgacggcgtaaaagtggtgtctttcatacccagcggacgggtaatttgctcttcgaaaagctgcggataaggtttgcctgctgcggtggacaacgcatccgccagcagatcaaaagccaggtttgaataggctgcctgcgctcccggcgcggttttcagcttagcggtagaaagccagttccagcgctgctcgcgtgttggccagacaaataccggacgatgcgccgcgccgcccggctgttcgcgcggtaacgcgctggtatgggtggcaaggttaaccagcgtaataggcgtgccgttataagtcggaacacgtgcgcctggcggggcatacttgctcaggggatcgttaagtttaaccacgccctgatccagcagtttcaccagcatctcgctggtcatcagcttggaaatcgaagcgatgcggatcacggaatcaagctgcggatggacgttgctgcccggtcgggtttcaccaaaacttcgaaacacccgctggttaccatcgatcaccaccatcgccatgccggtggcgccgctaccgtaataaatatggtttgcgtagcgatcgacaacatcagaggcaaattccggatcgagcgagggttgcgcggcattggccgacgagaagctcagcacgcccagcatcacggataaaagcagacaacgtttcaacaaagtatccatcaaagaattaagaagattatgcgtatttatactatttagctgcccgatgcaaagcccggaaaagggcattattcgcggttaaaacgtaacgatgcgtaaacagacgggttttcttgccctttaatgtctgcttctgtgacgccagccttatggtaacctcctaaacttcggcaattttctcaggggcaaagcgatgtcagccaaacgggtagtcatgattgtggatatgcagaacggtgttttcgccactccgcgcttgcagcgtgagcagtgcgtcatgcgtattaaccaactgacacaagccgcagacagggtgatttttatccagcactgcgaagagggtggtctggaagccggcagcgaaggcttcgcattattacccgaacttgttcagccagaacgggcgaactatgtgacgaaaaccgcctgcgatgctttttataaaaccgaactggcgcagctgctggaagataacggcattagcgaatttgtgatttgcggctgtgcgacagattactgcgtcgataccacgatcaaagccggggccagccgcggttacgcgatcacagtggcagaggatgctcacaccacagcgaatcgcgccgcggtcgacgcggcgtcgctgattgctcaccacaatgaggtctggcgcacgctgatcatgcccggcaatccggtgcaggtgaaatccacagaaacaattcttggcgagtggcaggcgaactaagccaccgccggttggtctgaaaggcggatttcatccgttaagcacgttgttcgctataaaaatgagaagcttcaggagcagatatgtttaagtcttttttcccaaagccgggaccattctttttgtcggcatttatttgggcgctgattgccgtaattttctggcaggcaggcgggggcgactggctacaacacattgccggtgcgtctgatgacgtcccgattggcgctgcgcgcttctggtcgggcggctatctggtcttttacgcttactacgccctctgcgtggggatttttgcgctgttctggtataaagccgcgccgcatcgctggcagaactggtcgattctgggcacggcactgatcatcttcgtcacctggtttatggtgcaggtgagcgtggcgattaacgcctggtacgcgcctttttacgatctgatccagaccgcgctcagcgcgccgcacaaagttaccctgggccagttctatcgcgaaatcggcgtcttcctgggtatcgcgctgatcgcggtgctggtggcggtgctgaataacttcttcgtcagccactatgtgttccgctggcgcacggcgatgaacgaatattacatggcgcactggcagcgtttacgccatatcgaaggggccgcgcagcgtgtgcaggaagacaccatgcgcttctccagcacgctggaagacatgggcgtcagtttcctcaacgccattatgaagctgatcgctttcctgccgattctggtgacgctgtcggcgcacgtgccggagctccccattatcgggcatatcccctatggtctggtggtggcggctatcctctggtcgctggtgggcaccggcctgctggcggtggtgggtatcaaattgccggggctggagtttaaaaatcagcgcgtggaagcggcctaccgtaaagagctggtgtatggcgaggacgatccggagcgtgccgatccgcctaccgtacgcgagctgtttgccgcggtgcgccgtaactatttccgcctctattttcactatatgtacttcaatatcgcgcgtattttttacctgcaaatcgataacgttttcggccttttcctgctgttcccgtcgattgttgccggtaccatcacgctcggactgatgacgcagatcaccaacgtatttgaccaggtgcgcagctccttccagtatctgatcaactcctggacaacgctggtggaactaatgtctatctacaagcgtttgcgtaccttcgagcgcaccctcgataacgaggaaaccccggacgttgtcaccacactgagctgatacagggaaagagtatgtctttgatcgcaccacgttttatcccgattctggccggtcttatcctcgccggatgtagcacagagcgtgcgacgccgctaaaagagggggagaaggcggttgatgtggcaggcgtggtgcgggcgaaaatgcccgccagcgtgaaagatcgcgacgcatgggcgaaggacctggcaaccacctttgaaagccagtcgctggcaccgacgctggaaaatatctgctcggtgctggcggtggcgcagcaggagtctaactatcaggccgatcccccggtgccggggctgagcaaaatcgcctggcaggagatcgacaagcgcgccgcgcggctgcacattccctcgtttgttgtgcacaccgcgctgaaaatcaactccaccacaggcaaaagctacagcgagcgtcttgataacgtgaagaccgaaaagcagctcagcgcgattttcgacgatcttattgaccgcgtgccgctgggtcagacgctctttggttcgctgaatccggtgcacaccggcgggccgatgcaggtgagcatcgactttgctgaaaagcatgccagcggttacccgtggaagatggacggctcagtgcgccaggaagtgttcacccgccgcggcggtctgtggttcgggacttatcacctgcttaactatcccgccagttactccgcgccgctttaccgtttcgccgattttaatgccggatggtacgccagccgcaatgccgcgttccagaatgcggtcagcaaagccagcggcgtgaagctggcgctggatggcgatctgatccgttacgatacgcgcgaaccgggtaaaaccgagctggcagtgcgtaagcttgcgggaaaactggatatgagcgagcgtgaaattcgtcagcaactggagaagggcgacagtctggcgtttgaaaagaccgcgctctatcgtgaagtgtatcgtttagcagagcagaaaagcgggaaagcgcagccgaaagagatgttgcccggcattcagctggaaagcccgaaaatcacccgcaacctgacgaccgcctggtttgctaagcgtgtggacgatcgtcgggcgcgctgcatgggacagaaataaaaggcttagtcgtaacgccgccagcgcagcagcagggcaatgacgccaagaatggcgctaccgatgaggaaggggaccagaccaaaaatggtccctacgcccagccccatttcaacgtgcggccggtttacatcctgcatctgcatcagatgttcaaacacgccaggcgcatgcaccagcaggtttaacagttgcgcaccggcccagaagcagagcagtacaaatacggcatacgcaatgttacccggggtggaggcgtcacgcttttttcctttccgatccgaaaagggtttcgacaaagtaaagtctgccatatcgacctccgctactcatgatgaacgtcggctaaaagccggtgatactgagtttattttgacaggacatcgtgattgtcaatatcagattggtgacaaattgcaccgtaacgcggggaagaataatcaatttttgctgacactcacatttttgtaacatatatatttattcattaacatttaagattttccgcatgccgcacagacgtgcaggcgcaaatatgcgaggatatttttttagcctgcggagttgttatgaaactgcctgagaaaattcgccgtgactggcattattatgcgtttgccattggtttgatcttcattcttaacggcgtggtgggactactgggatttgaggcgcagggctggcagacgtatgccgtcgggctggtgacctgggtgatcagcttctggctggcggggctgattattcgccgccgccccgcagaagacgagacggcggcgaaaacgccggattaattcatggtgcttttcagcgcgctgtcggcctgatggcgcgctaacgccagatcgatcagacggctaatcagctccgtataaccgataccgcttgcctgccacagcttgggatacatactgatattggtgaatcctggcagcgtgttgatttcattaataattacgtcattatcagccgtgagaaacacgtccacgcgcgccatcccggcgcagcccagcgtctgatatgcctgtaccgcaatattacggatcgcgtcattgaccgccggatcgatatccgccgggaccaccacccgcgcgccgttatcatcaatgtacttggtatcgtaagcgtaaaactcactgttaagcacgatttcgccgcaggtgctggcttcaggctcgtcgttacccagcacggcgcattcgatttcgcgaccgacaatgcctttttccaccacgactttatgatcgaattcgaaggccagacgcaccgccgcctcatactgcgcttcagtggtcactttactgacgccaacggacgacccctggtttgccggtttaacaaacagcggcaggccgagcgtcgaggtcatctcagcgaaagaatagcgctggcggtttgcccgcgtcagggtgataaagggggcgatattcagtccggcatcgcgcagcaagcgcttggtgacgtctttatccatacaggcggcggatccgagcacgtctgagccgacaaacggcaggttagccatgcgcagcataccctgcaaagaaccgtcttcccccagcgtgccgtgcacaatcgggaaaatcacgtcaatgtgcggcagcggctcgccattgtcggcgttaatcagcggctgttccgcctggcctgggatctgcgccaggcgggttgcggaaggattgagcgcaatgcgcgccggatcatgggcattcagcaggtaattttctgcatcattaacgtgccactgtccctgcttatcaatacccagtaacaccacctcgaagcggtttttgtccatcgcttccacgatgtttttcgccgactgcaatgagacttcatgctccgccgatttaccgccaaacaccacgcctacccgcaacttcttcatcaccacatccactcattaacgtcatgaaagtctctaccttaccacgtcaaaacggcggattcccggccttctgatataatgtttcttcagcctgaaaggagaacgcgtgaaaggaaaaagcctgattgttgtcgcggttcttttgggggcgggcgtgatggcgtatcgccatctgccctcctggtataacccctttacgccgctgcgcttaagcgatccgcccggcgtcattacccagtttaagctgcgacgcttgccgcctgagcagtgcgccgccttgctggcagaggccaatcagcaggggctgatcaccacgcggtcggtcgccaaaaccaccggcagctgtccgctcaccaacgcggtgcgggtgcgcgattttggcccggtaaagctcagcagcagttttctggcctcatgtccgcttgcgttaagctcggcgctgtttgtcgatcaacaggcgcgtcctttgacgcagcagtttatgggtagcgcgctggtgcgcatcgaccatttcggcagctatgcctgccgtaatatttatcaccgcgagaacgcgcgcctgagcgaacacgccacggcggatgcgctggatatcagcgggtttcgtctcgcctccggtcagcaagtcagcgtactgcgtggctggaaagtggataaaacccagccctggcttcaggcgatgctcagtgccagctgcgactattacggcaacgggctgggcccggagtacaatgcggcccacgcaaatcattttcaccttggcatgcgcggctacggcctgtgccgctaatgggtgatctacacaagaaagacaacctgttatggaagcctggaaagtaaatcttatctccgtctggttcggctgttttttcaccggcctggcgatcagtcagatcctgccttttctgccgctatatgtggcgcagctcggcgtcacttcacatgaagcgctgtcaatgtggtcggggctgaccttcagcattacctttctggtgtcggccattgtttcgccgatgtggggcagcctcgcggatcgcaagggccgcaagctgatgctgctgcgcgcctcgctgggcatggccatcgccattctgttgcaggcctttgccactaacgtctggcagctcctgttgctgcgcggcatcatggggctgacctccggctacattcccaacgcgatggcgctggtcgcctcgcaggtgccccgcgagcgcagcggctgggcgctcagcaccctgtccacggcgcaaatcagcggcgtgatcggcggcccgttgatgggcggctttctggcggatcatgttggtctgcgggcggtatttttcattaccgctatcctgctggtggtcagttttctggtcacgctgttcctgatcaaagaaggcgtacggccgaaaatcagcaaagcgcagcgtttgtccggcaaagcggtatttgcctcgctgccttatccgcggctggtgatcagcctgttcgtcacgaccatggtcatccagttgtgtaatggatccgtggggccggtgctggcgctgtttattcagtcgctgtcgccggacagcactaatattgcctttcttagcggtatgatcgccgccattccgggcgtatcggcgctgatctccgcgccccggctcggtaagcttggcgatcgcatcggtaccgcccgcattctgatggcgacgctcatctgcgccgtcgggctgttcttcgctatgtcttttgtcacctcaccgctgcaattaggcatcctgcgttttctgcttggctttgtggatggcgccatgctgccggcagtgcagacgttgctgctaaaatactccagcgatcaggtcaccggacgcattttcggctacaaccagtcgtttatgtatctgggcaacgtcgccggtccgctgatgggcgcgaccgtctccgcgatggccggattccgctgggtgttcgccgctacagccgtagtggttttgcttaacgtctggcaactggcggcagaactcaggcgcacccgccttcgcattgataaaaaataagtaagcagacttaaactattatttaacggagcttaatgctccgtcagtctgttgttttgcctgcacactttggccagcattgctgtatttacagcccggcaaagccaaaataattcgcggtcataaaaaagcattaatcatttgaaaaaaataatacctgaagctactttgcaattatcagatctggtgctaacgtcagcgaaaatcacataaggaaatagcgctatgaaaaacctcatcgcagagttgttggttaagcttgctgaaaaggaggaagagtctaaggagctggtcgcgcaggtcgaggcgctggaaattgtggtgacggcactgctgcgccacatggccgcgccggaacagaatgcgctgatccagagtatcgaaggcgcgctggaagcggcccgcccggatgccgaggtctcggaaaaggattctgaactgttgcagcaatacgtaaaaaagcttctcaggcatccccgcagttaaattactgaatgggaatgccagcgatcgcgctttttatttcttttattgccctgcctgtctttgctggcagaaaatagtctacaacccccctccgttcatttgccgcctgattgcgcaaatgaacggagggtggtttttttttcgtaacgcgccatgcttaaagagaaacttgttctgaggatggtgatatgaaaataacattcctggtaaccctgctgtttggcatgctttttatgatggcagtcagcgcggctgaaaaagatctgacgccgcaacagcaacgtatgaccatttgtaatcaacaggccaccgcgtagacgttgaaaggcgacgcccgcaaaagttatatgagcgattgcctgaaaaatactaaagtagagccgggccagaaaagtctttccccccagcagcaaaaaatgcgcgaatgtaattctcaggcgacccagcaatcgctgaaaggcgaggatcgcagtaagtttatgagcgcctgccttaaaaaataacgctgatacaaacgggtgacgctgcgcggcggctcacccgaaatttcatacttacccgtcgggtcacctgcctataatttttggaaatgtttcagaatgttcccaaaaattatgaatgataacaatttttatacttctgcgccgtcgcgtcctgacggcgacagcttgcacagtcaggacgaactttaccgggccgggcagcagtttgtccgccgcgccaggatgccgcgcgtggcgggtgtgggtggcctctatttcccgctggcaggcgttatggtgacgcagtccctccccgggggctggtggatggcgttgctgtgctgggcgtttatctggccgcattttgcctggcaaagggcagtgcgtgccagcgagccgaagcgtgcggaactggccaacctgaagacggatgccattcttgccggtatgtggatcgccattattggcgtgaacgtcatgcctactgcggcgctggtgatgatgatcggcgtgaatttaatgggcgcaggtggaccgaaattatgcggcatggggttagttctgctgctggtaacctgtctggtcacgctgcaaatcaccggtattgccgtggtgctgaccagtacgccgctggaagggtggttgtcgatcccctttctggtgatctatccgatgctgttcgcgtgggggagttacaaaacggcgaaccggctcgccgcgcagaaacgtcgtctgaaggtgatgagcacccgcgatggcatgaccggcgtttacaaccgccgctactgggagatcctgctgcgtaacgaatacgataattgtcgccgccaccagttggcttccacggtactgcttatcgacctcgaccatttcaaaatcatcaatgacacctgcggccatgacattggcgatgaagccatcattgctctgacgcaccatctgcaaatgagtctgcgcggcggcgatgtgattgggcgctttggcggcgatgaattcgcggtgatcatgaacggcaccagcccggaaagcgccgctgccgccatgagtcgcgtccatgccaggcttgcgaccttccgcctgacctccgctccgcacgtcaccctgcacatcagcgtgggcgttgcgcccttaaccgccgatatgctgcactaccgcgaatggctaaaggccgctgatatggcgctgtacaaagccaaaaacgccggacgcaaccgtaccgaaatcgccgcctgaactcaggctttgctgagcttctctgatttttccatgcatttgttcatcgcttcgatcaccgccgagcggaaaccgcgatcttccagcaccctgaccgcctcgatagtggtgccgccaggtgagcacaccatgtctttcagttcacccggatgtttaccggtttccagcaccatttttgccgagcccatcaccgcctgcgccgcaaacttataggcctgggcgcgcggcataccgccgagcaccgctgcatcggccatggcttcgataaacataaacacataggccggggcggagccgctgacgccgacgaccggatggatcatcggttcggcgatcacttccgcttcaccgaagcagcggaaaatattcaccacatccgcaatatcttccggcgtcaccagcgcgttaggggtgatcgaggtcatgccggcattcaccagcgcaggggtgttaggcatggtacgcacgattttgcgatcgtggccgagggcacgcgccagctgatccagcgtcacgcctgcggcgatagagacaatcagcgtatctttattaaggctggaagtgatttcactcagcactttgatcatgacgttaggtttcaccgcgccaaacacaatatcggcgacctgcgccacttcctgcgcgctggcggcggcattgatgccgtattgatcgtgcagcgcagcgactttatcaggggagggggtgtacacccaaatctggcccggcagtacctggccgctggcgatcaaaccgccgaggatcgctttacccatgttgccgcagccgataaaaccaatttttttgtccatcacgtcactccctggttttttattgattgggtttatagcttaacgtggatccgcgcacagggctaaagcttccttgtagtctttgcgggcagagacgattcaggcgagaataaggcgtaatcgtttatcaggagtcaatatggtgatttgggtggatgccgatgcgtgtccgaacgtaatcaaagaagtattatttcgcgccgctgagcgcacgcaaaccccgctgacgctggtggcgaatcagtcgctgcgcgtgccgccgtcacgctttatccgtaccctgcgggtggaggcgggcttcgacgtggcagataacgaaatcgtgcggctgtgcaatcccggcgatctggtgatcaccgctgacattccgctggcggcggaagtgatcgctaaaggcggtgcagcgctgaacccgcgcggcgaacgctataccgaagccaccattcgtgaacgcctgacgatgcgtgattttatggataccctgcgcgccagcggcgtacagaccggcgggccggattcgctctctcagcgcgatcgtcagcactttgccgccgaactggataaatggctgctggaggttaagcgccgccgggaaagcaatcagggcagctgaaagcttgtcaacggacgacgcattcagtaaggtgggcgtgccattttatctttacactttaaagtgcatttttctcgctaaaatcaatgttaccgctgttttaaatttctctgtaattatttatttacacttgctggcagcagataatcatttttgtttcatcatatctcgttctgcaatgggcggaaccagggggatcaccaggtcatgacgttacccatctttctaactggcgcacgcggttgcggaaaaaccaccatcggcgttcagctcgcccgggtccgcgactgccagtttgtcgataccgatcgcgtattacaggatcaggcgcaaatgaccgtcgccagtatcgttgaaaaagagggctggtcaggatttcgcgcacgggaaaccgccaccctgcaaagcgtcaccgcgccatcgacagtgatcgccaccggtggcgggattatcctcagcgaatttaaccgtcagtttatgcgcgaacagggcatagtgatttatctctgcgccccggtggacgtactggcgcagcgccttgaagccacgccgaaagccacccagcgtccgacgctgaccggtaaacccatcagcgaagaagtgagcgatattctggccgagcgcgatgcgctttatcgcgaggcggcgcactatgtggttgatggcgctcaggatccggaaagcgtcgtggaagaaatccagacggtattattactggcgcgcgcaagctaaacctgatgcgctacctttggctatactccaggtacgactgataaaaactgataaaaaaggaagtgctatgccgacaagaccgccgtacccaagagaagcgcgtatcgtgaccgttgaaaaaggaaaccaggaagaaaccgtgacctggtatcaattacgatccgatcaccctaagcccgattcgctgatcagcgagcataataccgagcaggaagcgctggatgccaagcgccgctacgaagatcctgataaatcctgatccctttcccccgcgccgcgggggaaattttataaacctttcgggaaataacagacgtttatgtaagcgtttacaaaaatagtcacgctccggtcatatctgctgctacgcttttttctgcgacgatcattgccggttttactcccgccctctggcgtgagcaattgtcagtcctgaataactgaagtgaagaaggcggaaagaaccatgagtgcgactctggccatcctcaccattggtgtggtgcccctcaatgctgtgctgccgctcttaactgagcacattgctgaagatcagatcacccacgttagtttgatgggcaagatggatcctgaagatgcccttgaagattacgccgccgcgccgggcgaggacgagatccgcgcactgctgaacaatggcgaggtggtaaaagtctcgcgccagaaggtgaagcgcgatctgcaaagcgtcatcgaactgctcgataagcagggctatgatgtcatcctgctaatgtataacgataaaatcgaagggctgaaatcccgcaacgctattttgctggagccgcaacgcattattccgccgctggtcgcctccattattgatggtcatcaggtgggcgtgctggtgccgatggcagagatgcttggcgaacagcagcaaaaatggcaggcgctttcaaacgagccgctgtacgccattgccagtccacaggacactatcggctcgcagctggtggacgcaggtagaacgctcatcgatcagggcgctgacgtgctgatgctcgactgcctcggttttcaccaggcgcaccgcgatctgctgcaaaaatccctcgacgttcccgttctgctctctaacgtgctggtcgcccgtcttgcctctgagctgctgatgtaacagcgattttacgtgacagccataaagcctggcccctatagtggatttccatacactacacagataagggccagtctatgcttcagagtaatgaatacttttccggtaaagtgaaatccattggttttaccagcagcagcactggccgtgccagcgtcggcgtcatggcggaaggcgaatacaccttcggaaccgcccagccggaagaaatgacggtggtcagcggcgcgttaaacgtgctgctgccgggagaaacggagtggaaaacctatgcggcgggggaagtgttcaatgtgcccggccacagcgaattccatttacaggtggccgagccgagcgcttatctttgccgctatctgtaatgcagcgatctgtcccctcaggcgagggggcagatcgacaggatcagcgctgcgcttcgccgcctaatccttccaccagattctgaattaacgccgccagttccccggtcatcaggataaagtcagcatcaaagcgctgggcataatcctcgcgatcaatgtcttcattctgatcgcgcagctcatcggaaaacttcaggcgtttgatcgagccatcgtcgcacatcataaactgaatacgctgctgccagtcgagcgcaagcttagtgaccagctttccggcttcaatatgcacggcgatttcatcgcagacgagatcctgctttttacagcggatcacgccgccatcttcaaggatcgctttcagttcggcttcatcctgcaactggaatccctgcgccgcgctgccggagcgtacccattcggtcagcgtcagttcaattggattttccagcgtcagcggcaccaccggcagggagccgaggcttttacgcagcagcgccagcgtatcttccgcttttttggcgctggcgcagtccaccatgatcaggccgttaaccgtatcgatccacatcatcgtctggctgaagcggctgaaggcgcgcggcagcagcgaatgcagcacttcatctttcagcgaatctttttcggtcttcttcagcttgcggccctgatcggcttcaagtttggcaattttggcttccagcgcctgtttgatcaccggcgacggcaggatcttttcttctttgcgggcgcaaatgatgatctggccattattggtatgggtcagtgcatcactgtgcgaacccatcggcggcacccaaccggttttcgccatatcctggctaccgcaaggtgtaaaggttagcgcggctaactgtttttccatctcttcagcgcgcaatgaaacatcgcggctaagacggtaaaccatcaaatttttgaaccacagcatgataattttcacggccttgtcgttaaatgcagcgggcatgataacgaattgtcactttcgatgcattgctaatacggggcagggatcctactctgttgatattccgcgaaaaacaaggagatttccgtgcgtataggaattgatttaggtggtacgaaaacagaagtgattgcgctcagcgacagcggcgaacagctgttccgccaccgtctgccgacgccaaaaaacgactacggacagacgattgaaaccgttgccacgctggttgagctggccgaaaaggagaccgggcaaaccggcaccgtcggcatggggatccccggctccatttcgccctataccggggtggtaaaaaacgccaattccacctggcttaacggtcagcccttcgataaagatctcagcaagcggcttaaccgtgaagtacggctggcgaacgacgccaactgcctggcggtatccgaagccgtcgatggcgcagcggcgggggcgcaaaccgtcttcgcggtgatcatcggcaccggctgcggttccggcatcgccctaaatggccatgcgcatattggcggcaacggcaccgcaggcgagtggggccacaacccgctgccgtggatggacgaggacgaactgcgctatcgcgatgaagtgccgtgctactgcggtaaacagggctgtatcgagacctttatttccggcaccggttttgccaccgattaccaccgcttaagcgggcagtcgctgaaaggcaatgagattatccggctggtgggcgagcaggatccgatcgctgaactggcgctgagccgctacgaactgcggctggcgaaatcactggcccatgtgataaacattctggatccggacgtgatcgtgctgggcggcggcatgagcaacgtcgatcgtctgtacaaaaccgtgccaacgctggtgaaaaactgggtattcggcggtgaatgcgaaacgccgatccgcaaagcggtacacggcgattccagcggcgtgcgcggcgcggcctggctgtggccgcaaaattaatcattgcacggcagccgccccatgacctttcaggcggctgtacaacaccagtgagatcatggccgataacgacagcaaggctgccggtaaggccacatattcatacgtcagcccggcggtcagcatcatcccgccgcaaaacgcccctaccgcgctgcccagattaaaggccatttgtccacccgccgctcccagcatttcaccgcctctggcgttttgcagcagcaggatttgcagcggcgcagacagggcaaaaagtccggcgcagctgataaaggccaggctcagggacgcggttttgttccacgcgaagaagaagatcagcgccagcgcaatggcaatcaccagatcggtcgtcatggcgatgcgcagcggcgtaaaccagcgcgacagcttgccgctcagcatattacccagcaccattcccagtcccaccagcatcatgatcgccggcatggtggtttctgcgtagccggagacgaagatcatcagcggtttgatatagctgaaccaggcgaaaaccccggcgttgccgaacagggtggcggcaaaaatcagccagggcgcaggggatttgaggaagcggaactgcgcggagagggtggttttggcctcgtcagcgatatccgggatccacatcaggatcgacaccatcaccgcaatgttaaaggccgcaatcagccagaaggtatagcgccagctgaattcatggctcagccaggtgccaatcggcacgccgatcagattggcaatggtcatgccggagatcatccctgcgacggcggcggtgacgcgtccgggctgcgcgactttggtgagaatgatcgccccgacgccaaaaaacgcgccgtggggaaaaccggacaccagtctgccaatcgccagcattacataggacgaggagagggtgaaaatcacgttgcccgccagacacagcagcgccagaaacaccatgatatgtttcagcgaaaagcggttagagaacagggcgatgatcggcgcgcccagcaccacccccagcgcataccaggagatcatatggcccgcggcgggaatgctgatctgcacatccttcgccagctccgtcagcacgcccataatgccgaactctgccattcccagcccgaacgtcccgagcgccagcgaaacaatcacttttttgatactacccgacacggcaatcatccttaagaaaaacccccgcccggctggacgaggggaaacgccttattctacggcccaggctttatccagcttgctgtaacccagcccgttaattttacgtactttgatctgcaccgggatgcgctctttcatcgcctcgacgtggcttatcacgccgatggttttgccggtggcgttaagggcgtctagcgcatccagcgcggtgtccagcgtttcgctgtccagcgtgccgaacccttcatcaaggaacagcgaatcaatacgcgttttatggctaaccaggtccgacagcgccagcgccagtgccaggctgacgaggaaactctctccgccggacagggtacgggtatcgcgcaccgcgtccgcctgccaggtatccaccacttccagctccagcgcttcgctggccttgcgcttgagcaggtatcgcccgtgcaggcgggtgagctgattattcgccagccacaccagattatcgagcgtcagcccctgggcgaatttacggaatttatcgccttctttcgagccgatcagcgcattgagatacgcccagtcttccacatattccgcattttgctggatgctctgcatcagcgctaactgccgctggcggttttcggcgtcctgtttcagctgctggcggatctcgccctggcgggtggtgttttcccgcagctgctgtgccactgctgaaagctgcgcgaccagcgcgtcgatttcggcgtcgtccgccagcgtcggtggacgggacgccagatgctgcgccagcgcgctttcggcctggctatagagcgtgctttgctgctgatgcgcccgctcaagctgctgctgacgctgctccagcgcctgccgctgcgcatcgtccagcagcgcgcccaggaaagcggcctcgtccgcaaaaggactggcggccagcgccgcgctgaactgtgagcgcgcctgttcctgctgtctgtcgagctggcgtatctgctcctgcaacaggcgcagctggccttccagcgtactggcctcgctgtaaagcgtctgccagttgcccagcgcggcggcgtgttgctgctccggcaggggcggcggcgtggtgccgtcatcggcgagcgttgccagcaggctgtcgaggcggctcagttgttcccgcagctgtggcagtttgtcatgctgctgctgccagcgctgcgactcttcctgccgcgccgccagccaggccgcttcgtcgctcaccgccgggcgcgtcaggcccagctgtgccagcgcggtgtccagcgcatcgcgctgccgggcgatctccgccgccagctgcgcatcccgctgctgctctttatgcagccttgcttccagggttaagcgttcattcagctggcgcagctgctgctcatgctgatcctgctccgccagccagccgctcacgtcgtcctgcggcgtcagcgcgatgttcagcgccgcgcactgctgctgccagcgggcgtgaagcgtggcgctttcctcctgaatcgcggtaagagccgcggcgagtttgtcccggtgctgacgctgggtatccagctggcctttcagggcaaaaccctgttcgcgcaggctttccacctcttttttcagcgccgccagccgctgctgattttcgcccggctgcaatgcctgataggccgccacggcaggatgcgacgtggatccgcacagcgggcagggcgtatccggttgcaggttcgcgcgttccgcttcgaggcgcaggatcagcttttcctgctccaccagcttttccacatcgctttcatgctggcgcttgtctttatattgctgacgaatagccccaagccgcagatcccaggccgcgatctgcgtgtccatctccgccagttcctgctgctgttgcgcctgacgttttgccagcgcagcaaactgcgggtgcagcatcgccagctgttgacgcccgctgcggcccgctaagtgctgttgtaaatgagcgcttacttcttccagattcagattcagcggggaaggcggcagggcggcgagcgcctgttctgttgtacggagtgtattttgcagctccgcccgctgtttttcatcccgctgctgctgggcaaaggtcagacgccagcccgccagttccgcgctccataagcgaaaacgatcgttttcgctgagccactgctgcacctgcgccacatcgtttttcagggtggtagcggtgatattcgccagttgccaggtctgttgcagcccggtgcgcacctgttgtaagcgagtattcacattttcgtgctggccctgcgcgtggcgcaacgcctgctggcgttcctgtaactgctgccagtggggacgtaatttttccgcaggcagggcgcgggtcagcttttccagttccggggcggcggcctgtaatgccgcatgcgcggcggtcagcgcctcctgcgcccgctggcgttcgccgctcagccggtggctttcactcagccactgatgatgtccctgcgcctgctgctgcccggcgagcagctgtttttcttcgtcagtaagtgcctgcaaacctgcgctgagcgtctgtgcctgttcgtcgcttaacagctgcacgccgtcggcctgggcctggagtttttccagctccagtcgcgcggttttatgcttttcgaagaccatcgcggagatctgaccgtagatctcggtaccggtcagctcttccagcagttcagcgcgctctcggggtttggcattcaggaaggccgcaaactgaccctgggagagcagcatcgagcgggtgaaacgaccatagtccagcccggtcagggtggcagtcagatccagcttgtctttcactttatcggcaaggattttgccatcggcgcacagcgccagctccacgcgcggggcctgcaaattgccatccggctgattgcgggcgcggttctggctccaaaaagcgcggtaagccacgcctttgacctcaaactccacttccgccagacattcagcggtatcgcgggtcatcagatcgttttgcgactgggagacgctgctcagacgcggcgtttcgtgatacagcgccagacagatggcgtcgagcagggtggttttgcccgcccccgtcggcccggtgatggcaaacagcccattactggcgaacggctcggcggtgaaatcgattttccattcccctttcagggagttgatatttttcaggcgcagactgaggatcttcatgcgtcgtcttcctccgtcagggcgtcaacggtttgcgcgaacagcgtctgtaaacgcgcgttttgcgcctcgtcgaggctttccagcgccagccgccgctcaaagacttcttccaccttcagttcgctcagggtttcgcgcagttcgcccgccagcagacgttcgcgctgctcccggctgcggcgcaccagcaacacttccaccggcagatccccggtaagcgcctggattttccgttgcgcgtcggccaggtattcgtcggtggtgatttcaatatccagccacaccggcgggctgaccggctggtcgcgccattgctcaagctgttcgccgatagccgccagatcgcctttgatcaccgccagttgctgggtaaccggcaccgtcagcggcgtcacctccgtcagcctgccgtcgctgaaagtcaccagattgacgcttttgggcctgccggtttcatcaaaacttaacgcgatgggggagccgcaataacggatatgttcctgaccgcccaccagctgcgggcgatgaatatggccgagagcaagataatccaccggcgggaagttctgcgccggaaaggcgtccagcgtgccgatataaatgtcacgcaccgcgtcacttttgctggctccgacggtggtcagatggccgctggcaataaccggcagcctctgctccccgcgcagggcgcaggcgtcttcatactgctgctggtaatacgctgtgatgctggtcagcaaaagctgttgtttctgactgccggataacccggcctggcttagcacgatgtcgcgcgggcgtaaaaacggcaccgggcagaacaccgcgcccggcgtgccgtcacggcgtttgagcataaagggcgcgctgcccgcggtggcgaccacggtggtgtttaaaaaggcgagaatttcgcgggattcgttgagcgtggcgacggaatcgtggttacccgccagcaccaccaggtgacagccggtttgctgtagattcaccacaaagcggttatagagttcgcgggcatagctcggcggcgagccggtatcaaaaatgtcgcctgcgacaataatcacatccacctgctgttcttccgcggttttcagcagccagtcaagaaaggcggcatgttcagcggcccggcttttgctgtaaaagttttgacccaggtgccagtcagaggtatgaagaagacgcataacgatcccatggcaaaaaagcgtgaagccgattataaacgttaagcggcgtgaagatagttatcggttttttcacgagtgtcataaaacaacggcttgagtcatcaggcagtcatcattttcataaatctgtcataaatctgacgcataatgccaccgcaacatatactggcgacttaataaatacagggcaaattatggcgagacgcattctggtcgtggaagatgaagctccaattcgtgaaatggtatgctttgtcctcgagcaaaacggcttccagcctgtcgaagcggaagattatgacagcgcggtgaaccagttgaatgaaccctggcccgatctcattttgctcgactggatgctaccgggcggttccggtattcagtttatcaaacatgtgaagcgtgaagccctgacccgtgatattccggtgatgatgcttaccgcccgcggcgaggaagaagatcgcgtacgtggtctggaaaccggggcggatgattacatcaccaagccgttctcgccaaaagagctggtggcgcgtattaaagccgtgatgcgccgcatctcgccgatggcggtggaagaggtgatcgaaatgcaggggttaagcctggatcccacttcccaccgcgtgatgaccggcgaaaatccccttgatatggggcctaccgaatttaagcttttacacttctttatgacccatccggagcgtgtctacagccgtgaacagttgctgaaccatgtgtggggcaccaacgtttacgttgaagatcgcacggttgacgtgcatattcgccgcctgcgtaaagcgctggaacatagcggccacgatcgtatggtacagaccgtccgcggtacgggttatcgtttttcgacccgtttctaacatctgaagggagtgtgacgcgtgctggaacggctgtcatggaaaaggctggtgctggagctggtgctgtgttgcatcccggcgctggtgctcggcgccatatttggttatctgccgtggtttttgctggcggccgtcaccggattactggtctggcatttctggaacttactgcaactctcctggtggctctgggtggacagaagcatgacgccgccgccgggccacggtagctgggagccgctgttatacgggctgcaccagatgcagatgcgtaacaaaaaacgccgtcgcgaactgggcagcctgatcaaacgcttccgcagcggcgcggagtcgctgccggacgccgtggtgcttaccaccgcagaaggcgtgatcttctggtgtaacggtctggcccagcaattgctgggtctgcgctggccggacgataacggccagaacatcctcaacctgctgcgttatcccgaattcacccagtacctgaagcgtcaggaattccttaagccccttaatctggtgctgaataatggccgccatctggaaattcgcgtcatgccctacagcgatcagcaattgctgatggtggcgcgtgatgtcacgcagatgcatcagctggaaggcgcgcgacgtaacttcttcgccaacgtcagccatgaactgcgcacgccattgacggtgttacagggttatctggagatgatgcaggagcagacgctggaaggcgcgccccgtgaaaaagcgctgcatactatgcgcgagcagacctcacgtatggaagggctggtgcgccagctgctgacgctctctaaaattgaagcctcgccggtgcaactgctgaacgaaaccattgatgtgccgatgatgctgcgggtggtggagcgggaagcgcaaaccctcagccagcaaaagcagactattgagttccacatcgacagctcgctgaaagtgctgggcagtgaagatcagctgcgtagcgccatctctaacctggtgtataacgcggtcaaccatacgccccccgccacccatattgtggtgagctggaagcgcgtaccccacggcgcagaattttgcgttgaagataacggaccggggatcgcggccgagcacattccgcgcctgacggagcgtttctaccgggtggataaagcgcgatcccggcagaccggcggcagtgggcttgggctggccatcgttaaacatgcggtcaatcatcacgacagccgcctcaatattaccagcacgccagggcagggcacgcgtttcagttttattctgccggaacgtttgatcgccaaaaacagcgcctgacgccccgactgtcagcttatctttccgcaggccagctaatgctggcctgtttgcgttccggttcacctttttctgaccgattattgtacggctgatgattttttgttcgcatgataagccatgtgtttttcttatacatagcgttttgaactggtaaccatataggtagcagcagatccatctggttttacgatcccgtcttgcctttaaacgttataagcgtttaaattgcgcccctgatactgtcataccgactgtatttgcgtggtaaatcgaaaaactattcttcgccacgtcatgcgggaagcatatcccgctgaaattgagagaaattgccgtcgtattgttccaaaggcactggcgaacatttcatcgtttccaacaccacatccacaggcagcacacgtttatgactcatcgcttaaaaccacgagacatcatggctctgggctttatgactttcgccctctttgtcggcgcaggtaacattatttttccgccaatggtcggtttgcaggcgggtgaacacgtctggacggcggcgttcggctttctgatcaccgccgtaggcctgccggtgctgactgtagtcgcgctggcgaaagtgggcggcggcgtggacagcctcagtatgccgatcggcaaagcggcgggcgtgctgctggccaccgtctgctatctggcggtcgggccgttgtttgcgatcccgcgtaccaccaccgtctcctttgaagtcggtattgccccgctgaccggcgacggcgcgatgccgctgatgatttacagcctcgtctattttgcgctggtgatcctggtatcgctctatccgggcaaactgctggataccgtgggtaacttcctcgcgccgatgaaaatcatcgccctgacggtgctgtccgttgccgcgctcgtctggccggcaggcccgatcagcagcgcgatggatgcctaccagaatgccgcgttctctaacggctttgtgaacggctatctcaccatggatacgctgggcgcgatggtctttggcatcgtcatcgttaacgccgcccgttcgcgcggcgtgacagattcccgtctgctgacccgttacactatctgggctggcctgattgccggtgtgggtctgacgctgctgtatctggcgctgttccgcctcggctctgacagcagcacgctggtagaacagtctgccaacggcgcggctattcttcatgcttacgttcagcacacctttggcggcgcaggcagcctgctactggcggcgctgattttcctcgcctgtctggtgacggcggttggcctgacctgcgcctgtgcggagttcttcgcccagtatctgccgttctcttaccgtacgctggcctttgtgcttggcggcttctcgatgctggtgtctaaccttggcctgagccacctgatccagatttccataccggtgctgaccgccatttatccgccgtgtatcgcactggttgtattaagctttacccgttcatggtggcataattcgtcgcgcatcatcgcgccggcgatgttcatcagcctggcctttggtatccttgacggtatcaaagcttccgccattggcggtgtgttgccagcctggacccagcgtttaccgctggcggagcaggggctggcgtggctgatgccaaccgttgtgatcgtgatactggccgtggtctgggatcgtgccgcagggcgtcaggtgacttcccgcgcacactgatcaagggttgcttgtcataaccacggggcttaccatcccgtggtttttttatttttgttatggcacgggaaacaatggaaagtactaacaagctaaagcgggggttaagcacccgacacatccgctttatggcgctcggttcggcaataggcacgggcctgttctatggttcggcggacgccatcaaaatggccgggccgagcgtgctgctcgcctatattatcggcggcgcggcagcctatatcatcatgcgcgcgctgggcgaaatgtcggtacataacccggcggccagctccttctcacgctatgcccaggaaaacctcggcccgctggcaggctacatcaccggctggacctactgttttgagatcctgattgtcgccatcgctgatgtcacggcgttcggcatctatatgggcgtctggttcccgacggtgccgcactggatctgggtgctgagcgtggtgatgatcatctgcgcggtaaacctgatgagcgtcaaggtgttcggcgagctggagttctggttctcgttctttaaagtcgccaccattatcgtgatgatcgcggcgggctttggcatcatcatctggggcattggcaacggcggcgaaccgaccggcatccacaacctgtggagcaacggcggcttcttcagcaacggctggctcggcatggtgatgtcactgcaaatggtgatgtttgcctacggcggcatcgaaatcatcggcattaccgccggggaagcgaaagatccgcagacctctattccgcgcgccatcaactccgtgccgatgcgtatcctggtgttttatgtcggcacgctctttgtgatcatgtccatctacccgtggaaccaggtgggcaccaacggcagcccgttcgtactgaccttccagcatctgggcatcacctttgccgccagtatcctcaactttgtggtgctgaccgcgtcgctgtcggcgattaacagcgatgtgtttggcgtcggccgtatgctgcacggcatggccgagcagggcagcgcgccgaagatgttcgcgaaaacctcgcgcaacggcattccgtgggtaacggtcgttgtcatgacggtggcgctgctgttcgcggcctggctgaactacatcatgccggagaacgtcttcctggtgatcgcctcgctggcgaccttcgccaccgtgtgggtgtggatcatgattttgctgtcgcagatcgctttccgtcgccgtctgccgccggaagaagtggcggcgctgaagtttaaagtgccgggcggcgtacccacgaccatcgccggtctgctgttcctggtgtttattatcgcgctgattggctggcatccggaaacccgcatttcgctgtacgtgggctttgcgtggatcgcgctgctgcttatcggctggatgtttaagcgccgttacgaccgcaaaaccgcctgatctcctgaacttttgccgggtgagcgtcctgccgcccggcaatgctttttggcttcctcctcccccatgctcctcccccaattatcagcagtatgatgagtgaactttcactatgctgtggcaaggtggcgtcatttttcagcaaggggtaaagcgatgttgaacgcctggcatcttccggtagcgccgtttgtaaaactcaataaagatcagctttttataactttgtggctggcgggcaacgatttgcctgcgcaggttaaactgcgtacggaaaaggacaacgaagagacgtccatcctgatgcatccgctgcgcagtgcaccgtaccccggcgtaaccgcctggcgcgccgccatcgacgtgtccgaagggcaaccgcgccgtcgctacagctttaaactgctgtgggcggatcgccagcgctggtttacgccgcagggcttcagcgatttcccgcccgcacggctggagcagtttgccatcgattgcccggataatggcccgcagtgggtggcggatcaggtgttttatcagatctttcccgatcgctttgcccgcagccagccgcgcacgccggagcaggacaacgtctattaccatcacgccgccgggcaggagatcgtgctgcgcgactgggatgatcctctcaccggcgaggcgggcggatcgaccttttacggcggcgatcttgacggcatcagcgaaaagctgccctatctgaaaaagcttggcgtcacggcgctgtacctcaacccggtgtttgtcgcccccagcgtacacaaatacgataccgaagattatcgccacgtcgacccgcagttcggcggcgatcaggccctgctgcggctgcgcgccaacacccagcgcgaaggcatccgcctggtgctcgacggcgtgtttaaccacagcggtgactcccatgcctggtttgaccggcacaatcgcggcaccaccggtgcctgccataatccggcctccgaatggcgggaatggtacagcttttcagacgacggccacgccctcgactggcttggctatgccagcctgccaaagctggattatcagtcggcctcgctggtggaggagatctataaaggcgaagacagcattgtgcgccactggctgaaagcgccgtggaatatggacggctggcggctggatgtggtgcatatgctgggggaggcgggcggggcgcgcaataacctgctgcacatcagcggcatcagccaggcggcgaaagagacgcagccggaagcctatatcgtcggcgagcattttggcgatgcccggcaatggttgcaggcggacgccgaagacgccgccatgaactaccggggctttactatccctgtgtgggggtttctcgcgaacaccgatatttcctacgatccgcagcacatcgatgccgccacctgcatagcctggatggataactaccgcgccgggctgtcgcatcagcagcagctgcgcatgtttaaccagctcgacagccacgacacctcgcgctttaaaacgttgcttggtaaagacatcgcgcggatgccgctggcggtggtgtggctgttcagctggcctggcgtgccctgtatctattacggcgatgaggtggggctggatggcaacaacgatcccttctgccgtaagccgttcccgtgggacaaagaaaaacaggacgccacactgtttgccctctatcagcagatggcggcgctgcgtaagaaaagccgcgccctgcgtcacggcggctgtcaggtgctgcatgcggaaggcgacgtggtggtctttgtgcgcgttttccggcatgaacgcgtgctggtggcaatcaaccgcggcaaggcctgcgaggtggtgctgacggatttaccgctggtagacgtcccggcctggcagtgcaaagtgggcaccggcaccatcgaggataatgtgctatcgctaccggcgatctccgccacgctgtggcgcaatcgctgaacctgttgcaacatttttatcagcattgaaaagaaatgtaatatcctttcgggagtgatcaccgaaccgaaggtaaaaccatggatgagcttttgctggttgccggtcttgttctctttttcgcgctgattgtcgcccctgcgctggcggtcagagcctggcgaaaaagcagcgatacgcagcgggaactgggcgtattgcgtgaacggctgacggcgctggagcagcagctggcggggcaggcaattgcgcctgcgccgcagccgctgcctgaacggatagcggagcaggaacctgttcctgcgcctgtcattatacctgcggcaccactgcccgctgtcgatccctgggcggcgagcgtgccggagcctgagccggttgccgtcaccccggcggcggtcagcaaacccgtatccgccgaaccgcgcggtggcatgattacctcgctggtgagctggtttatgcgcggcaatccgctggcgaaactcggcattctgctgctgttcttcgggctggcgtttctgttccgctattccgtcgagcgcgatctcttcccgctggaactgcgtctgtgtgtagcggcgcttgcggcggtgctgctgctggcgctcggctggcggttgcgccacaaacagcctgtctatgcgctgattttgcagggcggggccaccggcgtgctctatctgacggtatttggcgcgttcaggctctggcagatgctgccgatggcgctggccttcgccttgctgctgctgatctgtgcggtgagcgtggggctggcggtgttacagcgtgcgctaagtctcgcgatgctcgccagcctcggtggttatcttgcgccgttgctgctctccaccggcggcggcagccacatcgggctgttctctttctacctgctgctctcctgcggcattctggctatcagcgtctggcagcactggcgggtgctgaatctgctcggtctgctttttacctttggcgtcggcggcctgtgggggctgtttagctaccggccggagttctacctcagctgccagctgttcctgatcgcgaatattctgctgtttggcgtcctgagcgttggactgtcgctgcgggcgcagggcggcagtaagcgcattattgacggcgtactgctgttcgcgccgccgttgctgggatttggtatgcagtacgccatcacgcaggatttcgcctatggcccggcgttttccgccctcggctttggcgcgttttatctgctgctggcgtggctggtgctgcggcgtaaacctgaacttgggcgaccgctggtgctggcggcgctggcgctcggcggggcttttgtcacgctggccatcccgctggcgctttccgcccgctggacatcaatggcctgggcgctggaagggcttggcattctgtggcttggggtacagcaacagcaacggcggatgagctacagcggcacaggtttactgttgctggcaatgggcagcgccctgtgggcgatgcaggatctgcttccggcgctgtcgcagttgatgatttttgcggtgctgagcctgacatggatcgccgccgcctggctgtggcgcggactgaatatgcagggcagccacggcctgctggcgggcggtattctcttctggctgctggcgctgcacgggctgtcagcgctcaccttaagccgctttatgaatgagctgccgggcatactggcgctgatcgccctcagcgtccacggctggcgggttgtcggccagcggctgcgctggcgcgcgctcagcgatagcgtctggctgctgtggccgctgatgctggggacgctggtctggcagatcgcagcccagggcgcgatcctcagcgccggctggcagaacctcgcctggtgtcttgcactgccgtccgccttctggctgctgtatcaacagcgtacgccgcccgtgccctggctttcgcagggactgcacctgtcgctgttctggatgatcctcgccgcgctggcggcagagctgtggtggtttaccgatgcgctgccgtgggggatgttcccgtggcaggcggggctggcgatgaccgcggcggccgcagtgatcctgctggtacgcgccgggatcaagcgttcgctgtggccgctgcgcgtctggccgcagtggtacggcaccctggcgctggcgccgccgggcgttttcctgctggtgatgctgctgttgaccaatatcgacgatggcgtggtgatggaacagggctaccggccattgctcaatccgctggaagagggcgcggcctttgccttactggcgctgttcgcgctggcgcggctgtgcgcccgctatttcccggcgcaggggcgtgagatccataaacgtgtgccgctgctgctggcggcgctcgccttctggtggctgaacggcctgctgttgcgcagtctggcctggtatggcgatatcgactggtcggtgagcgcgctctggtcgtcccgcctggtgcagacctgtttcgcgctgttctggatgctggtggcgctgctggtgatgctgcgcgctgcccggcaggcgtcgcggcatgaatggctgggcggtgcggcgctgcttggcgtggtgattgtgaaactgatgctggtggacagcgcgggcggcggcggactggcgcgcgcggtggcctttatcggcgtggcggtgctggtgctcatcgtgggttatttctcgccgctgccgccgcggatacaacagacgcataacgaggaacaaggataatgacaatcatcagacggatacttttttgtgcgttactgggcgcggcgctgccgggctggagccaggacgccgcgccggaaaaaccgcaggattatgcctggggcgcggggctggagacgaccacgccatcgccgctgtatcaggtgaccttaccggagcgcatctataccgacagcgtcgcccccgatctgcgtgacgtgcgggtttttaatcagcagggtaacgccgtgccttttaccctgatcccggcggtgcagaaacagacgccgccgcgcacgctgccgctgcgcctgttcgcccttgatgcggtaccggaaaataatgcctcgtcagaaagcctgtggttgcgctcgcaggacggaatcgaaatccgtctggagggagaagggcggaaaacagcagggaagagttatctgttaaccctgcctgacacgcaaaaagacgactttccgctttcacagctgaagctggcctggagtgccgcgcccgccaactggcaggggcgcgcggatgtgtacttcagcagcgatctgaaaaactggacgctggcgggccgggatatgccgctgatggatcttgcctccggcaacgatcgcctgttgctggacacgctggatttcagcagttcagcctacccgacggaaatgcgttatgtgctggtagtgttcaacgatgccgcgcacgcgcctgcgctgaccggcgcgacagcggttgagcaggtttacagcgatacggcggtgaacatccacctgaatgcggtggcgaaaaccgtctccccggcggtacaggagttttcctggcaacgaccacagccgctggtgtcggtgatgattgaagcccggcacgggcgcgtactgccgctggcgatcgagtaccgcagcggggaaaaggccgcatggcagccgctggcgaaaagcgtgatttatcagctgaacggcaaagcgccggagccgctgaaaaccagcgggctggtgcaggcgatccgcgttacggcggttaatggccaactggaggatggtatcgcccaggtgaccggcgagcgcgccagccagacgctgatctttaatgcgcaaggtaaagggccgtttttactggcctgggggaatggcgctgcacaaccgcaggcgatggaggtggagatgctggtgcctgccgcgctacgtcaggagaatgcgcagctcccggaggcgatggtgcaggatcgcgtagtgctgggcggcgacgcgcggctgacggcggtggatccggcgcagcagcaaagccagtggaagaagatgctggtgtgggcggcgctggtgctgggcgtgctggtgctggtctgggtggggcttgggatctggcgcgaggtacggcagaagtcggtataaaaataaaaatgccgggtggcgctgacgcttacccggcctacgtacgacgatctacggaacaatcgtaggcccggcaagcgcagcgccgccgggcattacgtcatcgaacccccccaggccccgcaagcgcagcgccgccgggcaaaaacggcttacaggctggtgagattttcgctcaggtatttcgccacgccgtccggcgacgcgttcatcccttctttgcctttttcccactgcgccgggcagacttcaccgtgctcttcgtggaattgcagagcgtcaaccatacgcagcatttcgtcgacgttacggcccagcggcagatcgttcaccacctgatgacgcacaataccgttagtgtcgatcaggaaggagccgcgcagcgccacgcccgcgtccgggtgttcaatgccgtaggctttctggatttcacgcttgatgtcggccaccatcgcgtatttcaccgggccaataccgcctttatcgacgggcgtattacgccaggcgttgtgaacaaattcagagtcaaaagaaacgcccaccacttccacgccgcgcttctggaattcttcgtaacgcttgtcaaaagcgatcagttctgacgggcagacgaaggtgaagtccatcggccagaaaaacagcaccgtcgctttgccctggatatgctgtttgaagttaaagttttccacaatttcgccattgccaagcacggcggcggcggtaaagtccggagccggacgagtaaccagtaccatcataattctccagtgtgattgtaggggtaaggccgctatcaagataatcacctgccggtaaagcgcaagcactaaagctgtttgtttttcgcctgcgccatcatgcggggatagaactgaaagaacagcttttccagcgcctgataatgcgtatccagatcctgccacgagtcgcgcagcgcatcgaggcggggccgccgcgtcgccatgccgttcagcacctgctgaataaaatccatctcccggtagcgctcaagccatcgctctgaccacaaatagtcattcagattgacgaagcgcgccggcgaggagggcagaatggtggcgacctgcgcgtgggcatagctcacaaattcgctcagcggcatgtcaggcgacatctgcaaccagtggcgtgacagaaaatggtcccacatcacgtccagcgtaatgggcgcgacccggcgcgtttgcgggcgaaaccactcacgcgcttcgcggacttccggcaaattatcggtcagcacgtcaatgcggcggtgcatgcgaatgccgtcgacaatctcagccggatagctatcctgcgggttgccgcgaacgaaatcgcccagcaaattaccgggaagcgagctttctgcgaggtgcgcaagatgcaggtgtgcgaggaagttcattgtttagttaatccataaagaggcgtagctgttgcagcggaagcaccgtagcactagactatcccgcctgtttttcagtctgagtgtaagccatgcgcgttgccgatttttcctttgaattacccgaatccctgatcgcccattaccctgtgcctgcgcgcagtagttgccgcctgttatcgctggacgggccgacgggcgcgctgacgcatggtactttcaccgatctgctcgacaagctcaaccccggggatctgctggtctttaacaatacccgtgtgatcccggcgcgtctgtttggccgtaaagccagcggcggtaaaatcgaagtgctggttgagcggatgctggatgataaacgtattctggcacatattcgcgcctctaaagcgccgaagccgggtgcggaactgctgttaggcgacgatgacagtgttaaagccaccatggtggcccgccacgatgcgctgtttgaagttgagtttaacgatgaacgcccggtgctggatattctcaacgccatcggccatatgccgctgccgccctatatcgatcgtccggatgaagacgctgaccgcgaactttatcagacggtttacagccagaaaccgggcgctgtcgccgcgccaaccgcgggtctgcactttgatgagccgctgctggcgcgtctgcgtgagaaaggcgtagagatggcgttcgtaacgctgcacgttggcgcgggcaccttccagccggtacgcgtggacagcattgaagatcacatcatgcactctgaatatgctgaagtgccgcaggaagtggttgacgcggtgctggcggcgaaagcgcgcggcaatcgcgtggtggcggtcggcaccacctcggtgcgctcgctggaaagcgccgcgaaagcggccaaaaacgatctcatcgagcctttcttcggcgatacgcagatctttatttatcctggctatcagtacagcgtgattgacgcgctggtgaccaacttccacctgccggaatccaccttgatcatgctggtatcggcttttgccggttataaagccaccatgcacgcctataaagaagcggtaaaagcggaatatcgcttttttagttacggggatgcaatgtttatcacgtacaatccgcaggcaatttctgagcgcgtcggggaatagttccgcggcgctttgattgacgcgttggactgtttttccggcgtatggagaaaaaatgaaattcgaattagatacgacagacggacgcgcccgccgtggccgcctggtgtttgatcgcggcgtggtggaaacaccggcctttatgcccgtgggcacctacggcaccgtaaaagggatgacgccggaagaagtgcaggataccggcgcacagattatcctcggcaacaccttccacctgtggttgcgtccgggtcaggagatcatgaagctgcacggcgatctgcatgactttatgcagtggaaaggcccgattctgaccgactccggcggtttccaggtcttcagcctcggcgatattcgtaagatcaccgaagcgggcgtgcatttccgcaacccgatcaacggcgatccgatcttcctcgatccggaaaaatccatggagatccaatacgatcttggctccgacatcgtgatgatcttcgatgaatgtacgccatacccggctgactgggactacgccaagcgttccatggaaatgtccttacgctgggcgaagcgcagccgtgaccgtttcgattcgctgcaaaacaaaaatgcgctgttcggtattattcagggcagcgtttacgaagatttacgtgatatctccgtcaaaggtctggtagagattggctttgatggctacgctgtcggcggtctggctgtgggtgaacctaaagcagacatgcaccgtattctggaacatgtctgcccgcagatcccggcagacaaaccacgatacctgatgggtgtgggtaaacccgaagatctggtggaaggcgtacgtcgcggcattgatatgtttgactgcgtgatgccgacgcgtaatgcgcgtaacggccatctgtttgtcaccaatggcgtggtgaaaatccgtaacgcgaagtacaagagcgataccggcccgcttgatgaagagtgtgattgctatacgtgtcgcaattattcactcgcttacttgcatcatcttgaccgttgcaacgaaatactgggcgcgcgtcttaataccattcataacctgcgctattaccagcgcttaatggctggtttacgcaaggctatcgaagagggtaaattagagagcttcgtgaccgatttttaccagcgtcagggtcgtgatgttccacctttgaacgttgattaattttaataatgagggaatttgaatgagcttttttatttctgatgccgtagcagcaacgggcgcaccggcgcagggcagcccgatgtctttgatcctgatgctggttgtatttggtctgatcttctatttcatgatcctgcgcccacagcagaaacgtaccaaagagcacaagaatctgatgaactccatcgctaaaggcgatgaagtgctgaccaacggtggcctggtgggtcgcgtgaccaaagtagcggaaactggctacattgctatcgccctgaatgacaccactgaagtggttatcaaacgtgacttcgtagctgccgttctgccgaaaggcacgatgaaggcgctgtaatctttcgttttcccaaagggaagtgccgtgttaaaccgttatcctttgtggaagtacatcatgctggtcgtcgtgattatcgtcggcctgctatacgcacttcccaacctgtatggtgaggatccggcagttcagatcactggtgcgcgcggcgtcgccgccagtgagcaaacgctgatccaggtccagaacaccttaaaacaagaaaaaatcactgctaagtctgtggcactggaagagggcgctattcttgcgcgtttcgactccaccgatacgcagctgcgcgcgcgtgaagcgctgctcagcctgttgggtgacaaatatgtcgtggcgctgaaccttgcacctgctactccgcgctggttatcctccatcaaagcagagccgatgaaactcggtctggatctgcgtggtggcgtgcacttcctgatggaagtggatatggacaccgcgctcggcaaactgcaggaacaaaataccgacagcctgcgtagcgatttacgcgaaaaaggcattccttacaccaacgtgcgtaaggaagataactatggcgtgagcattgtgttccgcgacagcgcagcgcgcgatcaggcgattacttacctgactgcccgtcaccgcgacatggtgatcaccagccagagcggcaacgccctgcgcgcggtcatgaccgatgcgcgtttgagcgaagcgcgtgaatatgcggtacagcagaacatcaacatcctgcgtaaccgtgtcaaccaactgggtgtcgccgagccgctggtacagcgtcagggcgctgaccgcatcgtggttgaactgccgggtattcaggacaccgcgcgtgcgaaggaaattcttggcgcgactgcgaccctcgaattccgtctggtgaacaccaacgtcgatcagtcggcggcggcgtctggccgtgtaccgggtgattcagaagtgaaacagatgcgcgaaggccagccggttgtgctgtacaaacgcgtgatcctgaccggtgaccatatcaccgactccacttccagccaggatgagtacaaccagccgcaggttaacatttcgctcgacagcgcaggtggcaacatcatgtctaacttcaccaaggacaacatcggcaaaccgatggcgaccctgtttgtggagtacaaagacagcggtaaaaaagatgcgaacggtcgttccgtactggtgaaacaggaagaggtgattaacgtcgccaacatccagtcgcgcctcggcaacagcttccgtattaccggcatcaataaccctaacgaagcgcgtcagctgtcgctgctgctgcgtgcgggtgcgttgattgcgccgattcagatcgttgaagaacgtaccattggcccgaccttagggatgcagaacatcacccagggtctggaagcctgtctggcgggtctggcggtctccatcatcttcatgctgttcttctataagaagtttggcctgatcgccaccacggcactgatcgccaacctggtgctgattgtcggcatcatgtccctgctgccaggggcgacgctgaccatgccgggtatcgcggggatcgtcttaacccttgcggtagcggtggatgcgaacgtactgataaacgaacgtatcaaagaagagctgagcaacgggcgtagcgttcagcaggcgattgacgaaggttatcgcggcgcgttcagctccatttttgacgccaacgtcacgacgcttattaaggtcatcatcctgtatgccgtaggcaccggggccattaaaggcttcgccattactaccggtatcggtgtggcgacgtcaatgtttaccgcgatcgtcggcacccgtgccatcgtaaacctgttgtacggcggcaaacgcatcaacaagctgtctatctgaggagtgcgttgtggcacaggaatatactgttgaacaattgaaccacggccgtagagtctgggactttatgcgctgggattactgggccttcggtatctccggttttctgctgatcctgtcaattatcattattggcgtgaaaggctttaactggggtctggattttaccggcggtacggttatcgaaatctcgctggaaaaaccggccgatatggatcagatgcgtgaagcgctggaaaaagccggctttgccgatccgctgttgcagaactttggcagcagccgcgacatcatggtgcgtatgccgcctgccgagggtgaaaccggtggtcaggtgctgggcagcaaggtcgtgagcgtgattaacgaagcgaccagccagaatgccgcggtgaaacgtatcgagttcgtcggcccgagcgtgggtgcagacctggcgcagaccggcgcgatggcgctgatggtggcgctgatttccatcctggtttacgtcggcttccgctttgagtggcgtctggcggccggtgtggttatcgcgctggcgcacgacgtcatcatcaccatgggcgtactgtcgctgttccatatcgaagtggatctgacgattgtcgcctcgctgatgtcggtgatcggttactcgctgaacgacagcatcgtggtatcggaccgtattcgtgaaaacttccgcaagatccgccgcggaacgccgtacgaaatctttaacgtgtccctgacccagacgctgcacaggacgttgatcacttcaggaaccaccttagtggtgatcctgatgctctacctctttggcggcgccatgctgcagggcttctcgctgaccatgctgatcggtgtgtccatcggtactgcatcgtcgatttatgtcgcgtcagcgctggcgctgaagctgggcatgaagcgtgaacacctgctggtgcagaaagtcgagaaagaaggcgcggaccaaccgtcaattctgccgtaaaccgacgctctgcgttgaaaaccgcagcctcagcgctgcggttttttttcgcctgcgttttacgggcaaaaaaaagccagcggttaagctggcttttcgatggggctgacagacaaatcagaagttataacctgccaccaggtaaccaccccagccggtagagcggacgttttctttcatccataccaggtctgcatcatcattccactgaccgccgttgtgccagtaacgcgctactaccgagtagtgccagtgatcgtagctcagggacagaatgtggctggaggcgatggagtcgttggtacgctgcttgatgccgttcatcgcatagctgctcttatcgcccaggtctgagccccagtcaaagttggtgaagccgatgtagctcaggttaccgccccacagttgggtgatcggcacgaagtatttcactttgaaacggtagccgtcccactcgttttcgttttccgccaggtagttctgccactggtatttcgcatacacgttcagtgacaggctcatcggcaggccggtatcgatgtcggtacccagacccatgtaccaggtgctctgacgaccagaggcgttgcggcccatgtcgtagatgtagttgttcgcgaaataccactctttaaacggaccgaagctcagatcggcgccggtcagcttatcgatagagaaacgcggttcgatttccataaacagcggcgaaccatggttccagatcccgcgggcatcggtgttaccaccgaagaataccggtgcatccaggtaaccatagaaatcaaaccagtcttttttggcaaatgcttcatattccaggtaggtatcgttacggatctgcggtccaaaacgggtgtgatagctgcctaccacgttcacgctctggtgccaccagtcggaaacgaactccggcttgtcattttctgccgcattgactgcgaatgaggaggagagagccagtgctgcaccggcgacgagtaatgtttttttcatagtttagccactgattaggttcccttgcgggagcgaaagaacgcgcgtattgagtttctaaatgtttcgtatttcagcgagcctattataagtatccatgctcacaaaaatatgtgttgtttcacatatccattacgcacgtaatcgattgcgttcacgtttgcgtatataaaacgcagggattgtactgagattcatctgtcttgcaaatatttcgtggaaaaaggcggtaggggagggaaaagggcgagaggctcgcccttaaacaggatcactgattggtggcgggctgaatatcgtggacgcgtacaaagcccagctggtccggcgtgatgccgttaagctgcagcggcagatcaacgtcgctcggcgccagggtgctggccggggcgttaatcagctggttttgcacgttcacttcctgataatcgttggtggtgccctggatctgaccccattccaccgtaccgctaaacgctggcagcggatcgttcgattcgccctgaatgcgcagcgtcacgcgcgtgccgttcgcatcaggcgcgatgttcaccagcgacatcttcagcataccgatctggctgtgcagaagggcaggggtattcgcgcccggcaacaggtacacaccgctgctggatttggcgttcagcgcattttgctgggtgattttcaccgtctcctgattcagcttactcatttctttgttaagcgtgctgacactttgatgcaactggcggacttcgctctgctgcgcgcaggcgctgagggtaaacaggctgccgaccagcaaaattttcaggtaacgtcttgtcatcgtgttggtttccttgcaaagagcattgcctgtaatagtagcctgcacgaaccggcttgccatcgatcctttatctcaaaagcggtcttgcctttgttgtcacggcagatcaggttaaaatagatttcagctaattttaacgtcaggacgccgtatgcattgcccattctgtttagccgtggataccaaagtaattgactcccgcctggtcggtgaagggtcgtccgtgcgccgccgccgtcagtgtctggtgtgtaatgaacgcttcaccacttttgaggtggcagaactggtgatgccacgcgtggtgaaaagcaacgagatccgcgagccctttaacgaagaaaaactgcgtaacggcatgctgcgcgcgctggaaaaacgcccggtaagcgccgatgacgttgaaatggcgctgaatcatatcaaatcccagctgcgcgccaccggcgagcgcgaagtgccgagcaaaatgatcggcaacctggtgatggagcagctgaaaaagctcgataaagtcgcctatatccgcttcgcctcggtttaccgcagcttcgaagacatccgcgaatttggcgaagagatcgcccgcttacaggattaagctcatgcacgatgagatgtacatggcgcgcgcgctgaaactggcgcaacgcgggcgttttaccacccatcctaatcccaacgtcggctgtgtgatcgtcaaagacggcgagattgtcggcgaaggctatcaccagcgggcgggcgaaccccatgctgaagtccatgccctgcgtatggcgggcgaaaaggcgcgtggcgccaccgcctatgtcaccctggaaccctgtagccatcacggacgcacgccgccatgctgcgacgcgctgatcaacgcgggcgtgtctcgtgtggtggcggcgatgcaggatcccaacccgcaggttgccggacgcgggctgtatcgtctgcaacaggaaggcattgaggtcagccacgggctgatgatgagcgaggcggaaaatcttaataaaggttttctgaaacgtatgcgcaccgggtttccttatgtgcagctgaagctgggcgcgtcgctggatggccgcaccgccatggccagcggcgaaagccagtggataacctcaccgcaggcaaggcgcgatgtgcaacgtctgcgcgcgcagagtcatgctatcctcaccagcagcgcgacggtgctggcggataatccgcagcttaacgtccgttgggacgaactcccggcggacgtacaggcgcagtattcgcaggcgcagttacgccagccgctgcgtattgtggtcgacagccagaaccgcgtcacgccggaacaccgtctgatccagcaggcgggtgaaacctggtttgcccgcacgcagcaggactcgcggtcgtggccggacaacattcgccacatccaggtgcctgaacacaacggtcatctcgacctggtgctgatgatgatgctgctgggccgcgagcaggttaacagcatctgggtggaagccggggcgtccctggcgggcgcgctgcttcaggccgggctggttgacgagctggtggtgtacctcgccccgaaacttttaggcagcgacgcccgcggtctgtgcgtactgccgggctttgaggcattagccgatgcgccgcagtttacattcagtgaaattcgtcaggttggacctgatatttgcctgcatttgaccactgcgtaatgccctcgtaaaagggaagcagtgcgcaaagtattatgataaaatccgcccccctgcggggccaaatgaacccgtaaaggaagagtatgaacattattgaagctaccgttgctgccccggacgctcgcgtcgccatcaccattgcgcgtttcaacaacttcatcaatgacagcctgctggacggtgctatcgacgcactgaaacgtatcggtcaggttaaagatgaaaacatcaccgtggtttgggttccaggtgcttatgagctgccgctggcggctggcgcactggcaaaaaccggtaaatatgatgcgattatcgcgctcggcacggttatccgtggcggtaccgcccatttcgaatatgtggcgggtggcgcaagcaatggtctggctcatgtcgctgaacagagcgaaatcccggtagcctttggtgtgctgaccactgaaagtattgaacaagccatcgaacgcgccggtaccaaagccggtaacaaaggtgcagaagctgcccttaccgcgcttgagatgattaatgtattgaaggccatcaaagcctgatttttttgtaaggggaatttccgtgaaacctgctgctcgtcgccgcgcccgtgagtgtgccgtccaggcgctttactcctggcagttgtcccagaacgacatcgccgatgttgaataccagttcctgtctgaacaggatgtcaaagatgtcgacatcgcgtatttccgcgaactgctgtccggggtggcgactaacagcgcatatctcgatggactgatgaagccctacctgtcccgtctgctcgaagagctgggccaggtcgagaaagcggtactgcgtatcgcgctgtttgaactgtctaaacgtgcggatgtgccgtataaagtggccatcaacgaagctattgaactggcaaaaacgtttggcgcagaagacagccataagtttgttaacggcgtgctggataaagccgcacccgcgatccgcccccacaaaaagtaatttgctggtccgcgcggcgaagtgcagttgccatttcgccgcctccccagtctcctgtttatcattctgctgaggcatagcgtatggcatgcggcgagttttcccttattgcccgttattttgaccgcgtaagacgcgcgcgtctggatgtcgaaaccggcattggcgacgattgcgcactgctcaatattcctgacaagcaaacgctggcaatcagcaccgataccctggtttcgggcaaccattttcttccggatatttcccctgtcgatctggcgcacaaagcgctggcctccaacctgagcgatcttgcggctatgggcgcggatccggcgtggctgacgctggcgatcacgttgccggacgtcgatgaagcctggctggaagcctttagcgatagcctgttcgaacagattaattactacgatatgcagctgattggcggcgacaccacccgtgggccgctgtcgatgacgctgggtatctacggctatgtgcctgcgggccgcgcgcttaagcgttcgggcgcgaagcctggcgactggatctatgtgactggcacgccaggtgacagcgcggcaggtctggcgatcctgcaggatcggctgcatgttgataatgagcaggacgcgcagtggctggtaaaacgccatctgcgtccgacgccgcgcattctgcaggggcaggcgctgcgcgatctggccagttcggcgatcgatttatccgacgggctaagttccgatctcgggcacatcgtgaaggccagcgactgcggcgcgatgctggatatggatgccatgccgttctctgacgccatgcgccgtcacgttgagccggagcaggcgctgcgctgggcgctggcgggcggcgaagattatgaactctgctttaccgtgccggaacgcaaccggggggcgctggacgtggccattggtcatcttggcgtgccctttacctgcatcggccagatgagcgccgatgtggaaggcatccagtttacccgcgacggaaaaccggtatcgtttgatttaaaaggatacgatcactttgcaacctcgtaaggatagtgcgaaaagccgtcttagcatgcgcaacccctggcatctgctggccaccggttttggcagcggcttaagtccgattatgccgggcacggcgggttccattgcggccatcccgttctggtatctgatgacttttctgccgtggcagctctattcgctggtgatcatgctttcgatcagcatcggcgtttatctgtgccatcaaacagcgaaagatatgggcgtgcacgatcacggcagcatcgtctgggatgagttcatcgggatgtggatcacgctgatggcgctgccgacccatgactggcagtgggtggtggccggttttgtgctgttccgcttttttgatatctggaaaccgtggccgatccgctggtttgaccgcaacgtgcacggcggcatgggcattattgtcgacgatattatcgccgggattatcgcggcggcggtgctgtatgtaatcggtcatcactggccgattggcattatttagccgttttccccggcctgatcttttcagaacaggccggggcagcgattatttaaatcccaccacggcatgctgtttatacggcatttccatttcggcgatctgctccggcgtcagttgcagatcaaccgcctgcaacaactcttccagctgctcttcccgtgacgtgccgataataggcgcggccacgcccggcttactcagcagccaggccagcgccacctgcgcccgcgttgcgcccacgtcttccgctatcgcggccaggcgttcggcgatctgcgcatcgctctgctcgctgtcgtcatagagttttttacccacttcatcggacaccagccgcgcggtggtttcaccccaggggcgcgtcagacggccacgggccagcgggctccacgggatcaccgcgatgccttcctgatagcacagcggcagcatgtcgcgctcttcttctcggtagatcagattgtaatggttttgcatggtgacgaaacgcgcccagccgtgctgtttttgcagatccagcgcctgggcgaactgttcggtgtgcatggacgatgcgcctatgtagcgcgccttaccggctttcaccacgtcgttcaacgcttccagcgtttcttcaataggcgtgttgtaatcccagcgatggatttgcagcagatcgacatactccatgccgaggcggcgcaggctgtcatctatggaacgcaggatttgcgcccgtgacaggccttcggtgagatcgcccgacgaataatagactttggtggcgaccaccacctcgtcgcggcgtgcaaagtctttcagcgcgcggccaacgatctcttcgctgctgccatcggaatagctgtttgccgtatcgaaaaagttgatgccgccttccagggcgcgctgaataatcgggcggctgctctcttcaggcagggtccaggcgtgattgccccgatccggctcgccaaaggtcatacagcccagacaaagacgggaaaccttaaggtccgtttttcctaatgtattgtattgcatggttccactcctgctacgggtacgagattacctaagcatagcaggagcggaagagggagttaggccagccagtttttgatgctggcttcaataccggcagcgtccagaccaatggcggcgcgcgcctcgtcctgggtgccctgaggaataaaatgatccggcaggccgaggttgagcaccggcaccagcgtgcggttcgccatcagcacttcgttcacaccgctgccagcgccaccgatgatggcgttttcttccagcgtcaccagcgcttcatggctgcgggccagcgacaggatcagcgactcgtccagcggcttcacaaaacgcatgtccaccagcgtggcattgagcgattccgcgacctgtgccgcatcggccagaagagtgccgaagtttaaaatcgccactttttcgccctgacgtttcaccacgcctttacccaacggcagcttttgcagcggcgtcagttccacgcccagcgcattgccgcggggataacgcaccgcgctcgggccatcgttatagtgatagccggtaaacagcatctggcggcattcattttcatcgctcggcgtcatgatcaccatttccggaatacagcgcaggaatgagatgtcgaacgcgccctgatgcgtctgcccgtcagcgccgacaatacctgcgcggtcaatggcgaacagcaccggcagcttctggatggcgacgtcgtggatcacctgatcgtaagcccgttgcaggaaggtggagtaaatcgccaccaccggcttgtaaccgccaatcgccagacccgccgcgaaggtcacggcgtgctgctcggcaatcgccacgtcaaaatagcgatccgggaatttacgggaaaactccaccatgccggagccttcgcgcatcgccggggtgatcgccatcagtttgctgtctttggccgccgtttcgcacagccagtcgccaaaaattttggagtaggacggcatgccgccgacgcttttcggcagcgttcctttagccggatcgaatttcggcaccgcgtggaaggtaatgggatctttttccgccggctcataaccacggccttttttggtcatgatatgcaggaactgcgggcctttcaggtcgcgcatgtttttcagcgtcgtcaccagccccagcacatcgtgaccgtccaccgggccgatatagttaaagcccagctcttcaaacagcgtgcccggcaccaccatgcctttaatatgctcttcggtgcgtttgagcagctctttgatcggcggtacgccggagaagacttttttgccgccttcgcgcagcgtggaatagagtttgccggacagcagctgcgccagatggttattcagcgcgccgacgttctcggaaatcgacatttcgttgtcgttgagcaccaccagcatatccggccggatgtcgcccgcgtggttcatcgcctcaaaggccatgcccgcggtgattgcgccatcgccgatcacacagacggtgcgacgctgcttgccttctttcgccgccgcaacggcgatgccgatcccggcgctgatcgaggtggacgaatgaccgacgctcagcacgtcgtattcgctctcgccgcgccacgggaaggggtgcagcccgtctttctgacggatggtatcgatcttgtcacgccgtccggtgaggattttatgcggataagcctggtggcccacgtcccagatcagctgatcgaaaggcgtgttatagacataatgcagcgccacggtcagctcaatggtgccaagcccggaggcaaagtgcccgctggagcggctcacgctatcgagcaggtagcgacgcagttcgtcgcacagcttcggcaggctctctttcggcagcagacgtaactccggggcggagtcaaccagtgccagtgtcgggtatttggctatatcaaaactcatcggccactcgtcttactcgtcataattcagcgggcagtttgccgccctctgcgttatcaggagcatataaaaagtttatttatcacgctggattatgtaattcgccagtgcttccagtgccgtggtatccagtgactgggcggccagcgcgtctaacgcgtggcgggcatcgtcaatcaggtcacgggcttttgtctgagcctgctctaagcccagtagtgcggggtaggtgcttttacctaaaaactgatcggcaccctggcgtttgccaagggtcgcagtatcacccaccacatccagaatgtcatcctgaacctggaacgccagaccgatgctttcggcgtagcgatcgaggatcggcagcgcagcgcgtcctttatcaccggcgcttaacgcgcccagtcgcaccgcggcgcggatcagcgcaccggttttatgccggtgaatacgttcaagctccgccagaccgacctgtttgccttccgcctcaagatccagcgcctgtccgccgcacatgcctgcgacgccactggcctgcgccagttcagacaccatagcaaggcgatcgcgcgcgtcgacttccggcatgggcgtatccgcgaggatagaaaacgccagcgtttgcagcgcatcgcccgcgaggatcgcattcgcttcgccgaatttaatatggcaggtcggctgaccgcgacgcagatcgtcatcatccatcgccgggagatcgtcatgcatcagcgaataggcgtgaatacattcaatggcggcggcaggggcatcgagcgtggatgcgctcacgccaaacatctggcccgtagcatacaccaggaaaggccgcagccgtttgccgcctaacagtgtgccatagtgcatggcctcaaccagtggagtgttctgaaagggctggggagaaataaagcggcgcagggcgtcattcgcctgctgtacgcagatttcaagttgctgtgcaaaatccatgtttactcggcgtccggagtgaaaggcgtcagcggggcgtcatcattatcagagagcaggatctgcacgcgctgctctgcctgttgcagtttaacctgtccctgacgggccagctgtacgccgcgctcaaattcatttaaggcttcttccagcggtaagttgccgctttcaagacgggtgacaatctgttccagctcattgagctccgtttcgaaactggccggtgcgtcatttttctttggcatgtgaatgtctgactctctcatttattcggccccgctatggtagcggagtggcgcaacttagcaaataaggcgtaatggtcatgcaatatgcgcaggttgaccacgatggtggtatacttctgcgcctggatgcagccgcaggtatgggctgctgtatatttctctcaacagatcgcttgcctgatctgccaacgaaccattgccgccatgaagtttatcattaaattgttcccggaaatcaccatcaaaagccaatctgtgcgtttgcgctttattaagatgctgaccggaaatattcgtaacgttttaaaacattataacgacgacacgctcgccattgttcgccactgggatcatattgaagtccgctccagagacgaaaaccagcgtctgactattcgcgatgccctgacccgcattccggggatccaccatgtgctggacgtggaagatgtgcctttcacttcgctgcatgacatttttgaaaaagcgctggcgcagtatcgcgaccagctggaaggcaaaaccttctgcgtgcgcgttaaacgccgcggtaaacatgagtttagctctattgaagcagagcgctacgtgggcggcggacttaatcagcatatcgaatcggcgcgggtaaaactgacgcacccggatgtcaccgtacatctggaaattgaagatgaccgtttgctgctggtgaaaggccgctacgaaggcatcggcggtttcccgatcggtacccaggaagatgtgctgtcgctgatctccggcggtttcgactctggcgtgtccagctatatgctgatgcgtcgcggctgccgcgtacactactgcttctttaatcttggcggcgcggcgcatgaaatcggcgtgcgtcaggtggcgtactacctgtggaaacgttttggcagctcgcaccgcgtgcgctttgtcgccattaactttgagccggtcgtgggcgagatcctcgaaaaagtggaagacggccagatgggcgtggtgctcaaacgcatgatggtgcgcgcggcgtcaaaagtcgccgaacgctatggcgtgcaggcgctggtgaccggcgaagcgctgggccaggtgtcgagccagacgctgaccaacctgcgtctgattgataacgtttccgacacgctgatcctgcgtccgctgatctctcacgataaagaacacattatcgatctggcgcgtgaaatcggcaccgctgactttgcccgtaccatgccggaatactgcggtgtgatctcgaaaagcccgaccgtaaaagcggtgaaagcgaaaatcgaagcggaagaagaaaactttaacttcgacattcttgatgaagtggtcgccgcggcgagcaatatcgacatccgcgaaattgccgagcaaacccagcaggacgtggtggaagtggaaaccgtcaccggtttcggcccgaacgaggcgatcctcgatattcgttccatcgacgagcaggacgataagccgttgcaggttgaaggtgtggaagtggtatctctgccattctacaaactcagcactaaattcggcgatctcgaccagagcaaaacctggctgctgtggtgcgagcgcggcgtgatgagccgcctgcaggcgctgtatctgcgcgagcagggctttgagaacgtgaaggtttatcgcccgtaatgaaaaagcgccgtaaggcgctttttttattcgtaataattataaattcctgccggtatcaccagctgtgacgccacttcgtgggccttttctcgcccgaccagcagatcgataatcttcagaccgaaatcaatggcggtgcccggcccctggctggtcagcaggttgacgcgcggatcccagaccacacgtttatcctgccactgatcttccgggatacggtctttcagcgccgggaagccggtcatgttgccgatggggaacagatcgtgaggaaccagcacggtagccgcggcggcgcagatggtggcaacgatgcggccggaaagatggaactgccgcaccgtctctaccagcagcggactgtcacggaaacattcggcgcctttaatgccgcccggcaggacgatgatgtcaaaatcgccgtcagccacttccaccagcggcgcatcggcaagcagcttcacgccgcgcgagcagacgatcctcagatcgccgtcgctggcaacactggcggtagtgacgttgatgccgccacgcaccagcaggtcgatggtggtgaccgcttccatttcttcactaccaggggcgaggcatatcagtgctgatgggctcatactcactttccttacgcttaacgagttcataaagtcgggtgttttccgggaccgctataccgtgcgcgcgggcgcgtctgagcaaatacccggtgatgtaatcaatttcggtatgacgcagggcgcgcacgtcctgcaacatcgacgagatgttatctttagtgctggcgatgatctggttgacgtaaagcagcaaatcctcagcggaagtatgatgaccttcccgctccatcaccgccgccacttcgtggcacagcgtctggattaaggccggatgcgcctgtagctcgccgttcgggcagttccacagcgcggtcagcggattgatcacgcagttcactgccagcttgcgccacagctcagggcgaatggtgttatgccaggctacgtccggcagcacgtcctgaagggtatccgccagatagctgtaatccccgtcctgctggcgtgcagggccaatgtgagtgataccacccgcgacgtgcagaatgacattgccatcgtggcgggcagcgtgcgtggtggtacccatcagcagaggctgggagatatttttcagctcatccaccgtacccataccattatggatgaggagtatcggcgtagcggcaggtaaactggcggcgaggtttcttaccggttctgacacctgccaggctttaagagtcaccagcagcagatcgctttgcgccaggaaatcaggatcgttcgcggttaacgacgcgttaaaaagggtgccgtcttcttcgatcaggtttacgctgcaataaggttgaggtacgcgaagccagccctggacttcatgtccatgcctgcacagcgcgctcagccacagctgacctaatgccccgcatccgagcacggtaattttcatggttcctcctggcctgcaacacttacgggcataacaagttgagttatgcttcttagcaggtattatgcatcgcaataaatagagagggagaagaaaagatgccatctttcgatattgtctctgaagttgatcttcaggaagtccgcaatgcggtcgacaatgccagccgtgaagtggagtcgcgttttgattttcgcggcgttgaagccactttcgagctgaacgaggcgaataaaaccattaaggtgctgagcgaatctgatttccaggtgaaccagctgctggatattctgcgtgccaaactgctgaaacgcggtattgaaggggcgtcgctggacgtacctgaaactttcgtgcacagcggcaaaacctggtttgttgaggcgaagctaaaacaaggcatcgagagcgcgacgcagaagaaactcgtcaaactgatcaaagacagcaagctgaaagtgcagtcgcagatccagggtgaagaagtgcgcgtgaccggtaaatcacgcgacgatttgcagtccgcgatggcgctggtgcgcggcggcgatctggggcagccgttccagttcaaaaacttccgcgattaactatcccaggcccggcgatacccttttcgtcggccttttttactcccttcacctgcttcagccaattaagtaaattaatcaatctattacgaatttgagaatgatgataatcacattctaggtgaaatcatcttgtcagcctggtctgcactgattactttgctaactcgaattagcaaagggcggggcagggatgccatcacatgaatttaaggcgctggccccgatataatggataaatggtgaggcgctatcatgtcagcagacaaaacaggtttattacaggatttatgtcagattaaaaatgcccgcagcgggcggctatccagctgggatcaaagcgggcgtaatcaggattactggatgatccccgccggggaaaccgttcggttagcggatataagtggtagcggttgtattacccatatctggatgacgcaattttgccgcaaaataaaaggccccggattgattgatccgacgcagggacaatatgtcgcgcccattaatgaaatcaataacgcccttggcgtaagctgggagcaacatgatgaagcttactatcgtaaggtactgctgaaattttactgggataaccaggtgcaaccgtccgttatcgtgccgctgggggattttttctgtgtcgggcattcggttccggctagctttacctcgctgcccttcactgtctcttgtcggcccgacgaaaattaccggcccggcgcgacggcggcgtttaactgctatttacccatgccctttaacgagcgcgcgattattgaagtcgaaaaccagaatgatttgccctacggacagtatttcaatatcgattttgaatgctatccggaaaagcatgccgacgatattgcttattttcatgcctggtggaagcgtgaaaatccctgccagggctgggggcctgaactgcaggttaacagcccggaagtcaatattccttgcctgagcgcggagaataattatgagcttctgaatattgagggggaagggcattatatcggctgcaatttatcggtgcgccatcggcaggaaacctggtggggcgaaggcgatgagatgatctttattgatgatgatccgctgtggccgccttcaattcatggcacagggacagaagattattttaatcatgcctggggaatgcaggactgttccgccccttttaatggttcctcactacacgattctcatttgccagggtttcagaccagctaccgctttcatattaccgatccagtgcattttaaaaaacgcatccgggtgaccatggagcatggtcatggtaatcatctttctgacgactgggcgtcgaccgtctactggtatcaaaagctgccctcgcccgtattgtcgatgcaaccggtggcggagcgtattccggcaagggcaggagaagcctttgccccgctgtctgaggtaacgctgaatgcagaaatgcaggcgcaaaaacagtgcgcggcgcagcgtcttgaaaactggcaaacgcttcgccagcaggaagtggataagaaaatcgccgccacgcgtgagaagtccattaacaataaaattatttcaccattttctgaataactaaacagcggtatgcgcattattgcggtatgcctggcgggttcccgtcaggcagaagatgtgcatacctgagccacctgaaatcacgttaccggaagagttttatcatgactacacgcttatcggttcttgaaaaaagcgcttatggcgcgggtgatatggcactcactatttctattatttccgcatccatacttatctatgctttcctgatccaggtcgtcggattatcgcccgttgacgcaggctggatattaatgattgtgcgcaccattgatgctatttccgatccgctgatgggaatattaaccagtaaattccgtacccgtctgggacgttatcgtcactggttgatgattggcgcaatacctttcggtatttcactctggctgttatttacttcttttggcgaaacctatagccagaaaatggcctggtcaaccggcgtctatatatttaacagccttgcctttacggtgctggcgatcccctatatttcattgattggcgtgatcaccgccgatccacaggagcgactgaacgctaacgcctttcggttcccgatggcgaaggtagccacgcttattgtttcaacctttgtgccgtactgggtgacccagggcagcgatgcgcgcagcagttacgcaacagcctttgcagtagtgggggcggtaagcgtcgttatcatgctgttctgcgcgtttaatgtgaaagagcgggtgatcactacgacacctgcagagcctttacgccgccaggtgaaaggcttgctgcaaaacgatcaatggcagattatcagcctcgcgatggtcgtgctgtttgtcggctttctggtgaatggcagcgtcgcgattatgtacggcaaagagtttgccggtgcgacggacgggtatgggattgcgatattcatgagtatgggatcggtaggaggcatccttgggccgttgatctctacctggctgacgcgtcattactgcaagataaaagtatttaagtattccatgtatggctcggcggtgatgtcgttattggcctggtggctggtaggggcgaacagcttctggagcgcgacgttcttttatttgctctgttctgtagtgtcacagattaatacgccgatcctctggtcttctattactgaagcttcagattatggcttatgcaaaacaggtattgatgcttccggtctggcgattggtatgatttctttctgccagaaattcggtatggggatcgccgggccgatcaccggctatttgttggcctgggtgggctacaccagtgagggcgcgcaaagtgcgtcagcgatcgcagggttatcctggatcatgctgctggtgccagcgctgttttatttactcaccggcctcattatgcatttctacgtgatcaacaacgcttactattccgcgatgatgcagaatggccgcaatgatcaagcgaccatactgtgtgaaaagcctcagtaaaaaggccccgcagctgacagggcggggcgcttgatttaagaccggcgcttgcgggtgatcagcgtcatcggcactctgacggtctcattaacgggatcgccggtaagcgcgcgctgcatcatattgaaggctttttccgcccaggcgtcttcgtcctgttgcattgaccagacattatttgccaggaaactcagcatcgggtgttcatcaaaggtgccgatatcaatatccggggaaagctcaccaaagcgggtacgcagcgcatcgatagccccctccagtaccggcagcgatgaggcgataaatacctccggctgcccatgttgtgcaagcaaccgatccatgatcgctctgccgccttccggcgtgttttctgctcctttgatgacccagttactgtggtctatgccctgttttttcagcgcctggaggtatccatccagccgatcgctgatgctcggtaactcggcatcgcctgccagaaaccagacgggttttttgcctgacgccagcagattctcggtcagcgtctgactaccttgcgcattttggctttcaaccagcgcgttgttgctgaacctgaaatcgcgatccagtagtaccatcggtttttttacctggcgcagatgatgctgttggttttccagcgaggagggaacaatgaataagccgtctatgttgcgggcgatcagcgctcgtaccagtttgttttcgtactcaatatcgtcataggtacagctgatggttaactggtagccggagcggcgacagcgcaactccagcttttcagccagggtggcaaagaagacgtttgaaatgttcggcacaataaaaccgagcgtgtcggttttattgagtttcagacttcgtgccgaatggttaagtacataaccataacggtctacatactccctgatgcgcgcctgagtctttacgctgatacggtactgctccgcttttccgttcaacactaaccgcacggtcgtgactgacaaattcagttcgttggcgatttgttcgactgttttggccactacagtatgctccggacaggtctttagagaatagtgatgaggccataatagaacgattatcaggcattgtctttatgcatcagtcggttaagcgcttgctgatgttcccacatttgtagataaacctgatatttacggtcatgagaggacttacgcgccggatttgccacaactctgctgccgggcctcaccatctgttgcgtcgccgcggcaagatccgggaatgcctgacaagccaccgcgccggtaatcgcagaccccaaggttacggcatcttcttcctgcaatagatggatatcataacctgtagcatcggcatactcacgcatccatagcgggttatgcgtagcgccgccgcacagcgccagccgcgcaatgatatgcccctgtttctgcatgacctcaataatatggcgtgtgccgtaggcgatggcctgaagcgtggcgaggtactgccgcgccacgcgggattcaccacgttccagctgtaacccgcatatactgccgcgcgcgtctggtcgggcgcggggagagcggttgccgtgatgatcggccagtatgtgcaaatccgctgtgggctcattttcgcgggtttccagcgcggccacccactcgttaaccagcgtaaccggatggtacccacgctgatgagcctgagtaatcagctctgttcctgtgctgcactcttgcaacgtccagtccactaacgcgcccgcagcgctttgcccgccctcggtcagccagtaccctggcaacatggctgaccagtatggcccccatacgccgggcgtcatgatggccgcttcgctacaaatcagatggcagttagatgtgccgcttatcagtgccagggtaccctgaggttgccgtccggttaaggctacgccgccggcatgggcgtcaatcataccgctggcgacgacgacctgcgtagacagccccagcgcctgagccgcctccggcgttaaggttccggcgcgagcggcgggcggcaggatgcgcggcggaattttatccctcagggcttccagcccggcggcagccagcagcgtgtcgctgaaacgctgttcatgagccagatagttccatttgcaggtcagggtgcacaggctggcgacatcctcccctgtggccttccagaccataaaatccgccagatccagtaaacggtgtgcgcgttgccaggtttgcggatgatggttcttgagccaaagcgctttcggcagttccatttcaatactgacttcgccgcccgtatatttaagagcgcgatcgccagtggcattgatcaactgcgtttccctcgccgcgcggtgatccatccacataatgatgttgtgatcgtcagcttcgccaggcgatacggcaagcccgttgccgtttttatcgatagccaccagcgaacaggtggcatcaaaaccaatcgaaactatctgcccggcgtcaaggccagcactggcgacagcctctctaaccgcctcgcaactctgctgccagatctcagcggaggactgctctacccgcgcctcggcgggacgaaactgtgaaatagcgcgagtggcgaaagccagccgctggccgtttgcgtcaaataccccagcgcgcacgctggctgaacctatgtctatgccaaggaaaaaacaggtcgtcattttctgctccagaaagtcagggttacatccctgtggttaaaccgctcgtgaggatcctcacaaaacccggcgaaaaatgttgtgatgaaaatcagaaaaactctatgctaattcgagttagcaaaaggatttgacgccaggggcgttgagggcaatcacatatctgtaaggatgagatctcattatgaaaggtaaaaaggttcttccgaagattggcattcgtcctgtcattgacgggcggcggatgggcattcgcgaatcgctggaagcgcaaacgatgaatatggcgtatgccaccgcgaatctgttgcaggcaaaactgcgtcacgcctgcggcagtgaagtggagtgcataatcgctgatacctgcatcgccgggctgacagagtccgcggcctgtgaggagaaattctcggcgcagaacgtcgggctgactatcaccgtcacgccctgctggtgctatggcagtgaaaccattgatgttgatccgttgcgcccaaaagcgatctgggggtttaacggcacggagcgacccggcgctgtttatctggcgtcagcgttggcggcacataatcagcagggcattccggccttttcgatttacggccaggatgtacatgacagtgacgacaccgccatcccgccggatgtggaagaaaaattgctgcgttttgcacgtgcaggcctgacggtgaccagcatgaagggcaaaagctatttagctttaggcggcgtttcaatgggaattgcggggtcacttgtcgatcatgatttttttgcgtcctggctgggcatgagggtgcagtccgttgatatgaccgaactccgccgccgtatcgatcaacatatttatgatgaagatgaactggcccttgcgctggcatgggcgacggagaaattccgcttcggagaagaccgaaacgcgcagcacaatcagcgtaacgaagcacagcagcgggagatcctgcgggaaagtttactgatggctatctgtatccgcgacatgatgcagggcaatccggtgctggcccgagcaggcttttgtgaagaggccctgggctataacgctgtcgcagccgggtttcaggggcagcggcactggacggatcaatacccgaacggcgacatggcagaagcgctgctgaacagctcatttgactggaatggcatccgccagccctacgttgtggccacggagaacgacagtctgaatggcgtcgcgatgctgatggggcacctgatgacgggcacggcgcagatcttcgctgatgtgcgcacctattggtcgccggaagcggttgaacgagtaacgggcgagacgctcagcggcgtggcggagcaggggattattcatctcattaattccggttcggcggcgctcgatggcaccgcgcagcagacggacatcaaaggaaatcctaccctcaagccccattgggaaatcagcaccacggaggtagacgcctgtcttaatgccactcgctggtgtccggcggtacatgagtattttcgcggcggcggcttttcgtcacagtttgtcacccgcggcggggtgccttttaccatgacgcgcgtaaatatggtgaaagggatcgggccagtactgcaaattgctgaaggctggagtgttgagctaccggaagcgatccatgcggtactggaacaacgcacagacccgacctggcccaccacctggtttgcgccgcgtcttacgggccgtggcccgttccgtgatgtctggtcagtgatgtctggctggggcgcaaatcacgctgtactgacggcgggccatgtcggtgcggatttcattacgctggccgccatgttgcgtattccggtcagcatgcacaatattgaggaggagcaggtgtggcgaccgtctgcgtgggcggcgcacggaatggatccggaagggcaggattaccgcgcctgccgcaactacggaccgctgtacaggcgctaaggaaaagcaaaccggttagccccggtcaggtctggtcggggcttaacgtgccagcagcgcctgttcgatctcaaagcgattcgtcactttgctgtcgattttgatgtatacgctgcgctcatcctgcaccaccagcacctcgctcaccccgggcaacgcgcgtaactgctcgcccagcgtgtcatctgcgggaacatccgccggaatttccacgcgcagactgctgacgtaagccggttcgctcatggtcagggataccagcagccagagggtcgccagcagcgcgccagccagaaataccgtctgcgaatcaaacataccgtccacccaacccgccatcgagccgccaatagccacacccaggaactggctggtggaatagatacccatcgccgtgcctttatagcccgccggggcttctttactgatcaacgatggcaacagcgcttccatcaggttaaaggcgaggaagaagatctgcacgcccagcacctgctcccagaaatgcggcccggcgccccataacacgatttcggcaatcagcagcagcgcaacgcagaagacaaacacccgcttcatgcggcgttttacttccgcatagatgataaagggcaccacgcagacaaaagaaatcagcatggtcgccagatagattttccagtgatccgcggtggcaaagcccgcggcttccagctggccgggcagggcgacgaaggtggacatcagcaaaatgtgcaggcacatgatgccgaaattgagttttaacagcttcgggctggcgataactttgctgaagcagcctttgaccatgcctgattcacggttcagcacatggtttttgctgtccggcaccacccatagcgtcagggcgataccggcggttgccagcgcggcgatcatccagaacagcgcatgcaggccgagcttatgggtgatgatggggccgagcaccatggcgatggcaaaggtcaccccaaaactgacgccaataaacgccatcgctttggtgcggttctgttcgcgggttaaatcggagagcagcgccatcacggcggcggcaatcgcgcctgagccttgcagcgcacggccaagaataatgccccagatcgagtccgacagggccgccaccacgctgccaataacaaaaatagccagcccgccgacgatcagcggtttgcgtccgatacgatcggacaataatccaaaggggatctgaaaaatggcctgcgccagcccataaataccaatggcgaaaccaatcagcgcttcgcttgcgccctgcaaagccataccgtaagtggtgagaacgggcaggaccataaacatgccgagcatacgcaacgagaacacagtccctaaaccccaggtggcgcgtaactcgcctggcgtcattttataatcgttcatttccacctcaaattctaaaaccgggcatagtgtagtgcgggggcagggcagggtaaagcggggtattttacaaataaaaaagggtgccgtagcacccttttaggtattaatgcgttaccagacgtaagtaagcaggctgtgagaatccgggaccataaagtcgacggacatcatcaccgacagcgaggtaatggcgacgatagaaaagacgaacagcttacgcgcccagactttatcatcttccactttataaccacgcagcgccattccgagccaccagacgctcaccgccgcagccaccaccagatatttataaccggcatagccacccagagtgagcatcagcgtcgccacagcgaaggcgatgatatacagcgtgatatggtttttggcaaccgagatgcctttcactaccggcagtaccgggatgttcgccgcctgataatccttaaagcggaaaatcgcgatggcgtaggagtggggcatctgccacaggctgaaaatcgccagcaggatcagcgcgccactgtcaaaatcaccggttaccgcgcagtagccaatcaccggcggcgcagcgccggagagagagccaatcagggtgccataaacggagtggcgtttcatgtacaggctgtaaacgccgacataaaccacaaaccccatcacgcccagccagcaggccagcgggttagcaccaaaccacagcagcataaagccagcaatacccaacaaggtggcatacaccagcgacattttcggcgaaatcaggcccttgaccagtacccggttcttcgtgcgctccattttgcggtcaatatcgcggtcgatgtagttgttaaatacacaaccggatgcgactaccagtgacacgccaatcagcgtagcagcgaaaaggggatagtcgatgctgcccttggaggccagcaggaaccccccgatcacggagatcaggttaccgaaaatgatgcctggtttcgttacttgcaggtattgcttaatcatactcgccgctcttagtgaaccatcatgttgttgttcaggctccacataatccagatggatcctgcaaccactatggcgataatcagcacggtaaagacaaaggccaccaggttccagcgatcctcagaagaggtattcatatgcaggaagcacaccaggtgaaccagaatctgtaccactgccatccccacgacgacgctaaccagcgtggcatgagaagcagtgccgttcattaccatccagaacgggatcaccgtcaggatgatcgacaggataaaacctgtcatgtacgtttttacggtaccgtgagaagcgccgctatgatcggttggatgactcattacattgcccccatcagataaacaacagagaacacacagatccacaccacgtccaggaagtgccagaacatgctcaggcacatcagacgggtacggttagtgctggtcagtccgcgacgggaaacctggaacatcatcagcgccatccacaccagaccagaggtcacgtgcacgccgtgggtacctaccagggcgaagaacccggacaggaagccgctgcgatccgggccgaagccttcggcgatcagatgatggaattcatagatttccatcccaacgaagcccgcaccaaacaggaaggtcagcgccagccaggacagaacctggcttttgttccctttatccatggcgataaccgccatgccgtaggtgatggagctaaacagcaggaggaaagtttccaccagcacgaacggcagttcaaaaatatctttaccgctcgggccgcccgctgtgccgttcaccagaacggcataggttgcgaacagacatgcaaagagaatgcagtcgctcatcaggtagatccagaagccaaagactttattggctcctgcatcgtgatgcccatggtcatgcgcatgagcgccagaatgtgccagagaatcagttgacatttttcagccctgctttgctaatttcatcaaagtgctggttttccagtttctcaacggtcgcgaccgggacgtagtaatccacgtcttcatcgaagctcttcacaatccaggtaatgatgatacctgcgaagcctacgatggccagccaccagatatgccagatcatggcgaaaccgaaaatggtgctgaacgcgccgataaccacacctgcaccgctgtttttcggcatatgaatttcttcataatgcgtcggctgctggtacgcttcgcctttctctttcatttcccagaacgcatcacgctcgtggatatgcggaactacggcaaagttgtagaacggcggcggggaagaggttgcccactccagcgtacggccaccccacggatcgcccgtcaggtcgcggttctggttgcgatcgcgaacagaggtataaatctgcatcacgatgctgaagataccgcaggcaatcaacagcgcgccgatttcagccacaatcatcagcggttcgaacatcggatcgatgtcctggctaacgcgacgggtcatacccatgaagcccatagcgtacagcggcataaaggttacgaagaagccgatgatccagaaccagaatgcacgtttgccccaggcttcgttcatggtgtaaccgaaggctttcggccaccagtaggtcatacctgcgaagcaaccgaacaccacgccaccgatgataacgttatggaagtgcgccaccaggaacaggctgttgtgcagtacgaagtctgcgcccggcacggccagcagcacgcccgtcatcccaccgatagagaaggtgacgatgaagccgatagtccacagcatggaagagtggaactggatacggccctggtacatggtaaacagccagttgaagatcttcaccccggtcgggatggcgataatcatcgtggtgataccgaagaaggcgttaacgttcgcaccgctgcccatggtaaagaagtggtgcagccagacgatgaacgacagtacggtaatagcgatagttgcccataccagcgaggtataaccaaacagacgctttctggagaacgttgccgtcacttcagagaacacaccgaacactggcagaacaagaatgtacacttccggatggccccaggcccaaatcaggttcacgtacatcatcatgttgccacccatatcattcgtgaagaaatgggtgcccaggtagcggtccagggtcagcagggctatcgtcaccgtcaggatcgggaaggagacgataatcagtacgttagtacacagcgacgcccaggtgaacacaggcattttgaacatcgtcatgcccggcgcacgcatacgcaggatggttacaaagaagttaataccggtcagcgtagtaccaataccggagagctggagactccagatccagtagtcgaccccgactcccggactgtactcaatgcccgacagtggcggataagcgacccaacccgtctgcgcgaactcgcccacacccagagaaacgttcaccaggattacgccgacaacggtgaaccagaagctcaggttgttcaggaacgggtaagcaacatcgcgtgcgccgatttgcagcggcaccacaatgttcatcagaccgataacgaacggcatcgccacgaagaagatcatgataacgccgtgggcggtaaagatctgatcgtagtgatgcggtggcaagaagccctgttcgcccgcggacaccagcaactgctgggtacgcatcatgatggcgtcggcaaagccacgcaccagcataacgatagcgacgaggatatacataatccccaggcgtttatggtcaacggaggttaaccattcgttccataagtaagaccacttaccgaagtaagtgagtgcggcaaccagcgccagaccaccgacgaggattgctgcaaccgtaaccatgataatgggttcatggtacggaactgcatccagtgttaattttccgaacatcgtattattcctcagccccttaatgagaggtttgggcgtgactcatgtccatgccttccataccttcatgagaactgtgttccccttccggctgcgtcacgtccatgcttttcccgtgagacataaatttgccaataacatctttaaacaaattcggtttcacgctggagaagtattcaaccttgttatattcgctcggagccgcaactttctcgtacgtcgccatatcgttcatgactttcggagactgtttcgctttggcaacccaggcgtcaaaggtggcgttatccggcgtagcaatagctttgaacttcatgccggagaaacctgcgccactatagttggaggaaataccatcataggtgccggcttcgttggcaatcaggtgcagcttggtctgcatcccggccatcgcataaatctggctacccagacgcggaataaagaaggagttcatcaccgagttagaggtgattttgaattccactggcgtgttcgccgggaaggcgatttcattcaccgtagcgataccctgctccggatagatgaagaaccatttccagtccatagcgataacttcgatggtcaccggcttagcatcgtgatcaagcggtctgcctggttctaatgcatgcgtggttttccatgtcagtacagcaaggaaaataatgattaagatggggatggtccagacaacagcttcaactttgttcgagtgcgaccagttggggctgtatttggcatccttattcgacgcccgatacttccaggcaaagccgatagccatcacgatagcggggatcacgacaatcaacatcagcccaagagctgtcagtatcaaggaacgttgttccagtccgatctgtcctttggggtccagcagtgctgaatcacaaccactgagtaaaacagtgcctgcaattaacgaaagcagtcccaaacttttattgtatttcctgagtctcatttaacgacctcaattccacggggatcaggtggcgtttaaagtgtgcgggcattttacgggaaggttacattactgtaaacatgaatggcgcggtgtcagcgaggtgtaaccgggttctgccgcgcgcgtcacatagaatgcaacaatctgtaaaaattcgcgatcgcctaagttacacctatgttagaacaaaactccgtcctccagttaattgatcaggttaattggtataaccaatcaattttaagtacaaattattaacattgaatcagcatttatagaacattacttgaaagaaataattcataacggtgctgaatcgtttaagaatagtcattattttaaaccgcacaaaataattaaagaaatttaagtttgcacgaatgaataatgccgactaacagcgattttatcgttcgatatttaatcaaaataataactcaggggaattaaacctgaggttaaccggttcagatcagacgagttttgcgcagggcgaggtagtcaagaacgcccccatagaggatacctgccgttgccagcagcgccccccattccagcagttgcaggccgaatgtccaggcggtaaggccggaagcgttaagaagcaaaatgaccagccaggccgcgatcagggcacagccgaccgccaggatccgcaacgccagccggtaggccgtggcatattcagtacgtggaaggaagctgtccgtttgctgggtaaacgcaagcgtctgcttacagaccagcagcaggagcaggccgggaagggcggcaaagaccgagaacagataaaaggttgaccagccatgcgcctcgacaaaccagccggcgaggggaccgacgtatacccgacccacggcagacagggcagagagcagggcaaactgcgtggcggaaaaggatttattgcacagtgtcatcaacagcgcaacaaaggcggcggtgcccatgccgccgcacaggttctcaaagaacaccgccgctgccatgctgtagatatgtttgtcggtgatggagagccaccagtaaccggcattagatatgccctgcaacacgccaaagatcagcagcgcgcggaacagcgtcaggcgctgcatcagtacgccgccgtacagcgcgcccacaatggtggcaatcaagcccagcgtcttattcaccaccccaacctcaccggcttcaaaaccaacgccgcggatcagaaaagtggtggtcaggctcatggcgaaggcatcgcccagcttataaaggacgatcagcagtaaaatcagccaggcgttgttacggccaaagaaatcacgcagcggcgcgacgaccgcctgttcaagggatttcggcaccggaataacgtccgtgggttccggggccagcagggtggcaatgatgcagggaataagcagcgccgccatcagccagtacataccctgccagccaagccatttatccgccagccacagcgccagtccgccggagaccagcatcccgaggcgataacccagcacgctgatggccgcacccgcgccgcgttcctctgcaggtaatacatccgttttccaggcatcgaacacaatgtcctgggaggcggaacaaaacgcgatcaccaccgccagcgccgccatccagcgcaactggctgaccggctccagaaagcccatcgcagcaatcgccaccagcagcaaaatctgtgtggtcagcagccagccgcgccgccgtcctaaaaatggcggcgtatagcgatccattaccggcgaccacaggaacttaaagacgtaggcctggccgaccagcgagaagaaaccaatggttttcagatcaatattctcgacggtcatccacgcctgcagggtgcccgaggtcagggcaagcggtaaaccggaggcgaagcctaagatcagcaggatcgctgattttggttgctgaaaaatgcgcagatagtggctggacataagagggacgctgacccgactgctgccgggtcagcgggcagaattaacgcgcgttctgtttaatgaattcgtggatgctcacgtcctgagacatgtccgcgatggtatcggtcagcacgctgttaaccgcgttagcaatgttctcgttcttggcggtgaacgcaccttcaacggagtagctggcgcgatagtttttggtcatcttgttgccattagccgcggtggcgataatcgcgatgtcggctttggtggcgatgttgtagcgcacgttaccctgcgacacatcggcatacagctgattgacaataatctgcaggttcaccgcaccgttcgggccaaccatgtaaccgcgggcggtcatctgtttttcgagtacttcctgcaacaggaaacgcagatcgcgtgtagcggtcagagtgactaactggttgtcacgggtgactttagccagtgcctgatcctgacgctgatcggcgccgttaatgctcacggtcacgcccatcaggctcgggtcctgctgcggcagcgtaattttcggtgaaacgtcaatggtgtttggcggtgtagcgcagcctgcgagcataaacagggcgaccagcgggaaaagcagtttttttaacatgtcgggggctctcggaagatcggatgcttataagagaataattgtcgccatcataacattgccaacggccggggcaaccagggaacgcatgtaaattcatcgtcttgtctgttttctgaccaccgaagacttttctgcccgcctgaggggggccggagcataactttgtctgttgagttaatgcctttgaatgagaaaaggtcacaaaagctaaataattgtttttttggtgtaatgaaagtggtaaaagcggctaacatttaaagggatgggtgatctctggacgctgtcagaggagtaaaatcatgatgatgcgtgaccaaatcgaatcaaaattaagggccgcgtttgaacccgcgtttctcgaagtggcggatgaaagctatcgtcacaatgtgccggctggttcagaaagccattttaaagtcgtcctggtgagcgaccgtttcaccggtgagcgtttcctgacgcgtcatcgtatgatttacagtacgttaacggatgaactggcaggatcggtacacgccttagcgctacatacctataccattaaagagtgggaaggattacaggatacggttctggcctcgccgccatgtcggggcgccggaaccatcgcctgataaatggaatttgcaactgctggaacttttccagtatgttgcgtacagaatatgtgaaaacggcctgcgggccgttttgttttgcctgagttttgtccggtttgtgccaaattcagacaaaaattagccgggaattgtgaaaaatgccgatccggcacgcaataaccgttctcgactcataaaagtgatgccgctataatgctgcgtcttatttttcggaatgtcttcgggatgattctggtgacagggaatgtatatctgattcaagagaacatcccggtactgtgaagccaaacttacacgcgcttccagagttgaccgagcactgtgattttttgaggtaacaagatgcaagtttcagttgagaccactcagggccttgggcgccgtgtaacgattactatcgctgctgacagcatcgagaccgctgtgaagagcgagctggttaacgtagcgaagaaagttcgcatcgacggcttccgtaagggcaaagtaccgatgtccgttgttgctcagcgttatggcgcatctgtacgccaggacgtgctgggcgaactgatgagccgtaactttgttgatgcgatcattcaggaaaaaatcaatccggccggcgcgcctaactatgtgccgggcgaatacaaactcggtgaagacttcacttactctgttgagttcgaagtgtatccggaagtgaagctgtccggtctggacaccatcgaagttgagaagccggttgtagaagtgaccgaagctgacgtagatggcatgctggacaccctgcgtaagcagcaggcgacctggaaagaaaaagacggcgctgtagaagctgaagaccgcgtgaccgttgatttcaccggttccgtagacggtgaagagttcgaaggcggcaaagccactgatttcgtactggccatgggccagggtcgtatgatcccgggcttcgaagacggtatcaaaggccacaaagcgggtgaagagttcactatcgacgtgactttcccggaagaataccacgctgaaaacctgaaaggtaaagccgctaaattcgtcatcaacctgaaaaaggttgaagagcgcgaaatgccggaactgaccgaagaattcatcaagcgtttcggcgtagaagatggttctatcgaaggtctgcgtgctgaagtgcgtaaaaacatggatcgcgagctgaaaggcgcggtgcgtaaccgtgtgaaaactcaggctatcgacggtctggttaaagcgaacgaaatcgacgtgccggctgcgctgatcgacggcgaaatcgacgtactgcgtcgtcaggctgcacagcgtttcggcggcaacgagaaacaagcgctggagctgccgcgtgaactgttcgaagaacaggctaagcgtcgcgtagtggttggcctgctgctgggtgaagttatccgtacccatgagctgaaagctgacgaagcgcgcgttaacacgctgattgaagaaatggcgtctgcctacgaagatccgaaagaagtgattgagttctacagcaaaaacaaagagctgatggacaacatgcgtaacgttgcgctggaagagcaggctgttgaagccgttctggaaaaagcgaaagtgactgagaaagccacttccttcaacgagctgatgaaccagcaggcgtaagtttcgccattacgtacataacgtaaccagaagcccgtcactttgctgtggcgggcttttttttatcatccagactttttaggatgagtgctaaaagcgcgtttcagtgttagcgttaagccaaaagcttgttatgcttgaaataaggcgtagccatccccattacagggagactgtcagaagtgttcttgctgaatatccgtccagggtggtcgtagtcagaccagtcatactcaagtagaatcggtccagcaggtttatttattttttatccaggagacggacatgtcatacagcggcgaacgagataactttgcaccccatatggcgctggtgccaatggtcattgaacagacctcgcgcggtgagcgttcttttgatatctattcccgtcttcttaaggaacgcgtcattttcatgaccggccaggtcgaagaccacatggctaacctgattgtggcgcagatgctgtttctggaagcggaaaacccggaaaaagacatttacctgtatattaactctccgggtggtgtgatcactgccgggatgtcgatttatgacaccatgcaatttattaagccggacgtcagcaccatttgtatgggacaggcggcctctatgggcgcattcctgctgactgcgggcgctaaaggcaagcgtttctgcctgccgaattctcgcgtcatgattcaccagccgttgggcggctatcagggccaggccacggacattgaaattcacgcgcgtgaaatcctgaaagttaaagggcgcatgaatgaacttatggcgcaccatacgggtcaatctttagaacaaatcgaacgtgataccgaacgtgaccgcttcctctccgctccagaggcagttgagtacggtctggtcgactcgattttgacccatcgtaattaatgctcaggccagacgtgtaccgctataatcagtaagagcggcactacgccaggcagcattttgcgcctggattggcatttgcgtcgtcgtgtgcggcacaaagaacagataagaggtttttactcatgacagataaacgcaaagatggttcgggcaaactgttgtattgctctttttgcggcaaaagccagcatgaagtgcgtaagctgattgccgggccgtccgtgtatatctgcgacgaatgtgttgatctgtgtaatgacatcattcgcgaagagatcaaagaagttgcgccgcatcgcgagcgtagcgcgctgccgacgccgcacgaaatccgtcatcatctggacgattatgttattggtcaggaacaggccaaaaaagtgctggcggtggcggtttacaaccactacaaacgtctgcgtaacggtgataccagcaacggtgttgagctcggcaaaagtaacattctgctgatcggcccgaccggttccggtaaaaccctgctggcggaaacgctggcgcgcctgctggatgtgcccttcaccatggcggacgccaccaccctgaccgaagccggttacgtgggtgaagatgtggaaaacatcatccagaagctgctgcaaaaatgcgattacgacgtgcagaaagcccagcgcggtatcgtctatatcgatgagatcgacaagatctcccgtaagtctgataacccgtccatcacccgtgacgtctccggtgaaggcgtgcagcaggcgctgttgaaactgattgaaggcactgttgccgccgttccgccgcagggtggacgcaagcatccgcagcaggaattcctgcaggttgatacctccaagatcctctttatctgtggcggcgcatttgcgggtctcgataaagtgatctcccatcgtgtagaaaccggctccggcattggttttggcgcgacggtgaaaggaaaatcagagaaaccgcaggaaggtgagctgctggcgcaggttgaaccggaagatttgatcaaatttggtctgatcccggaattcatcggtcgtctgccggtggtcgctacgctgaacgaactgagcgaagaagcgctgatccagatcctgaaagagccgaaaaacgccctgaccaagcagtatcaggcgctgtttaatctggaaggcgtggatcttgagttccgcgacgaagcgctggatgccatcgccaagaaagccatggcgcgcaaaaccggtgcccgtggcctgcgctccatcgtagaagccgctctgctcgacaccatgtacgatttaccgtccatggaagatgtcgaaaaagtggtcatcgacgagtccgttattgcgggtcaatccaaacccatgctgatgtatggcaaaccggaagcgcagcaagcttctggtgaataaatcgccaaaacatacagtcagttaataaaaaaggggggattttatctccccttttatttttcctgttccctgacgttgaatgtccgggaaacatccccatatactgacatacatgttaatggttgcgtgaagcacagtcatgccacctgattaccctggcggacactaaactaagagagagctctatgaatcctgagcgttctgaacgcattgaaatccccgtattgccgctgcgcgatgtggtggtttatccgcacatggtcatacccttatttgtagggcgggaaaaatctatccgttgccttgaagccgccatggatcatgataaaaaaatcatgctggtcgcgcagaaagaagcctcaacggatgaaccgggtgtaaatgatcttttcaccgtcgggaccgtggcctcaattttacagatgctgaaactgccggacggcaccgttaaagtgctggtcgaaggtttgcagcgcgcacgcatttcagcgctgtctgacgacggtgaacacttctccgcgaaagccgagtaccttgaatcgccggccattgacgagcgcgagcaggaagtgctggtacgcacggccatcagccagttcgaaggctatatcaagctcaacaaaaaaatcccgccggaagtgctgacgtcgctgaacagtatcgacgatcctgcgcgtctggctgacaccatcgccgcgcacatgccgctgaagctggcggacaaacagtccgtgttagaaatgtccgacgtgaacgagcgtctggaatatctgatggcgatgatggaatcggaaatcgatctgttgcaggttgagaagcgcattcgcaaccgcgtcaaaaaacagatggagaaatctcagcgcgagtactatctgaacgagcaaatgaaagccattcagaaagagctcggcgaaatggacgacgcgccggacgaaaacgaggcgctgaagcggaagatcgacgcggcgaaaatgccgaaagaggcaaaagagaaagccgaagcagaactgcaaaagctgaaaatgatgtctccgatgtcggcggaagcgacggtggtgcgtggttacatcgaatggatgatccaggtaccgtggaacgcgcgcagcaaagtgaagaaagatctgcgtcaggcgcaggaaatcctcgacagagaccactatggtcttgagcgcgtcaaagaccgcatccttgaatacctcgcggtgcagagccgtgtaaacaaactgaaagggccgatcctgtgcctggtagggccgccgggggtgggtaaaacctcgcttggtcagtccatcgcccaggccaccgggcgtaagtacgtgcgtatggcgctgggcggcgtgcgtgacgaagcggaaatccgcggacatcgccgtacctatatcggctccatgccgggcaaactgatccagaaaatggcgaaagtgggcgtcaaaaacccgctgttcctgctcgatgagatcgacaagatgtcgtctgacatgcgtggcgatccggcatcggccctgcttgaagtgctggatccggaacagaacgtcgccttcagcgatcactatctggaagtcgattacgatcttagcgacgtgatgtttgtcgccacctcgaactcgatgaacattccggctccgctgttggatcgtatggaagtgatccgtctttccggttacaccgaagacgaaaagctgaacattgcgaagcgtcacctgttgccgaagcagattgagcgtaacgccctgaaagatggcgaaattacggttgatgacagcgccatcatcggcattatccgttattacacccgtgaagcgggcgtgcgtagcctggagcgtgaaatctccaaactgtgccgtaaagcggtgaaacagctgctgctggataagtcgctgaagcacattcacatcaccggcgacaacctgcatgaattcctcggcgttcagcgtttcgactatggtcgtgccgatgatgaaaaccgcgtaggtcaggtaaccgggctggcgtggacggaagtgggcggcgatttgctgactatcgaaaccgcctgcgtaccgggcaaaggcaagctgacctataccggctcgctgggcgaagttatgcaggaatccattcaggccgcgctgaccgtggtgcgcgctcgtgcagaaaaactgggtatcaaccctgatttctacgagaaacgcgacatccacgttcacgtaccggaaggggcgaccccgaaagacggcccgagcgccggtatcgcaatgtgtaccgcgctggtttcctgtctgaccggcaacccggtgcgcgctgatgtggcgatgactggtgaaatcaccctgcgcgggctggtactacctatcggcggtctgaaagagaaactgctggcggcgcaccgtggcggcatcaaaaccgtgctgatcccggacgaaaacaaacgcgatctggaagatattccggataacgtgattgccgatctgaagatccacccggtgaagcgcattgaggaagttctgactcttgccctgcaaaatgagccgtctggcatgcaggttgtaagcgcaaaatagtgacctcgcgcaaagagcactaagaaaaacaaggctggcagcgcatttcgggcttgccagcctttttttgtatagctaatttagattgctgcctggatgtgtcatcatcaactgatgttgtaagggcatgacaggcctgatataactgctgcgcggtcgctctgtgaaggattcagtgcgatataaattataaagagaggaagagaagagtgaataaatctcaactgatagacaaaattgctgcaggggctgatatctctaaagctgcggctggacgtgcgttagatgctttaattgcttctgttactgaatctctgcaggcaggggacgaagtggcactggtaggttttggtacttttgctgttaaagagcgtgctgcccgtactggtcgcaacccgcaaacaggcaaagagatcaccatcgccgcggctaaagttccgggtttccgcgcaggtaaagcgctgaaagacgcggtaaactgagcgcgatctccaaagggattgtgaaaaagtacaagggcgcatcaaccgatgtgccttttttatttgtgattgcccaattaatcggccccggtgggctgacatttacccccgtttcttgtcacaatacgggtttgcgcgcggcggcaggataagcagtgttgcgtgggacctcaagtcatctacagcggagtgttgctacaccatgatggacaatttacgcacggcggctaatagcgttgtgatcaaaatcattttcgggatcattatcgtgtcgttcattctgaccggcgtgagtggttatctgattggcggcggtgatagctatgccgcaaaagtgaatgaccaggaaattagtcgcggacaattcgaaaatgctgttgcaggcgagcgtaaccgtatgcagcagcagttgggtgaacagttctctgaactggccgctaatgaaaattacatgaaaaccatgcgtcagcaggtgctggatcgtcttatcgacgaagcgctgctggatcagtatgcccgccatcttggcctcggcatcagcgatgagcaggtgaagaaagccattttcgcgaccaaagctttccagaataacggcacctttgacaatacccgctataacgcgctgattaaccagatgggcatgaacgccgatcagtatgcgcaggcgttgcgtaaccagatggtgtctcagcagctgattaatgccattgccggtaccgatttcatgctgaagggtgaaaccgacgagctggctaccctggtggcgcagcagcgtatcgtgcgcgaagcgatccttgatgtgaatgcgctggccgcgaagcagacggtgaccgatcaggaaatcaccagctattacgagcagaacaaaaacagctttatggcgccggaacagttccgcgtcagctatatcaagctggatgctgcaaacatgcagcagaatgcgagcgatgccgatattcaggcgtactacgaccagcatcaggatgaattcacccagccgcagcgtaaccgctatagcgtgatccagaccaaaaccgaagacgaggcgaaagctgttctcgacgccctgagcaaaggcgcagacttcgcccagctggcaaaagagaaatcctccgacatcatctctgcccgtaacggcggcgatatgggatggctggaaccagccaccacgccggatgagcttaaaaatgccggtctgaaagaaaaaggccagctgtctggcgtgatcaaatccagcgtaggtttcctggtggtgcgtctggatgatattcagcctgccaaagttaaaccgctggcggaggtgcgtgacgatctggccgcgaaagtgaagcaggaaaaaggccttgatgccttctacgcgctgcaacagaaagtgagcgaagcggcgagcaacgacaacgtctccctgaccggcgctgaacaggccgcaggcgtgaaagccgtggaaaccggctggtttggtcgtaacaacctgccggaagagctgaacttcaaaccggttgccgatgccatcttcaatggtggtctggtaggggaaaacggcacgccgggcagcaactctgacatcattaccgtcgacggcgatcgtgccttcgttatccgtgtcagcgagcataagccggaagccgtgaagccgctggatgaagttaaaacgcaggtgacggatatcgtcaagcacaacaaagcgcagcagcaggccaaactggatgctgacaagctgctggccgccctcaaagccggtaaaggtgatgaggcgctgaaagccgcaggtctgagcttcggtgaagcgaaaaccctgacccgcaccgggcaggatccgctgagccaggctgcctttgcgctgccgttgccagccaaagataagccgtcttacggcgttgccagcgatatgcagggcaacgtggtactgctggcgctggatgaagtgaaagcgggcaccatgccggaagagcagaaaaaagcgatggtgcagggtatcacccagaacaatgcgcaaatcgccttcgaagcgctgatgagcaacctgcgcaaggaagccaaaatcaaaaagggcgacatcgttgatcctcagcaataacgaggcgcttcgcatctttttgtaacccactgcaatattcaaaggccgcttacgcggccttttccatttctgaagcttgctgtttgcacccgtttagccgcctgtttatcgtgaggtggctgtcaacaaacaaggagataacagcatgaaacgtggaatcaatgccctcatttttactctcggcctcgcctgtgcaggcatgacacagagcacgcttgcggcgactgcaagcgctaaaccggcggcgacgcaaacgaaagcagacgccaggccggacgcgcaaaaccttacccaggcaaaggagacggcaaaagccggcgatgaggaaagtaccagggtcagcattaacgccgcttctgccgacgatctggcccgtgtcctcaacggggtagggctgaaaaaagcccaggcgatcgtcagctatcgggaggaatacgggccgtttaaaacggtggaagatcttaaacaggtgccgggaatgggcaatgcgctggtggaacgtaaccttgaacgtttaaccctgtagtttttggggttgcggagtcgctaaattttgccaggataaagaggtcataccagtgatgacctctgttcctggaaaaaaataaaaggttaaggcgctatgcagactcaaatcaaagttcgtggatttcatatcgacgtctaccagcatgtgaacaatgcccgctatctggagtttctggaagaagcccgttgggagggcctggaaaacaccgacagctttcagtggatgtccgcccgcaacatcgcttttgtggtggtgaacatcaatatcaattaccgccgaccggccgtgctgggcgatctgttgaccatcagcagccacctccagcaactgaacggcaaaagcggcgtgctaagtcagacggtgacgctggagccgggaggggacgtcgtcgccgacgcgcaaatcacttttgtttgtatcgacctgaaaacccagaaggcgctggcgctggaaggagagttgcgggacaaattacaggcgttgatggagtaaggccgggcttgatgccgggtggcgctgtcgcttacccggcctacgtgggcaatgccgttgtaggcccggcaagcctgcgccgccgggcaacaggtacgaacgcaggccttacgccaggcccgtctttttcttcatcgccgccatcacgcccgctttatccgccaggtagtgattcagaccgttagcgcgcaggttacaggcggcgcactggccgcaaccgtcgcccttaatgccgttgtagcaggtcagcgtctcgttgcggatcaaatccagtttgccccagcgatccgccagcgcccaggtttccgctttgtcgagccacatcagcggcgtctcgaagcgaatatcctttgccatgccaagattaacggcatgattgagcgctttcacgaactcatcacggcagtccgggtagccggaaaaatccgtctcgcacacgccggtaatgaccgcttccgcctgtacctgatacgcatagatcgcggtcagggttaagaacagaatattgcgccccggcacaaaggtattcgggataccgctggcgtctggctcatagtccggcaccgggatgctgtcgcgggtcaggctgctgaccgccagttcattaagcagggtaacatccagcactttatgcgcacgcgcccccagtttcagcgccagttcacgggcaacgtcgatttcggcgcgatgacgctgaccataatcgaaggtgacacagtggacttcatcatactgctgtaacgcctgcaccagacaggtagtggagtcctgacctccgctaaagacgacgacggcacgtttcataattcttcccgattgcatgtaaaacactatggtagcgtctgcggcagtgcgcgaccagcttcttcacgcgccggggcgggtagccaggcctcggtaaaatcaaaccagccgcgggtgttcaggcggatcccctgcacgccaggcggggcgctgatctgatactgatagttaaacagcggcgtcagcaccgcctcgtccattaatccgctgaatacatcctgcaaatccgcgcagcgcgcctgttcattcggctgacgctgcaccgcatccagcgtggcctggagatgggcaaagcgagaggcgggtaacagattgggccacagcggatcgcagcgtaaccattgctccagagtatattccggcgcttcgccgatcagcctgtcgcccatcatcaggtcagcagttgcaagcccgctacagttatcccagttcttcgcatcatgaaaaattaccgtcagttcacagcccagcccggcaagatagcgcttaagctcctccgccatggtgtgcagttccaccggcaggtgatacagcagcgtcagtttttccggcagcgccaccttttcctccgcccagtgcggcatcgcccagccgggcagtaattcccggctgggggtgatcaggttttcatccagcggcagggtctgtagcaggccgctctgatggacgatctgcaccagtcgccgcgcctgtgcctggctcagtctttcactgatacgccgggcgagataacaaaacccgaggctgatgccgctgctgacctgccgcaggtggatcagttcatccggcttgccgatggtgatctgcaccggatggcgacaactactgcccagatcctgctcgaacagttgcggggtgatccagtattccaccgcctttagcagcggatggctgaggtgataatgctcatggctttccaggcgcaccagttccgggctgaaggaggccagccggaaaggaccggtgcccaccagcggatgctgcggatgggccagacggctgccgtagcttgccagacggtgcgccagccagtgatccggctgatgcagcgtgaacagcagacagtgcgggtgcggcaccgcgatctccgccacgctgttaaacagcctgcgcagatcgggcagcgtcagcagatgctgcaaacgcatctgcaattgttgggcgttcaccgcatcgccattatgccagtgcagggtggtgcgcagatgaaaacgccagctcaggccatcggccgacacctcccagtggtgcgccaggtcgctctgcggcaaagggttatcggtaataaagcgcgtcaggccggaaaagatctgcccggccagatgctgctcggcgcgccccggcagaaagcccggatgcagcggctccagagggcgataatagggaatgcgcagagtaggtgagtcgttttgccacaggccgcccagaaaaggatgcagcagattgcgcagcgcctccggcggcagttgcgccagcgccagcgcgctgtgctgctgtccctcattcagggcctgctccagcagcgcattgcgcagcgatcctggcgtgacgtgaaaatgcagcacgccacgttttccacgccccgactgcgcctgccagctcagccagccggacgcctccatttgacgtaacagggtacgcatatggcggtcgctgcaaaaacagcgctctgccagccccgccacgctggcgtgctgcggttcgccatcggaaaactgccacaggcgctgatactgattaagtcgatttaactggcgcataaacccggaacaaatatcctgaagtattcactattacttccgtatatctcaggcaatactggtacacaagtttccgcatcacaaaaccgggataattatggcgcgactggctgcatttgatatggacggcaccttactgatgcctgaccaccgtttaggcgagcaaacgctggataccctgcgtcgtctgcgcgaccgggatattacgctggcgttcgctaccggccgtcatgcgctggaaatgcgtcatttgctggggatgattacgctggaggcgtatctgatcaccggtaacggcacgcgcattcactcgctggagggggagctgctgcaccgtcaggatctcagcccggacgtcgccgaacaggtgatccaccgtcagtgggatacccaggcgagtctgcacgtgtttaacgacagcggctggctgaccggagaagagatgcctctgctgctcgatttccatatttacagcggctttaaataccgggtggtggatctcaaagcgctcagcccgcacgaagtgaccaaaatctgtttctgcggcgatcatgaggatctggagcgtctgcgcattcagctgcacgaggcattaggcgatcgcgcgcatatctgtttctcggcctttgattgtcttgaggtgctgcctgtgggctgtaataaaggcgcggcgctggcgatcttaagcgatcggctggggatcgccatgcaggactgcatggcatttggcgacgcgatgaatgaccacgaaatgctcgccgccgtcggacgcggcatgattatgggcaacgccatgccgcaattgcgcgcggcgctgccccatttaccggtgatcggacactgtcagaatcaggcggtgtcgcactatttaacgcattggctgaccacaccacatcttccttattcccccgaataatgagcattgtcagcaagccgggtccgtttaaacccggctttttttacgccagtaaacgggcgatttccgctttccacggcgtcacatcgccgatattcgcctgcacccattccgcattgtaataggtgtcgagatagcgctcgccgctgtcgcacagcagggtgacgatagaaccggtctggcctgcgtcgcgcattctggccgccagcgtcagcgcgccccacatattggtgccggtggacgcacccactttgcggcctaactgcgtttccagccactgcgcggtggcgacgctggcggcatccggcacgcgcagcatctcatccaccacatccggcacaaacgacggctcgacgcgcgggcggccaataccttcgattttactgcccaccgggctgcgcaaagtgctatcgcgggtttgccagtaatccataaacaccgagttttgcggatccaccaccatcagttgagtatcgtagccctggcagcgcaggtagcggccaatggtcgcggaggtgccgcccgtaccggcgctcatcacgatccacgttggctccgggtgcggttcgctctgcatctggcggaagatgctgtcggcgatattgttattgccgcgccagtcggtggcgcgttcggcataggtaaactgatccatataatggccgtgcagctcccgcgccagcatctcggaagcggcgtagatctcgcaggctctctccacgaagtgacaacgcccgccgtagaattcaatctgctcgattttgcgcttcgccgtacaggacggcattacggcgataaacggcaggcccagcagacgggcaaagtaggcttccgacaccgccgttgagccggaggatgactcaataatcggcgtgccttctttgatccagccgttgcacagaccgtataaaaacagggatcgcgccaggcgatgcttcaggctgccggtcgggtgggtgctttcatctttcaaatagagctgaatacccggaaaacccggcagcgccagacggataaggtgagtatccgccgagcgttgataatcggcattgatttcactgatagcatgtttaacccaggtgtttttcatggcgcggatccgtttgtcattttgtgcccagcttagcggaaagcacggaaaaaattgttgctttatgacctttgaaatagactttaaggagaaagaaattctcccggagggggcaatgctagataaaattgacagaaagctgctttcattactgcaaagcgactgcaccctctctttgcaggcgctcgcggatgccgttaatctgacaaccactccctgctggaaacggctgaaacggctggaagacgacggcgtgatcaaagaacgggtcgcgctgctggatgcggaaaagctcggcctcgggcttacggcctttgtgctgatcaaaacccagcatcacagccgcgactggtactgccgctttgtctctgaggtcaatgcgctgcccgaagtgttaggtttctggcgcatggccggcgaatacgactaccttttacgggtgcaggtcgccgacatgaagcgctatgatgatttctataaacggctggtgaacagcgtacctgggttgtccgatgtgacctccagtttcgccatggaacagataaagttcaccactgcgttacccattgaataactctcccggcccgaagcaccaccgccggaaaatcacgttcaggaaatgaccgcgtgcgattatttgctcaattaagctggtactttcgccgggaatggcgacgctatctcggtgctgtagccctgcttatctttattgccatcctgcagcttatcccgccgaaagtggtgggctatgtggtggatggcgtgacgcaacaacattacaccaccagccgggtgctgatgtggatcggcctgctggtgggggtggcgattgtcacctacctgctgcgctacgtctggcgcgtgctgcttttcggcgcctcctaccagctcgccgttgaactgcgtgaggatttttaccgccagctcagccgccagcatccggagttttacctgcgccatcgcaccggcgatttaatggcgcgcgccactaacgatgtcgatcgcgtggtgttcgccgccggggaaggggtgctgacgctggtggattcgctggtgatgggctgcgtggtgctggtggtgatgtcgacgcaaatcagctggcagctcaccctgctggcactgctgcccatgccgatcatggccattgtcatcaagcgctacggcgaccaactgcacgagcgctttaagctggcgcaggcggcgttctcctcgctcaacgaccgtacccaggagagcatgaccagcatccgcatgatcaaggcttttggcctggaagatcgccagtcggcgctgttcgccgccgatgccgccgacaccgggcgcaaaaatatgaaggtcgcccgcgtggatgcgcgttttgatccgacaatttatatcgccatcggcatggcgaatctgctggccattggcggcggcagctggatggtggtcaacggctcgttaaccctcgggcaactgaccagctttatcatgtatctgggactgatgatctggccgatgctggcgctggcgtggatgtttaacatcgtcgagcgcggcagcgccgcctatacccgcatccgcgatatgctggcggaggcgccggtggtcaatgacggcagcgaatccctgccggacggacgcggcgagctggcggtgaccattcgcgaattccgctatccgcaaaccgacagcgccacgctgaacggcgtcaatttcacgcttaatcccggacaaatgctcggcatctgcggcccgaccggcgccgggaaaagtaccctgctgtcgctgatccagcgccatttcgatgtcgatcagggtgagatcgcctatcacggtattccgctgccgcgcctgaagctcgacgcctggcgcagtcgtctggcggtggtgaaccagacgccgtttttattctccgataccgtggcgaataatatcgccctcggcaagcctggggccacgcagcaggagatcgagcacgcggcgcgtctggccagcgtccatgaagacattctgcgcctgccgcagggctatgaaaccgaagtgggcgagcgcggcgtgatgctatccggcggacagaaacagcgcatttctattgcccgcgcgctgttgctcaatgccgagatccttatcctcgacgatgcgctctccgccgtggacggtcgtaccgaacacgagatcctgcacaacctgcggcagtggggagaagggcgcacggtgatcatcagcgctcaccgcctgtcggcccttaccgaagccagtgaaattctggtgatgcagcacggacatgttgctcagcgcggtcatcacgaccagctgtcgcagcagcccggctggtatcgcgacatgtatcgctatcagcaactggaagcggcgctggatgacgcgccggaagaaaaagaggatcctgccaatgcgtagttttgggcaactgtggcctacgctcaaacggctgctagtgtatggcaaaccctggcgtaaacccctgacccgcgccgttgttatgctgtgggtggcggcgattgccgaagtctccggcccggcgctgatcagctattttatcgataacatggtcgccaaaagttacctgccgtgggggctgctggcgggcatggcggccgcctatatcggcctgcaactgctggcggcgggactgcactatgcgcagtcgctgctgtttaacgaggcggcggtgggcgtggtgcagcaactgcgtaccgacgtgatggacgcggcgctccgtcaaccgctgagcgccttcgatacccaaccggtggggcagttgatctcccgggtgaccaacgataccgaagtgatccgcgatctctacgtcactgtggtggcaaccgtgcttcgcagcgcggcgctgatcggcgcgatgctggtggcgatgttcaccctcgactggcgtatggcgctggtggcggtgaccattttcccggcggtgctggtggtgatggcgctgtatcagcgctacagcacgcctattgtccgtcgtctgcgcagctatctcgccgacatcaacgacggctttaacgaagtgatcaacggcatgggcgtcatccagcagttccgccagcaggcgcgctttggcgagcggatgggggaagccagccgctcgcactacacggcacgtatgcagacgctgcgcctcgacggctttttgctgcgcccactgctgagcctgttttcggcgctggtgctctgcggcctgttaatgctgtttggctttaccgccgtcggcaccattcaggtgggcgtgctctatgcctttatcagctatctggggcggcttaacgaaccgctgatcgaactcactacccagcagtcgatgctgcagcaggcggtggtggcgggggagcgcgtgtttgaactgatggatcgcccgcgccagacctacggcgatgacgatcgcccgctggaaagcggcgctgttgagatcgaaaacctgtcgtttgcctatcgtgatgaccggctggtattgcaggacattaatctgaccattccgtcacgcagttttgtggcgctggtggggcataccggcagcggaaaaagtacgctcgccagcctgatgatgggctactacccgcttacccggggggaaatccgcctcgacggacgtccgctctccaccatcggccataacgcgctgcgcaacggcgtggcgatggtgcagcaggatccggtggtaatggcagaatccttttttgaaaacgtgactctcgggcgcgacatcagcgaagagaaggtctggcaggcgctggaaactgtgcagctggcggagctggcgcgcagcatgagcgacggaattcatacccggttgggggagcagggcaataacctctccgtcgggcaaaaacagctgctggcgctggcgcgggtgctggttggcactcctcagatcctcatccttgatgaggcgacggccaatatcgattcgggcaccgagcaggcgatccagcaggcgctggcggcgatccgccagcagaccacgctggtggtgatcgctcaccggctgtcgaccattgtcgaggcggataccattctggtgctgcatcgcggtcaggcggtggagcgcggcacccatcaggcgttgttaaatgcgcaggggcgctactggcagatgtaccagctgcaactggccggggaagagctggccgccgccacgaaagaagaatcgcttatcgcctgatgcaccattatcaggcaggctactgacagccatcgctgttggtgcaaaaatgcaacgcaccctgcactggcatggtgcgtttttcttttccaggaacaatctgaatccccgtcacacttttcccttttgctttttcccctcgccacacggcgtaacggcctgaacttctcctcgtttttatttctggcacagcgattgcaataccagatccatgttagctgctgccattaccgaattccgcctggaggaactttatgaagctggttaccgtggtgattaaaccattcaaactcgaagacgtgcgtgaagcgctctcttcaattggtattcaggggctgaccgtgactgaagtgaaaggcttcgggcgtcaaaaaggtcacgccgaattgtaccgtggcgccgagtacagcgttaacttcctgccaaaagtgaagattgacgtggcgattgctgatgatcagctcgatgaagtgatcgacgtgatcagcaaagcggcctacaccggaaaaattggcgacggcaaaattttcgttgccgagctgcaacgcgtcattcgcattcgtaccggcgaagccgacgaagcggcgctgtaactcctgcacacagtgatagggatgggaaaaatgagcaaaaccacttttaaatccgtacttgccgcgctggctctgcttccgggactggcgctggccgccccggctgttgctgacaaagcggacaacgcctttatgatgatctgcaccgcgctggtgctgtttatgacaattcccggcatcgccctgttctacggcggtctgatccgcggcaagaacgtgctgtcgatgctgacgcaggtaacagtgaccttcgcgctggtatgcatcctgtgggtggtttatggctactcgctggccttcggcgaaggcaataacttcttcggcaactttaactgggcgatgctgaaaaacatcgagctgacggcggtgatgggcagcttctaccagtatattcacgttgcgttccagggctcgtttgcctgtattaccgtcgggcttatcgttggcgcgctggcggagcgtattcgtttctctgcggtgctgatcttcgtggtggtatggatgacgctctcctatgtgccgattgcgcacatggtctggggcggcggtctgctggcttcccacggcgcgctggactttgcgggcggtactgtggtgcacattaacgctgcggtcgccggtctggttggcgcttacctggtgggcaaacgtgtcggcttcggtaaagaagccttcaaaccgcacaacctgccgatggtgtttatcggtacggcgatcctctacgtgggctggtttggttttaacgccggttccgcaagcgccgcgaacgaaatcgccgcgctggccttcgttaacaccgtggtggcaacagcggcagcgattctgtcctgggtctttggtgagtgggcgctgcgcggtaaaccttcgctgctgggcgcctgttccggtgcgattgctggtctggttggcgtgactccggcgtgcggttatatcggcgtgggcggtgcgatgatcgtcggtctggcggcaggtctggcggggctgtggggtgtgactatgctgaaacgctggttacgtgtcgacgacccgtgcgatgtgttcggtgtgcatggcgtctgcggcatcgtgggctgcgtactgaccggcgtattcgcttcctcttctctgggcggcgtgggcttcgcagaaggcgtgaccatgggccatcaggtgctggtacagctggaaagtatcgccatcaccgtggtgtggtctgctgtagtggctttcatcggcttcaaagtggcggacatgacggttggcctgcgcgtaccggaagagcaggagcgtgaaggtctggacgtgaacagccacggcgagaacgcctataacgcctgattactgacgtttaactgtgcccggcggcgcaagcttgccgggcctacgtttatctcgtaggccgggtaaggcgaagccgccacccggctcttacttttgccaacactgtgtatttttaacgtgatgactgtatttgcctttctactacttcataaacatgctgcgcaaattgatttgccgcataatcaatgtctttgctcgtattttccacactgcctgtgccataaatcgttttattttttacgactgagcggccattgatactgactgacagcaagccgctcaggtcagtgttattagcaacgcctgattcttgcgtggtttctgtataggtatatgtacgatcgtcacagcggcgctccgtttctctcctgatttttggttttctttttttctcgtcttcatcatctctgtagtaaacatcaacatcgtagcaatattgttctgtcgctgttctttccacgggaatatctcgtgtaaagtctcgcgaggtacgatttgctgacgtacctttcagtgtgacgatgacattatttccttttttttgcgggctgtactgaatgtcataaatgttatttttagaatcatagcttgcgggtatgttacttttaattgttgctaaggtttcaacttttatggagcgctttatttgcgggataatataatttgccagaattggtgtgccatcaatgtatttttcacctgtattgttaataatgatatgccacgtcgcgttatcatacgcatttttaacttcattgatgatatcagggcgcttgctatcgtagtaatagctcattaaaagatcatagaatttttgctttttatcgtcctgcttcagcgctcgttcatgaaaagcctggctaagaggtttggtgacttcctgaagcgttatccgatcgacagtaaaagcagggttgataccgcctttcagcgatgcactcattttaggtgcaacttcctgtatcgccgggatccagcatgcccatgtatcggcttttagccgttgtgaggcaatatcggattggctgttaatagacgcaaccttttgcattactgtattataattactaacgaaattttgtaacactgtctcaactggcttttgacggcgtcctgattctgctgtattcagcgcatactgcaatttttttaatccagaacagtaatcgccggaggtaatatcctctgtcgaatgttttagttgcttgttaactctcgccgtggtggacagaccgcaagccgtcaatagcagcatgcatgacacaacaatgaagtatctgagtattttcattgatatcttccatgattatttgtgggttaatgcataatctatataaatatataaaattctcaatcacggatatttatagcagttattgcagtaaaaggaagatctaatagtaaaaacatcccccgcatttatttcgagggatgttgtatcgtcatattaattagtattgcgattgcgcatcacgccttcctgcacggtcgacgctaccagcacgccatcctgcgtatagatctcaccacggacaaagccgcgcgcgctggacgccgaggtgctctccacgctgtacagcagccactcgttaatattgaacgggcggtggaaccacatggaatggtcgatggtcgcgacctgcatcccgcgctcaagaaaaccgacgccgtgcggctgtaacgccaccggcaggaagttgaaatcagaggcgtaacccagcagcgactgatgcacgcgcggatcgtccggcacgttaccgttcgcgcggatccacacctgacgggtgggttcggcgacatggcctttcaacggattgtggaactctaccgggcggatctccagcggcttgtcgctgagaaacttctctttagcctgcggcggcagcaggtgcgccagcgagcgggcaatgtcggtttctgatttcagcgtatccggtgagggagcgtcaggcatggttttctgatgctcatagcccggctccggtgcctggaaggaggcggtcatatagaaaatcggcttaccgttctggatagccgcaacgcgacgcgcactgaagctgttgccatcgcgcagcacttccacgtcgtaaacaatgggtttttcactgtcgccggggcgcaggaaatagctgtgaaaggagtgcaccaggcgctcaaccggcacggtttctttggcggcatacagcgcctgccctacaacctgcccgccaaatacctgacgaagccctaaatcttcgctttgtccgcgaaacaggccctcttcgattttttccagatttaataatgccagcagattgttcaacgcttgactcatatgtttcctcaataaaaataaaatccgccagtccggagggttcggtctaagtataacgcaggatcgtcagtggtccgatgggtgcaaaaatctgaataaccggccatttccaggcagaaatgagtgatatgtgccacacttattcccgttatctaagtgttaaccactgattctggcaggaataaatccttctggtgcattgaagataaggagaactcaatgaaactcgtgcacatgttaagtggtgttgcggtcgctgtttcgctggctgcctgcgcggataagagcgcggatattccgacacctgcaccaaatccaaatacgtctattaacgctacccaatcgactattgcgcagcctaatgtctccggttctgtgtggatccgccagaaagtggcgctgccaccggatgcggtgctgaccgtgacgctggccgacgcttcgcaggccgatgcgccgtcgaaagtgatcgcgcagaaagcggtgcgtaccgagggtaaacaggcgccgttcagctttgtgctgccgtttaacccggctgacatccagccgaacgcgcgcattctgttgagtgcggccatcaccgtgaacgataaactggtgtttgtcaccgatacggtgaaaccggcggttaaccagggcgggactaaaatcgacctgaacctggtgccggtgcagcagacggcgatcccgttgcagcagagcggtggcgcaaccaccacggtaccttctacgtccccgacgcaggtggtgccttcggcttctacgccagcgccgacccagatgtaatagttttactgcccggcggcctttgctgccgggtcagcggttttatgagtacacccaccgatagcgctgtaaatcaatctgcccgtctcctgatacctgaaccccttccgccagcaacgcctgtcgctgtcgttgcagatccggcccgctgagggaaatagccccatgacgattgaccacccgataccagggcagcgtcgtgccttccggtaagcgcttcagtacgccgcccacctggcgcgcggctctgggcgatccggcaagacgcgccacatcgccataggtggtgacaaatccttcgggaatggaggcaactatctgccatacgcgctggggaaaagagtcctgcggatccatagcatctcctgagtattgattcttcaggataaacagccagccggacactgtgaagagggggctgcgcaataaaccagcatacgacaggcgcgcgcttgcaattgccggggtgtacagggataatgcgcctgcgcgttggttaacaacgctctcaatgggggccctgttggttctcccgcaacgctactctgtttaccaggtcagatccggaaggaagcagccagagcagatgacgtgtgtgccgggatgtagctggcagggcccccacccatttgtgccccgcataactcgctatgtttcgcctcgtcaatccctcttattagccgcacctgaatttcccgctgcgttatgtgacacccctcagcatattattacgctgtcatgtaaatgaaatgttattgtcattatagtgtcataaatgcatggcagattaatcgtgggtaattcaatgggtaagggataatcatggttagtgcagttttaaatgttaaaattgacgaagcagtcaaagagaaacttcgccattacgcagaagccaataacgaaaacctgagcacggccactgagaagctcttactgctggcactggaatcggacgaagaaaccagcgtttcagaagaagagatcgacagtcagcacatcgaagaagataacgcttcaccattaacttccaaagaaatcaaagccctgagaaaaattctgaagaagaaaaaatgaaacaacatctccagaagaccgcgaccagctacggcgaagcctgtcagttattgcgatccggccatgtgaaaaccgtacgcctgaactggaatgtcggcaccgatgaattttttcgcatagcctctgactggtgtgatgccggtgccagaatcaaaaaagatggcgagcactttattatttcgattaagggatttcctatcccgcgacaatagtcattatgttgtcatgcaggcgtcatcgaaataacatccgaatatgagaacctgtccgaaaatacaacgtcacacaaccatctcatgttcattatggatgatgattacgacgagccgttcggctcgtcgctattttctcagatcactttccgctgccgtaacatcatcggctgactgaccagcgacgcccagatcggttgcagcgtcataaaggcctcgcgcaaaacttcatccggctgtgaaaacggcatccgtaaaaagcgatcaaaagccccctgtaaaccgaaacgcgttcccgttcccagactgataccggtactttccgcgtgggtggcaaacagcgtcgccagcgcatcgggcagttccacccagaacgataatccgccctgcggcgtcgtccactgccagcggggaaagaatccctgcaacagcgccgcgcagtcatcccggtgcgccatcagcatctgccgtcgcgccggtaaaaaactctcgccgttttcgacaagccagcgggttgccagctgttccagcagcggcgagcctaaatccagggtttcgcgcatttgtaccagtgcggcgatggtacgcgccggggcgcggatccatcccacccgcagcccgccccagaaacttttgctggcggagccgagtgtaatgatcggcgcggcggtatcaaaggcggccagcgggggaggcggcggcgcgtccatccacagatcgaccatggtttcatccaccaccagcgtggtgcgcgtgcgcgccgccaggcgggcgacgttttcgcgggtcggcgcatccatacagcgcccggtgggattgtggaaatccggcatcagataggcaatgcgcggcgaggtctgggcgatagtggcggcgaggccgtccacatcccaaccctgagagggtaacgctactcccaccggacggcaggacgccccttcgatggcggcaatcgccagcggataggtgggatgatccaccaccacacgatcccccggcccggtcagcagccgcaggatcagcgccaggccgctgaccgcgccgttgacgatcatcacctcgtcggggcgtgtcggcagcccccgcgccacgtaacgccgggcgatggcttcccgcagcgccggtaaaccctgctggtcgtagccggtgccggacagcagcggcggcattgccgtcagcgcgtgctgataagcctggtggatctccggcccggcgggcagcgaagcggcagaaagatcaagcgcggtcggctgcgccatgcgggtcggcaccacgcgtttgctttccggcaggatcaccaccgagccgctgccgtggcggctcagcaaataaccttcctcccgcaactgcgccagagcgctggcggtggtggtgcggctaatgcccagcgcgctggctaactcccgctcgccgggcagacgcgtatccagcgccagtcggccatcaagaataagcaaacgcagggcctgcgccagttgccgccataagggcgtgcgggaggcggattgttgccactggccgagcaggcgtaccagggactgacttccggtgcgacgaggtgacatagcggtccactttttgaaaactggtcattaatcataatgccagccagggccatgatgtcactctgtttcgcagttttcggggtgagagatggttcggcgtttgatccagttgtatatcggtctgagtttttatggcgtttccaccgcgatgtttgtgcgcgctaatctgggagccgatccgtggaatgtcttccacctcggcgtcggtaagctattgtcgctggatatcggcgtggtgatgattgccaccggcgcgctggtgctgctgctgtggatcccgctgcgtcagcggccgggactgggcaccatcagcaatgtcattgtcattggtctggctgccgatgccgcgctggcgctgatgccgccgctggaatcgctggtcgcgcgcagcgtcctgctggtggcggctattgtggttaacgcgctggcgaccggtatgtacattggcgcaggcttcggttccggcccgcgcgatggtctgatgaccggcatcaatgcccgcaccggctggtcggtacgctcagtgcgcacggcgattgaaatcaccgttctgctgctgggctgggcgatgggcggcacctttggcgtcggcaccgtgctgtacgccctgaccatcggcccgctgatccagctctgtctgccgtggtttcgtccgcgcccgcaaccggttgacgtgccgctgccgcaaaccccggttgtttaaacgggcgaagcgctcacaacatcatgctttagattgaggtacactcacgccattctgactgttgcggtgtgagtgatgaaaccgataaccctgtacgatgtggcccgccttgcgggcgtctcctaccagaccgtctcccgcgtgattaatcaggcggagcatgtttccgcccgtacgcgcgaaaaagtgcagcgggcaatggcggaactgcactacattcccaaccgcggcgcgcagcagctggcgggcaaacgcacccgcacgctggggctgatcaccactgatctggcgctgcatgcgccgtcgcaaatcgcctcggcggtgaaaacccgcgccgggcaggcgggctgcggcacgctgatttccatggtggaacgtcacgatctggcggcctgtcaggcagcgcttcaggagttgctatcacagcgtgtggacggcctgctggtgaatattccgctggacgacgaggatgcgcaggcgctggcggcgcaggcacggccaacgccggtgctgtttctggacgtcagcccgacggcggcggtcgacagtctggtgttcgacgcggcgcagggcgcaagcctgggcgcggcgcatctgctttctctcggccaccggcatattgcgctgctgggcggtccggaaagctcggtgtcggcccgcgcacgttttgcgggctggctggcggcgctggatgaggccgggcttgccccggtcgcccgcgctcatggcgactggagcgccgcctccggctatgagaaaacccatttgctactggcctgcgcgcctcacaccgaagcgatcctcgtggcgaacgatcagatggcgctgggggcgatccgcgcctgtgcagaaaagggcattcgcgtgccggagcagctgtcgctggtgggctatgacgataccgccgacagcgcctggttctctccgccgttgaccaccgtgcggcaggcctttaaggaggcgggtgagcgcagcgtcgactggctgctgggcggggaggccgcaggccgcagtgagctgagccagacccgctgcccggtcacgctggtggtgcgcggctctaccgccgcacccggcgggcagacaatcgacggccaaacgctggcgcagcggctgaatgaactggcggtgctggcggcgcggctggagaggcgttaacacttttgtgatcgacgccgcttctggcggatccgatcctttacccgccgtgaagaaacaggcatggtactgttaattgtgagcgcttcgcaaaattcagaggtcactatgtctgcatctgctttatccaccctgatagcccgccgcgactgggaaaacccggtcgtcacccagtggcaccgtctgcccgcccatgcgccgatgaacagctggcgtaacgccacagacgcggcccgcgaggcggcatcgccgtcccgccgtctgttaaacggcgactggcaatttcgtcttttccccgcgccggaagcggtgccggaacagtggctgacacaggagcttgacgatgccgtcgccatgccggtgccgtccaactggcagatgcagggcttcgacacgccgatttataccaacgtgacctatcccatcccggtgacgccgcctgttgtcccggccgggaacccgacgggttgttactcgctcacatttgagatggacgagggctggctggcagccggacagacgcggattatttttgaaggcgttaattcggcattttacctgtggtgcaacggcgaatgggtcggctattcccaggacagccgcctgccggcggaattcgatctcagcgcctgtcttaaacccggcgctaaccggctggcagtaatggtgctgcgctggagcgacggcagctatctggaagatcaggatatgtggcgcatgagcgggattttccgcgacgtggtgctgctgcacaaaccggcgacccatatcgccgattatcaggttgccacccatctcaacgccgattttacccatgcgcagctggtggtggatgttgaactggcgggggagtatgcggattgtcaggtggcgctgacgctgtggcgcggcgatgaggctatcgcgcaggccagccaggggccgggcagcgagattattgatgaacgcggcgcctgggcggaaaaactcagcgtcagcataccggtggctaacccgcgcctgtggagcgcggaagatccggcgctctaccggctggtggtgtcgctgctggacggcaatggcaaactgctggagacggaagcctgcgatgtgggcttccgcaacgttgagatcagcaacggcctgctgaagctgaacggtaaaccgctgctgctgcgcggcgtgaaccgccatgagcatcacccggagcgcggtcaggcgattgatgaagcgaccatgcgccaggacatcgaactgatgaagcagcataactttaatgccgtacgctgctcccactatccgaaccatcccctgtggtatcgcctgtgcgatcgctacggcctgtacgtggtggacgaagccaatatcgaaacccacggcatggtgccgatgcgccgcctgtctgacgatccgcgctggttcccggcgatgagcgagcgcgtgacgcgcatggtgcagcgggatcgcaaccatccgtcgatcatcatctggtcgctgggcaatgagtccgggcatggcgccagtcacgatgcgctctatcgctgggtgaaaagcagcgatccgacccgcccggtgcagtatgaaggcggcggggctaacactgcggccaccgatattatctgtccgatgtatgcccgcgtggatcaggatcagccgttcccggcggtgccgaaatggtcgatcaaaaaatggctcagcatgccggatgagcagcgcccgctgattttatgcgagtacgcccatgcgatgggcaacagcttcggcggtttcgccaaatactggcaggcgttccgcgactatccccgtttacagggcggttttgtctgggactgggtggatcaggcgctgaccaaaaccgatgataacggcgagcgcttctgggcctacggcggcgattttggcgacacgccaaacgatcgccagttctgcatgaacggcctggtgttcccggatcgcacgccgcatccggcgctatatgaagcccagcgcgcccagcagttcttccggttccggctggagagcacctcaccgctggtcatcgatatcaccagcgagtacctgttccgcacggcgaataatgaagtgctgcgctggtcgattgcccgcgatggcgacgtgctggcgaccggcgagctggcgctggacattgcccctgaaggcacacagcgcgttacccttgacgcgcccgcgctgagcgccgcgccgggggaagtctggctgaacgtagatatttatcagcgcgaggcgacggactggtcaccggcagatcatctctgcgcttgggatcagtggcgcttaccggccccgctgtttgtcgccccgccagtagcgagcggcaacgcgcctgcgctcgccatcagcgatgaagagtatgtgatcacccatcagacacagcgctggcagttttcccgcttaagcggcgagctgacgcagtggtggcagggcgaaacgccaacgctgcttacgccggtgcgcgaccagttcacccgcgcgccgctggataacgatatcggcgtcagcgaagtgacgcgtatcgatcccaatgcctgggtggagcgctggaaggcggcggggatgtacgccatgacgccgcgcctgctgcactgcgctgcggaacgcaccgccgccgaggtctgtattgaaacgcgccactgctgggaggctggcgggaaagtgctgtttatcagccacaagcgctggcgcatcgacagccatggcgtgctgcatggcgacgtggatgttgcagtggcgaccgacgcgccgccgccagcgcgtattggcatcacttgtcagctggcggatgtggagccctcggtgagctggacggggctggggccgcatgaaaactatccggaccgtaaactggcggcacgccaggggcgctggacgctgccgctggcggcgctgcatacgccgtacattttccccggcgataacggcctgcgctgcgatacccgcgaactgcgctacggcgcgcatcagctgaacggacgcttccactttgccctcagccgttacggtcaggcgcagttacaggcgaccacgcaccaccacctgctgcgcgaggagccgggctgctggctgcatctggatgcgttccatatgggcgtcggcggggatgattcctggagtccgagcgtgtcgccggagtttattctggcgcaggatcgcgtgcactatcgctttagctggcagcaacgccgctaacccccgattgacgcgggcagcaagactgcccgcgttgatttattcgcgcttagcggtgcgcagattcgcttcggcccacagaataaaggccgctttcggcagcgccttgctgtacagccaaccctgaccatactgcacgccgtgctcccgcagccacgcctgctggctgtcggtttcaatgccttccgccaccatcgccagatccagcgctttcgccatctcaataatttgtggcgtgacgtttttatactccagcgcatcgacaaaggatttgtcgatcttgagaatatcgacgttcaggttttgcagatagctgaggctggaatagccggtgccaaagtcgtcgatataaatggcgtgtcctgccttgcgcagcgcgtcgatggccggggcgctgatctccggatcggcaaacccgcgctcggtgagttccagggctatttgcgcaggcgacagctgccagcgcgccagctgttcacgcagcagcacgggcagggtgtcggaggtcagatcgcccggatccagattcacggaaatatgtatttccggatgctgttgcagccatttgcccaaatcctcaaacaccgtttcgataatgagctgcgtcaggcgcggcatcaggccggttttctccgccagcggaataaacacatcgggcgtgagaaaggtgccatccacttgcggccagcgggcaagggcttctgcgccgacgatcctgccattactgagcgtgacaatgggctggtaattgacgacgatatcccgcgcgtgaatggcatcaagcaaacgctggcgcggtgactgcaaacgacgcagatagcgcagcaagaaaagcgccagcagcagactcatcaacaggccgaacggcagccagatcaacagctggcggtgccagcttttttccagcggcgcgagagaggcggaagtgacaatggccacgcccagttgcgggtaatacttcatggtatatatagcgccctggaatttaagctgctcatcgccgttctgtttcaggcgctgccagagcgcaggggtcagtgcaaagctgctggcgatcacctggttgctgtcggtgccaatcagcgcggtgctgatcgaccagttaccaaaaggcagcacgtcaatcaacgactggggatcgatcatcaccacatggcgctttccccccagcgccagcatggtacgttgcaggccgatgtcgttctgggtggtgagccaggcgcgataaccgtcgcgggtcactttgacagtcgccggaaagatgccttcagtgctcaggctttccagagaggagcagcgcggcctgaagccgtcgagatagatcacttcctgaatataacgatttacgtaggagacgcggcgcattgccagcaggtgttccggtccgcagggcttgccgctgaaggtttcaatatcatccagcgcgcgtttaccctgctcaatcacctgttccgtgcgcatcaccacccgcgaggcgtaattgcccatctcgctggcaaagttttcctctgcctgacgatgcgccagccagatgctcagcccgacggggagcagtaccgccaggagcagtacaccagtgatgacgctgataagccgccggttgttcataatcaaaagtccctgttttgatgttcaccacaccttgtggaatgatagcgttatatcacggctaattaatacattattgcaggatgcgtcagatgaagaaaaaagagtttgtgacgcaggatttgctgagcaaaatttatcagaaccgcgagccgggcccgcgtaaactgccgccggagcgccagttagccagcgaatacggcgtgtcgcgttttaccattcgccaggcgctggaaaaactggccagcatcggcgtggtacgtattgtccagggttcggggatctggatcaacgaacagtcgcgcagtaatccgctggtgtacaactcgatcactgaaaagcgcttcgatcagatccgctttcgcatgatcagcctgcataaaaaacggcctgaccgcgatgaacagcagatcttcggcctgccggaagagagctttatctggcagttttgccgcctgcgttttgtggatgaagaggcggtgcagatcgaagtgtcccgtatgccggtggcggattttccggatctgaatcagcaggtgatcgagcgctcattgcagcagtacgtgctgagcaagggttatcaggtgtcccatctgctgaccacctaccgcgcggtgagcgtcagccgtgaacaggcggtgctgctgggctgcaagaagggcagcccggcgatgcatatcagcaatcgcggtattctggaaggcggccaggtgtatgagatcagcgatattatcgacatcaattacacctgcacctacatcattccctataaccgcgacaatctgaccttccgccagggcggcagttaaggcgtgtggatgctgccgtccggcaggcggctttgcgtccactcatgggggcggtagaccaccgggctggcgagggctttttgctcgtcaaaaccgacgccgatacccggcgtttccggcgcacagacaaagccgtttttcgccaccggcgcgccggggaataccgcatcggtaccggcggagcggggaataaactcctggatcgccgcgttgtgcaggtgaatattcagatgggtgtttaccgccacgccaatcggcgtcatatcgccagggccgtgccaggcaagacgaacgccaaaggcctggcagagcaccgccagcttcagcgccggggtgatgccgccaatctgcgagatatggcagcggataaagtcgatgcggcggttgacgatcagatcgtgccactccgccgggttgttaaacagctcgcccatcgccagcggcgcggtgctgtgcgcccgcacctgctccagccacgcgctttgcgccggcggcagaatatcttcaataaaataaggctggtacggctccagctgttttgccagctgcaccgcctgttgcgggaacagccgctcgtgaacatcatgcaggatatgcaactgatagccatatttctcccgcagcgcggcaaacatcgccaccgtgttgctcatgtactcctgctggtcgaaataggcgcccggcgtgggattgtcaggggtgtgcagattcgctggcgtgccgccgtaaaaacccagctgacagcgcacatggcgatagccctgcgccaccagtttgtcgacggcggcaaagagttcgtccagggtttcgccgctggcgtgggaataggcgggaatggcatcccgggatttaccgccgagcagctgatagagcggcatcccggcgagctggcccttgatgtcccacagcgccatatcaatgccggaaatggcgttgttcatcgccgggccgttacgccagtaggcgttgacgttcatcatctgccaggcgtcttcgatatggttggcgtcgcgcccgaccatcagcggtttcaggtactcgtcgaccagggttttcaccgccagcgggcgctgttgaaaagtggcgcatccatgtcctgtgatgcctttatcggtggtgacccgcacggtaaccaggttgtggcgatcggggcgggtaataaaacattcgatatttttgataatggttggcgtcacagggaatactccttttcaggccagatgaatcgtaatggctattatcatcccctgaatttccggaaaaggtaaaccgttttttttataaatattttggtcagttatttggatttattttaattaaataccataccaattttcgttatatgaccttttgatgttgctgttagagcggaattgtgacgaaattcatattttattggtttgttttgtggtgacgatttacctaccatgagtgacagatattaaaacgacaacacttccggcaggagcttttatgggaacgcaagacgccattaacaatattatccgtctggtgggcggcgagggtaatattaacaaggtatggcactgtatgacgcgcttacgctttgatctcattgacgataataaagtcgatcagggtgaaatcaaaaagctgccgggcgtcctgggcgcgcagttgcagagcgaccagtttcagatcatcatcggcccgaaagtgaacagctggtatgagcaaatgctggccacgcttggcggcgacaatcgaaccaacgacgcaccggcgcagaaagggcggaaaagcctggtgtcgatgtttatggataccgtctccggcgtgttcgggccgattgttccggcgattgccggggcagggatgattaaaggtctgctggcagggctgatcgccctgaagctggtttctgcgaaaagcgataccgtggtggtgatcgacctgatcgccagcggcgtgttctattttctgccgttcttccttgcagtgtcggcggcgaaaattttcaaaaccaatgaatatctggcggcggcggtggcggcctgtctgatgtacccgtcgctgattgaggcggcaaaagcgctggcggcgcatcagccggaggcggtgacggcgttctggctgctcaacgccattccggtatcggtctttaactattctgccagcgtgataccggtgattttctcggtgctggcgctcagctatatccaccgctgggtggacagcatcatgcctgacgtgctgaaaacggtgtttacgccgacgctgacgctgttcctcggcgcgctggcggcgctggtggtgattggcccgatcggtatttacctcgggaaagggctggcgctgtttatcgaagggctgttcagcgtgtcgtcgagctttgccggtctggtggtcggggcgatccgcccggtggcgatcctcaccggtatgcaccacgcgatgacgccgattgcgctgcaaaacttcagcgaccgtggttacgacatgctgatgccgatgatgtttatggccaacatggcgattgccggttctacctttgctatctggcgcatcagtaaaaaccgccaggatcgcaccgtgaccttatcggcggggatttccgcgctgctgggcatcactgaaccggcgctgttcggcgtgctgacgcgctacaaaaaagcctttatcgccgcgaccatcgccagttcgctggcctcggcgttcattgccttctttggcgtgcggctgtacggctatattctgtcgagcattttcagtctgcctgcctatatcggcccgtactttatgttcgccctcgcaggcgtggtaatagcgctggtgctctccttcattttaacgacgatccttgtcggaaaagatcagccggacgcctgagttaacgtcggtgcgccagacggcgcgccgacatttgcttacttcctctctttgattcttccctgctttcgcatccttatgtgctttaaagagttgtattccttttattaccgggatagaattttgttatgttataacaaaacatctgaggcattatgaaagctgatatccatccccattaccggacggtggtgttccacgacaccagcgccaacgaatatttcaaagtaggatcgaccatcaaaaccgatcgcgaaattgagctagaaggcaagacctacccctatgtgaccattgaagtgtcatcaaagtcacatccgtactataccggtaagcagaagacgttcaccaatgagggcagcgctgcaaaattccagcagcgattcggtcgttttatcagttctaagaaggactaaaagatgcaggtgctgaattcattacgcagtgcaaaacaacgtcacccggactgtcagctggtgcgccgtaaagggcgggtgtacgtgatttgcaaatcgaacccgcgctttaaagcggtgcaggggaaaaagaaaagacgttgagggataaagaagaaacgggcggcaattattttgccgcctctttgcgcgtcagggtgtagatatcgtaaaacgacagctcgcccttacgggccatcatctgctgtaactgtaatttctctttctcgctgaccacaggcgagctgaggatatcgtcaatcagcgtttgcggtacaaagcgggtgttgtaccactcgccgttgtagcagacgcggaaatccagcacatcgatatcttcatagcggtagcgcggataaacatcaaaaaagaagaagccgttaagcagcgcaaagagcaccaccagcagccagacggagcctgccagggtttcagactgcaacatcaccgccagggtggcaaaccaggcgatgtacataccgacaaataatccgggatgattgcggatgaagctgatgctgaagcgcggcctgttgtcgcgtttctcgcgggtattaagctcatcgatagtttgcatgagcagccgctggatctcggtcatttatttccctttttattcggacgaggtgcaggtgaaaccgcctattttacgcgcccgcagagtctgaaaaaaagtaacagtcgcacggcaaaaaacaataacagtcagacggcgccaggcgtcagcgttttgatgatgcgcgccgggttcccggcaatcaccacgtcagacgggacatcgcggatcaccacgctgcccgcgccaatcaccacgttatcgccaatggtgacgccaggatttatcaccgcgcgtccgccgatccacacgtttcgaccaatgctgaccggcgcgccgaactccagaccactgttgcgcgcagtggcgtccagcggatgcgtggcagtatagatatgtactccgggcgcgatcatacagttatcgccgatgcggatcgggcagacatccaggaaaacgcagtcaaagttagcgtagaagtctttgccgaggaaaatattgtagccgtagtcgcagcggaaatttggttcgatatacgcattgccgctgtcgccaagcagttccgccagcatagcgcgacgtgccgctttttcatctggcacggagtggttgtatcggtgaatgatttctctggcgcgcagacggtcggcgcgcagggtgtcatccgatggccggtagggcagaccggctatcattttttgtttctcgtcgctcattgctttctcaccagtaaaattaacagtgaacaccgtaaagtgagatagccggaaaggataataccttcgcgagggcttgtgatcgcgatcacatgggcactcgctgttcatcgtcgggagaagccgcctgacaaaggctatgggagagcgctacgatacaacctcaaaaaacatcacagggattaacggacgaatttccaaaccgacgacggaattttgtcatacagcttattcatggtcagttcagccagacggtgatccgccgctgaataaaatacggtcagttccggatccgacagctcatatttattcttttcaatgacgcgttccagcgtatcaatagtctgacagcgcctcaggcgcatcaaataatcagtcttggttaatggtttatcagacataacttcacctttgtaatagttctaacaggagaggctaacggggttagccctgctcacattgaggaaacagcgaaacaagcgattccctgatttacgccatttctgtaagtcttctgtgttaatgccgtagctgctgaacaacataaacgtgtcatcgaggtattcatcgatttgggcgatcagcttattatcttcattatacttaattttataattaagtgcgaaggttgctatatgctcaacaagctcgtttaactgtaaattgattgctgaagttggatcatttacccagccatggtggctttcttccagattggcgaggcaatcatggtacagggtttcacaaagaaatttcagctgcgcaatatcatgcctttttggcgagtattcgtccataacgcatccccttctgagtgacttttttttactaaccgaacaccgtatcgggatggatacaacactgtgacctgccgcgtaagctgctcttacgtctcattttaactataagccagactgaataatatttcctggctctattacgaaaaattacaattattacaacttatgtctgtcagtaaggttatttccgatggttaatctaccgccgtggggcgcgttaaatcttcagcacctttaatgcatccttaggtttcattaggttatccgggattaactggtcggatgttattgccgtgttcgcgactaagaaaattacttaggaataatcttactgaacagcaaaattcacaataattaagatttttacccatacttttaagagtgaacttaagccttaagaattatatgacttattttcgttgcataatataaacgcacagacaataagctggttttatcattttttgcgaaaaagaaaaaggccgcttgcgcggcctttgttaaagcatcatggcttaatggtgctcaaccttatgggaatgctcaatatcttccgatttgcggctgaagcggcggcgaaccaccacaaagaacaccggtacgaagaagatagccagtacggtcgcagtgaccatcccgcccattacgccagtacctacggcgttctgcgcgccggaaccggcacccgagctgataaccagcggcataacgccgaggataaacgccagcgaggtcatgaggattggacgcagacgcatacgtaccgcttccatcgtcgcctcgatcaggcctttgccttctttctccatcagatccttggcgaattcgacgattaatatcgcgttcttcgccgacaagccaatggttgtcagcaggcccacctggaagtaaacgtcgttacccagaccgcggaaggtcgcagcaaggagcgcgcccagtacccccagcggtaccaccagcatgaccgagaacggaatcgaccagctctcgtacagcgccgccagacagaggaagacgacaatcagcgagatggcatacagggcaggggcctggttgccggagaggcgttcctgataggacatgcccgtccagtcgtaaccgatgcctgccggcagtttgcccgccagttcttccatcagatccattgcttcaccggtacttttacccggtgcggcttcgccaagaatttccatcgacggtaaaccgttatagcgttccagacgtggtgagccgtattcccagtgcgtggtggcaaaggcgttcaacggtaccatctgcccttcgttaccgcgcacataccagttgccaatatcttccggcaacatacggtatttggcttctgacatgacgtaaacttttttcacacgaccacggtcgatgaagtcgtttacgtagctgccgccccatgccgcgccgagggtggtattaatatcgctaatggatacacccaacgcctgcgctttttcctggtcgatatcgattttaaactgcggcgtatcttccagaccgttcggacgcacgccaaccagcacatcagagcgcttgccgacttcgccgagcagctggttacgcgcctgggtcagtttctcgtggccaagaccgccctggtcgatcagctggaagtcgaagcccgtcgccgtaccgagatcaacaatcgccggcaggttaaaggcgaagaccatcgcatctttaatctgcgagaaggtgcccatagcgcgaccggtgatcgcatccactttgttttcatcgcccggacgctcgccccactctttcagggaaacgaacgcgataccggtgttctgtccacgacctgcaaaaccgaaaccgttaaccgcaaacacagagtttacgttcgctttttcgtttttgaggtagtagtccgtcacctcatccagcaccttctgcgtacgctcctgggttgcgcccgcaggcagctgaaccatggtcaggaacacgccctgatcctcgtccggcaggaaggagcttggcagacgtacgaacaggtaggccataccaataacgatgatgatatagagcagcagataacgaccggtactgcgcaggatattccctatgctgtcggtgtaatggttggtgctcttatcgaacatgcggttgaaccagccgaagaagcctttcttgccttcgccgtgatcgcctttggcgaccggcttcagcatagtggcacacagggccggggtcaggatcaacgcaaccagaaccgacagcgccatcgctgaaacgatagtgatggagaactgacgatagatcgcaccggtagagccgccgaagaaggccatcggaataaataccgccgacagcaccatcgcgataccgaccagcgcgccctggatctggcccatggacttacgcgtggcttctttgggcggcagaccctcttcggtcattacacgttcgacgttttccaccaccacgatggcgtcatccacaagcaggcctatcgccagcaccatgccgaacatcgtcagggtgtttatcgaatagccaaaggcggagaggatcgcgaaggtccccagcaatacaacaggtacggcaatggtcgggatcagcgtggcgcggaagttctgcaggaacagatacatcacgatgaacaccagcacgatcgcttcgaccagggttttaaccacttcgttaatggagatttttacgaacggcgtagtgtcatacggataaaccacttccagaccggccgggaacgtctctttcatgcgttccagttcagcacgtaccgcgtttgccgtatccagggcgttcgcaccggtggcaagtttaatccccagaccggaagccggctggttgttaaagcgcgcgataatatcgtagttttcaccgcccaactcaatacgagagacgtctttcagacgcacctgcgagccatccggattcacttttagcaggatcttgccaaactcttccgtcgaggtcagacgcgtctgcgcaatgatagaggcattaagctgctgccctttcaccggcggggtaccgcctaactgacctgctgccacctgggcgttttgcgctttgatggcgttaatgacatcaaccggcgttaactggaagttgttcagtttggtcggatccatccagatacgcatcgcatattgcgaaccaaagagctgaacgtcgcccacgccgttagtacggctgatcggatcctgcatgttggcggcaacatagtcagaaatatcttcctgggtcatggagccatcggtgttaatcaccccgaccaccatcaggaagctactcgctgatttttgtacgcttacaccctgctgctgaacttcctgcggcagcagcggcatcgccagctgcagtttgttctgcacctgaacctgtgcaatgtctgcgtcagtaccggattcaaaggtcagggtgatctgcaccgaaccggtggagtcactgtttgaggacatgtacatcaggccatcgataccgttcatgttctgttcgataacctgggttacggtatcctgcaccgttttagcgtcagcgccagggtagtttgcggatacagttacagcaggcggcgcaatcgtaggatattgcgctaccggcaactgcataatcgcaagccccccggccagcatgacgatgatcgccaacacccatgcaaatatggggcgatcgataaagaaattaggcatgtcttaacggctcctgtttaagttaagacttaggctgttctgactgggcgccgcctgcggcttgctctttcgtctcagccttcacttcctgcacttttacctgagcgccaggacgaactttttgtaatccggtgacgatgacgcgatcgcccgttttcaggccatcggtaaccagccatttatccccaatcgcctgcgtggcggtgatctggcgctgttcaactttgtcgccttcgccaaccaccatcacgctcgcatcgccgcgtggcgtacgggttacgccctgttgaggcaccagcagcgcattcgggttaacaccttcttcaagacgagcgcgtacgaacatacccggcagcagggaatgattcgggttcgggaaaatagcacgtagcgtaatagagccggtggtctggtcaacggtcacgtcagagaactcgagggtaccggtttgcggcagtttttcaccgtcgctggtgataagttccactttcgccttgccgttttcctgtttcagcttgccgctttccagctcctgcctcagacgcaggaaatcgttgctcgactgggtgacatccacataaatcggatccagctgctgtacggtagccagcgcggtagtttgaccgctctgcaccagcgcgccttccgttacggcggatttaccaatacgaccgctgataggggaggtgactttggtataagcgaggttaatacgcgcggtttcaacggcagctttcgcggccacgacagcggcattggcctgcatcgcatcagcctgcgccgtatccagatcctgttgactgatgtagttggtgccaatcagtttctgataacggttaagggtaacctgagcaattttcgctgcggcctgcgctttcgccagatcgcctttggcgctctcataagaggcctgataggtggctggatcaatctgataaagcgagacgcccgcttcgatatcgctaccttcggtgaagttacgttttaagataatgccgctgacctgaggtctgacttccgcgatgcgatacgcgctggtacggccaggcaattcagtggtgatttgcagaggttcagatttgagtgtcacaatcccaacttctggcgcctgtccggcaccttgttgctgagccggtttatcatcacatcctgtaagcgctaagctgcctgaaagcatcagaacgaccgccagaggcgtgaaccctctgtttttgttcataggtaaacctcgagtatccgatttcaaattgatcaatggatcaagcgtccacaaacccattgctgcgtttatattctggtcatgctatgttacatacattcataaatgtatgtaaatctgactcctgtaaaatcacctacatatggcacgaaaaaccaaacaacaagcgttagaaacacgtcagcacattcttgacgtggcaatgcgattgttctctcagcaaggtgtctcttcaacctcgctggctgaaattgcgcaggcggcgggtgtgacacgcggcgcgatttattggcacttcaaaaataagtcagacttatttggtgaaatttgggagctgtcagagtccagcattagcgatcttgagcttgagtatcaggcaaaattcccggacgatccactctcagttttgcgggaaatcctggtttatattctggaggcgacagttattgaagagcgccgtcggctaatgatggaaatcatttatcacaagtgtgagtttgtcggtgaaatggcaattgtgcaacaggcacagcgcagtttatgtcttgaaagttacgatcgtattgagcaaaaccttaagcgctgcatacaagcgaaaatgttaccggcagatctgctgacccgtcgggcggcgatcctgatgcgcagttatatttccggcattatggaaaactggctgctcgcgccacaatcctttgatctcaaaaaagaagcgcgggattacgtggcgattttgctggagatgttccagttctgcccgacgatgtgtaaagcgcccggcactctgtccgcttaagacaaaatctccgtcgccaggatttatcctggaggctttgcgcgccgctaggtagtcgctggcgggcgtgatattctccgtgccaggctatttccggccgctttccggttaagaacacattcacactaaaattatgctgcacaccatacgcccgcaaaacccgatttccgcgtttgcctttgcgctgtgtttattcgtcgcgtcattttgcgtcacgataaacgtagcccaggccgcaaccgatctgccttcccgtgccgaaacgcaaagtcggctggatgcgctgaacaagcaaaaaacccacagcccgcaggataaactggtcattgaagatctgaccgaaaccctggacacgcttgataaaatcgagcgtatcaaacaggaaacggcgctgctgaaacagaaagtcgcccaggccccggaaaaactccgtcaggcgacggaagggctgaacgcgttaaacgataaagacaatgacgacgaaacgcgtaaaaccctggccgcgctgtcgttgcgtcagctggaatcccgcgttgctcaggtgctggatgatttgcagacggcgcaaaacgatctctccacctataacagccagctggtgtctttacagacacagccggagcgggtgcagaacgccatgtatgccgcctcccaggagttgcagcagatccgcaaccgtctgaacggcaccatgaccggagaaggggcgctgcgtcctacgcagcaagagttgctgatggcgcaacaggcactgctgaacgcgcaaattgagcagcagcggaaaagcctcgaagggaataccacactgcaggatacgctgcaaaaacagcgcgattacgtcaccgccaacagtaatctgctggagcatcagctacagctgttacaggatgcggtcaataataagcgcctgacgcttaccgaaaaaaccgcccaggaagccgtcaacccggacgaaaccgcccgtatccaggcgaatccgctggtgaaacaggagcttgatattaaccatcagctcagccagcggctgattgatgccaccgaaagcggcaacgcactggtgcagcaaaatatcaaagtcaaaaactggctcgatcgcgccctgcaatccgaacgcaacgtcaaagagcagatcgcggtgctgaaaggcagtctgctgttatcccgcattctgtatcagcagcaacagacgctgccgtcagcggatgagctggaagacatgaccaaccgcatcgcggatttgcgtctggaacagtttgaaatcaaccagcaacgtgacgcgctgttccagaacgacgcctttgtgtcgaagctggaagagggccaccagagcgaggtgaatgatgaagtgcatgacgcgctgcttcaggtggtggatatgcgtcgtgagcttctcgatcagctgaacaagcagctgggcaatcagctgatgatggcgattaacctccaggtgaatcagcagcagctgatgagcgtctccaaaagcctgcaggaaatccttacccagcaaatattctggatcaacagtaataagccgatggactgggagtggcttaaagccttccccgaagcgctgaaagagcagatcaaatcgaccaaaatcaccgttaactgggaaaaagcctggcctgcggtggctatcgcgctgctcgccggattgccgctgctgctgattgccggtctgatccgctggcgtctgcgctggctgaaacagtatcaggcgaagctcgcggatgaagtgggacagctgcgtaacgacagccagctgcatacgccaaaggccattcttatcgatctgatccgtgccctgccggtatgcatgctgatcctcgccgctggcctgatcctgctcaccatgcagctcaatatcagcgaactgctgtgggcgttcagtaaaaaactggcgctttactggctggtattcggcctgtgctggaaagtgctggaaaaagacggcgtcgccgtgaagcatttcaacatgcctcccgcgctcaccagccactggcgtcggcagattgtgcggttaagcctcgctctgctgccgctgcatttctggtcggtggtatcggaactgtcaccgctgcacctgatggatgatgtgatagggcaggtggtgattttgcttaacctgctggttatctccgcgctgatctggccgatgtttcgcgaaagctggcacgataaagagtcgcacagcattcgtctgatcaccattaccgtgctgtcgattgtgccggtggcgttgatggtgctgacggccacgggctatttctataccacgctgcgcctctccggccgctggatcgaaaccgtctacctggtgattatctggaacctgctgtaccagaccgtcctgcgcggtttaagcgtggcggcccgccgtatcgcctatcgtcgggcgctggcgcgtcgacagaatctggtgaaagagggcgcagaaggagccgagccgcaggaagagccgaccatggcgctggagcagatcaaccagcaaaccctgcgtatcaccatgctggtgatgattgcgctgttcggcgtggtgttctgggcgatctggtctgatttaatcaccgtcttcgcttatctcgacagcattacgctgtggcattacaacggcagcgaagcgggcgttaacgtggtgaaaaacgtcaccatgggcagtctgctgtttgccgtcattgcgctggtggtggcctgggcgctgatccgcaacctgccggggctgctggaagtgctggtgctctcacggctgaaaatgcgccagggcgcgtcctacgccatcacgcagatccttaattacgtgatcatcgccgtcggcgcgatgacggtcttcggctcgctcggcgtgtcgtgggataaactgcaatggcttgccgcggcgctctcggtcggtctgggttttggtttgcaggagatcttcggtaacttcgtctccggtctgatcattctgttcgaacgtccggtgcgcattggcgataccgtgactatcggcaccttctccggtacggtcagtaagatccgcattcgcgccaccaccattaccgattttgatcgtaaagaggtgatcatcccgaacaaagcctttgtgaccgagcggctgatcaactggtcgctgtccgataccatcacccgcgtggtggtgcgtcttggcgtggcttacggctcggatctggagaaggtcaaagaggtgttgctgaaagcggcgatggagcatccgaaagtgatgcacgatccggaaccggcagtgttcttcaccaccttcgggccgagcacgctggatcacgaactgcgtctgtacgtgcgtgaactgcgcgaccgcagctacaccgtggatgagctgaaccgcactattgaccgcctgtgccgtgaaaacggcatcgacatcgcctttaaccagctggaagtccacctgcgtaataccaaaggcgacgagcataccgaagtgaaacgtgatctgagcggtgataattccgcgccaggcatcgcctgacagacatccgccaaccctctcctgtgggagagggtcactctgtggcggcgcttgccgccactttcttctcaaaatcccggcgtacgatctccagcgctttcagcactgtatccggcggaatggcgtgttcttccagcagcataatcaaatccaccgccagtttaatgtcgtccggggcattctctaatgacatgataacgtcttccttagcgggtcatccgtgccagcacggactcaatacgatgtaatgcagtctgacagcgggacagccggccttgcagcgccacgatctcctgttgcagtttctgctgttctgccgtatcgacggctgcgcggcatcgcgcttcccgtgtctgtttcatttcgatcagacggcgctcaaattcctgatgctgcaaacggcggcgctgccattttgcgatccccggcgccgcatgatcccactgcctgagcgaccaggtggcggtttcgcgcatcagggcggcaatttgcgcgctgagatgctccgccagccagctcacctgagccagctgcgctttctccaccgcatggcgaagggcggcgagattggcttccgcctcctcaagacaggcggacatcagcgtgctgcgcgtgcggaaaagctggcgatcgaagcgcgcgctgacggtggcatggccggcaaggggcgcaacctgcatccgtaatgccgccagttgctcagcgagcgtctgtaaaagtcgaaccgttttcacctgtctctccggtcattcattcaaagcctgtgttaaagtgaccctaacatcagataacgatccctatcatgcaacgcactattttaatcatcatcggctggctggcggtagtcctggggacgctgggcgtcgtgctgccgctgttacccactacgccttttatcctgcttgccgcctggtgctttgcccgctcctcgccgcgctttcaccagtggctgctttatcggtcatggtttggcggctatctgcggcactggcagaagtaccgcgcgatgccgccgggcgcgaagccccgcgcaatcgtggtgatcctgctcacctttgcgctgtcattatggctggtaaagctgatgtgggtacgcattttgttgttatgcatcctcgcctgcctgctgatttttatgtggcgcatcccggtggttgacgaaaaacaacaaaatcagtgacgcgaacggaagtgtgttgcatttgtcgcgcgcagccagtaaattcgagcgttttcgagcacgggcactcctggttaaatgttaaacaacggttgcatttgatccttctcagcgtgccgtgagtaacaccgtttctatcaggcaaaaaatccatgaccgcgactgcgcagcagcttgaatatttaaaagacagcatcaaaagcatccaggattatccgaaaccgggcatcctgttccgtgatgtcaccagtttgctggaagacccgaaagcctacgccctcagcattgaactgctggttgagcgttataaggatgccggtatcaccaaagttgttggtactgaagcccgcggcttcctgttcggcgcaccagttgcgctggcgctgggcgttggtttcgtcccggtgcgtaagccccgtaaactgccgcgtgaaaccatcgcggaaagctatgagctggaatacggcaccgatcagttagagatccacgtcgatgccatcaagcctggcgacaaagtgctggtggtggacgatctgctggcgaccggcggcaccatcgaagccaccgtgaagctgatccgccgtctgggcggcgacgtcacagacgcggcctttatcattaacctgtttgatatcggcggcgagcagcgccttgaaaaacagggtattaaatgctttagcctggtgccattcccgggtcactaatacccgtcatcgacattcatcatgcgggcctgctggcttgcatgatgaagtgtattcagcctgttgctgtgttagcataacccctcgtaaatcacctttcagcgttgcagagcctgccaatgagctatcaggtcttagcccgtaagtggcgaccacaaacttttgctaacgttgtcggccaggaacatgtgctgaccgccctggcgaacggcttatccctgggacgcattcatcatgcgtatctcttttccggcacccgcggcgtcggtaaaacgtccattgcccgtctgctggcgaagggactgaactgcgaaaccgggatcaccgccacgccctgcggcgtctgcgataactgccgtgaaatcgagctggggcgctttgtcgatctgattgagatcgatgccgcttcccgcaccaaagttgaagatacccgcgatctgctggataacgtgcagtacgcgccagcccgtggccgcttcaaggtctatctgatcgatgaagtgcacatgctgtcgcgccacagcttcaatgcgttactgaaaacgctggaagagccgcctgcgcacgtcaaattcctgctggcgaccaccgatccgcaaaaactgccggtgacgatcttatcgcgctgcctgcaattccatctcaaagcgctggacgtcgatcagatccgccagcagcttgagcacattctcgacgaagaaaaaattacgcacgagccgcgcgccctgcaactgctggcgcgcgccgccgacggcagcctgcgcgatgcgctgagcttaaccgatcaggcgattgccagcggcgacggtcaactgaccactcaggccgtcagccagatgctcggcacgctcgacgacgatcaggcgctgtcgctgattgaagcggtggtggaagccaacggcgaacgcgtcatggcgctgatcaacgacgccgccgctcgtggcgtggagtgggaagccctgctggtggagatgcaaacgctcttacaccgcatcgccatggtgcaactctccccggccgcgctcagcagcgacatggcggccattgagcaccgtatgcgcgagctggcccgcaccgtgccgccgactgacgtacagctctactaccaggcgatgctgattggtcgtaaagaattgccgtatgcgccggatcgccgtatgggcgtcgaaatgacgctgctgcgcgcgctggccttccatccgcgccagccgctgccggagccgcaggttccacaacagtctttcgcgccggcggcccccacggccgttctgaacccgacgcaggtcgccccgcaacaacacgccgtcgccccaccggccataagccatgacgcgccattaccggataccaccagtcaggtgctggcagcgcgtaatcagcttcgtgcccagggagcgaccaaagcaaaaaagagtgaaccggcagcggcaacccgcgcgcggccggtgaataacgctgcgctggagcgcctggcgaccatgagcgaacgcgtgcagtcgcgtcccgcctcatcgacccaggaggctccgcctgctaaaaaagaagcctatcgctggaaaacgaccacggtcaccgaagcggtaaaagaagaagtcgccacgccgaaggcgctgaaaaaagcgctggagcatgaaagaacgccggagctggcgaaaaaactggcggaagaagccattgcccgcgatccctgggcggcgcaggtcagccagctcaatctgccgaaactggtggagcaggtggcgctcaatgcctggaaagaacaggacggcaaccgcatttgcctgcatctgcgtccgacccagcgccatctgaattcggcgggcgcggctaaggtgctgacggaagcgctgtcgaccttatgcggcgaagcagttgaactgactatcattgaagatgataatccgtcggtacgcacgccgctggaatggcggcagacgatttatgaagaaaaacttgcgcaggcgcgcgagtcgattgtcgcggataataatatccagacgctgcggcgcttttttgacgcggagctggatgacgaaagtattcgccccatttgacagccagcggtgctgactgtcgccaaccctgaatgtgacttacctgaccggtaaatcacccctagcctgagagagaagcctatgtttggtaaaggtggtctgggtaacctgatgaaacaggcccagcagatgcaagaaaaaatgcagcagatgcaggaagagatcgcgaagctggaagtgaccggcgaatccggcgcgggcctcgttaaagtgaccatcaacggcgcgcataactgccgtcgcgtggaaatcgatccgagcctgctcgaagacgataaagacatgctggaagatctggtggcggcggccttcaacgatgcggcgcgtcgtattgaagaaacccagaaagaaaaaatggcgggcgtgtcctccggcatgcagttgccgccaggctttaagatgccgttctgatgcaagccagcccgctgttaaatcagctgatggaagcactgcgcagtctgccgggcgttggcccgaagtccgcgcagcgtatggcgttttcgctgctccagcgcgatcgcagcggcggtatgcgactggcacaggccctgacgcgcgcaatgtctgaaatcggtcattgcgcccagtgccgcaccttcaccgaacaggaagtgtgcaatatctgcgcaaatccgcgtcgccaggaaaacggtcaaatctgcgtggtggaaagtcctgctgacatctacgccattgagcagaccggacagttttccggccgttactttgtgctgatggggcatctgtcgccgctcgatggcatcgggccgaacgacattggccttgataagcttgagcagcggctgtcgtctgaacagatgaaagaggtgatcctcgccaccaatccgacggtggaaggggaggcgaccgccaactatattgcggagctgtgcgcgcagtatggcgtcgatgccagccgtatcgcccacggcgtgccggtgggcggcgagctggagatggtcgacggcacgacgctgtcgcactcgctggccgggcgtcacaagatccacctttagtaaaaatcagtaaaaaaaatcgggggcatttctttgcccccgcttgaaattcttcccgcatatccccatttccccctcaacaccaaatggcattgttgaggtattttttcgatgaaaggacaagaaacacgcggtttccagtcagaggtcaaacagcttctgcatctgatgatccactcgctgtattccaacaaagaaatcttcctgcgtgagcttatctctaacgcctcggatgcggcagataaactgcgctttcgcgcgttgtcgaatcccgatctttatgaaggcgacggtgagttgcgcgtacgcgtctccttcgataaagagaagcgtacattgaccattgccgacaacggtattggtatgaaccgtgacgaggttatcgaccatctgggtacgatcgccaaatccggcaccaaatctttcctcgaagccatgggctctgaccaggcgaaagacagccagctgatcggtcagttcggcgtcggcttctactcggcgtttatcgtggccgataaagtcaccgtgcgcactcgtgcggcgggcgacagcgcagaaaacggcgtgttctgggaatcggccggtgaaggcgattacaccgttgccgatatcaccaaagaggatcgcggcaccgagatcaccctgcatctgcgcgaaggggaagacgacttcctcaacgactggcgcgtgcgctctatcatcagcaaatactccgatcacattgcgctgccggtagaaatcgagaagcaggaagagaaagacggcgaaaccatcgtcagctgggaaaaaatcaacaaagcccaggccctgtggacccgtaacaagtcggaaatcaaagacgatgagtacaacgaattctacaagcacatcgcccatgactttaccgatccgctgacctggagccacaaccgcgttgaaggcaaacaggaatacaccagcctgctgtatattccgtcccgcgcgccttttgacatgtggaaccgcgatcataagcacggtctgaaactctacgtgcagcgcgtattcattatggacgacgccgaacagttcatgccgaactacctgcgcttcgtccgtggcctgatcgactccaacgatctgccgctgaacgtctcccgtgagatcctgcaggacagcaacgtcacccgtaatctgcgcagcgcactgagcaaacgcgttctgcaaatgctggaaaaactggcgaaagacgatgctgaaaaatacctgactttctggaagcagttcggtctggtactgaaagaaggcccggcggaagatcctgccaatcaggaaaccatcgccaaactgctgcgctttgcctccacgcacaccgattcgtccgagcagaccgtgtcgctcaccgattacgtgtcgcgcatgaaagaaggccaggagaagatctactacatcaccgccgacagctacgcggccgcgaagagcagcccgcacctggaactgctgcgtaagaagggcatcgaagtactgctgctctctgaccgcatcgacgagtggatgatgagctacctgaccgagttcgacggcaagccgttccagtctgtcgccaaagccgatgagtcactcgacaagctgaacgacgaagtggacgaaagcgcgaaagaggcggaaaaagcgctggagcctttcgttgagcgcgtgaaaaccctgctgggcgagcgcgtcaaagaagtgcgcctgacgcaccgtctgaccgacacgccagccatcgtcaccaccgacaacgatgaaatgagcacccagatggcgaaactctttgccgctgcgggccaggccgtcccggatgtgaagtacatctttgaactgaatccggatcacgctctggtaaaacgcgccgccgatacccaggacgacgcgcagtttaaagagtgggttgaactgttaatggatcaggcgctgcttgccgagcgcggcacgctggaagatccgaaccagtttattcgccgtatgaaccagctgctggtttcctgatagcgtcatttcctgccggataagcccctgcgcttatccggtctggacgatcaacctgtaggccggataagcgtcagcgccatccggcattttttcgccagaattaccgcttttcttataattccccattaaccgtttcagcgtcgggcgcctttcttgaggcgaaggcgtgataatggtatcttttagcgcttttttaaaaaattttgataacctttgaggggattttcgcaatgcgtatcattctgcttggcgctccaggcgcggggaaaggaactcaggcacagttcatcatggagaaatatggcattccgcaaatttccacaggtgacatgctgcgtgccgcggttaaatccggcagcgagctgggcaaacaggcaaaagacatcatggacgccggtaagctggttaccgatgaactggttatcgcgctggtgaaagaacgtatctctcaggaagattgccgtaacggttttctgttggacggcttcccgcgtaccattccgcaggctgacgccatgaaagaagccggtatcaacgtggattacgtgctggaattcgacgtaccggacgaactgatcgttgaccgtatcgttggccgtcgtgttcatgcagcctctggtcgtgtttaccacatcaaattcaatccaccgaaagtggaaggcaaagacgatgtgaccggcgaagagctgaccacccgtaaagacgatcaggaagaaaccgtgcgtaaacgtctggtggaataccatcagctgaccgcgccgctgatcggctactatcagaaagaagccgaagccggcaacaccaaatatgtgaaagtcgacggcaccaaagcggtgagcgacgttcgcgcagagctggccaacatcctcggctaatgcttttccccggtggcctcaccggggaactcccttctgttttccctttcgctacaattggtttcgtttacctgcaattcagctacaattatcgcccgtttagaaggataagaggcgcgaatgagtcaggcgaaaaccggcatactgctggcgaatctgggcaccccggatgcacccacaccccaggccgttaaacgctatttacggcagtttttaagcgaccggcgggtggtcgataccccacgtctgctgtggtggccgctgttgcgcggcgtgatcctgccgatccgttcaccgcgcgtcgccaaactttatcagtccgtatggatggaagaaggctcgccgctgatggtctacagccgtcgtcagcaacaggcgctggccgcccgtctgccggaaatgccggtggcgctcggtatgagctacggctcgccatcgctggaaagtgccgtggacgaactgctgtcgcagggggtggaacatctggtggtgctgccgctctatccgcaatattcctgctccaccgtggctgccgtctgggatgagctggcgcgtattctggcaaaaaaacgccgtatttccggcgtctcttttattcgcgattacgccgacaattcagcctatatcgacgcgctggtaaacagcattcgcgcctccttcgccgtacatggcgaaccggatctgctgctgctctcctatcacgggatcccgcagcgctatgctgacgaaggggatgattatccgcagcgctgccgcgacaccacccgtgaagtggtttccgcccttggcctgccgccggaaaaagtgatgatgaccttccagtcgcgctttggccgcgagccgtggctgacgccgtacaccgacgagacgctgaaaatgctcggtgaaaagggcgttaagcacatccaggtgctgtgcccgggatttgcggctgactgcctggaaacgctggaggaaatcgccgtgcagaaccgcgaattcttcctcgaagcgggcggcgaaaaatatgaatatattccggcgcttaatgattcagccgatcatattgagatgatggtcagcctgacggccccttatcgctgatcgcgaagcgggccgcgagtgtgctaccatttgcggcccaattcttcactattactgattatgaaatttcccggcaaacgcaaatccaaacactactttcctgttaacgcccgcgatccgctgttacaacaacttcagccggtcagcgacgccagtacttcctgggtggtgggtatcgatcagacgcttgtggatatcgaagcgaaagtggatgacgcgtttgttgaacgttatggtctgagcgccggacattcgctggtgatcagcgatgaagtagcggaagcgttgtatcaggagctgatgcgcgacaccctcatcacgcaccagtttgccggcggcaccatcggcaacaccatgcacaactattcggtgctggcggatgaccgctcggtgctgttgggcgtaatgtgcagcaacgtcgagattggcggctacgcttaccgctacctgtgcaacacctccagccgtaccgatctgaactaccttcagggcgttgatggcccgatagggcgctgctttacgctggtgagcgactccggcgagcgaacctttgcaatcagccctggcgcgatgaaccagctgcgcccggaaagcattccggaagcggtgatagccggtgcctcggcgctggtgctgacttcctacctggtgcgctgcaaaccggacgagccgatgcgcgacgcgaccatgaaagccgtcgagtacgccaaaaagcataacgtgccggtggtactgacgctgggcaccaaatacgttatcgccgataacccgcagtggtggcgtgatttcctgaaagagaatgtctcgatcctcgccatgaacgaagaggaagcggaagcgctgaccggcgagagcgatccgctgctggcctgtaacagcgcgctggactgggtggatctggtgctgtgcaccgccggaccggtcggtttatatatggcaggcttcacggaagagcaggcgaaacgcaaaactcagcacccgctgttgccgggcgctatcccggaattcaaccagtatgagttcagccgcgccatgcgtcatcaggactgccagcagccgctgcgcattttctcccacatcgcgccttacatgggcggcccggagaaaatcatgaacaccaatggcgcaggggatggcgcgctggcagcgctgctgcacgacatcaccgccaataacttccatcgcactaacgtgccgaactccagtaagcataactacacctggctcagctactcatcgctggcgcagatgtgcaaatacgccaaccgtgtgagctatcaggtgcttaaccagcattcgccacgtctgacccgcggtctgccggagcgtgaagacagcctcgaagaagcctactgggagcgctgatttcgtgatgacaggccggacaggatattgagccctgtccggcaacctcactttatcccgtcaccacctcgcccgcaggcggcgtttccagcagttccagcatggtgcgggcgatttcacgctcgcccatcaccacctgattagcaccgcgttcggtgatgtaatccacctcatcgtcataatgcgcgcgggcgataatctcaatattcgggcacttctcccgcgccgaggccacgatttccccggcttcatagccgttcgggatcgtcagcagcagccagcgggcgcagtcgagatgcgccagattcatgatctcttcgttggcggcgttgccgagcaccgcgcggataccccgctcgcgcagctcatcgacgcgggagcgggaggtttcgatcaccaccagcggaataccctgcgccatcagcttttcacccagcaggctgccgacgcggccaaagcccaccagcagcgcatgattacaaatgtccaccgggatctgcttctcttcttcgatggcttcttccagcgtctgctcttccagggtttcggttttatcaaggtatttttcaaggatggcgaacaggatcgggttcagcataatcgacaggatcgccccggccagcaccaggttctgcccggtctgcggcagtaaatccagcgccatccccagcccggcgagaataaaggcaaactcaccgatctgcgcgaggctggcggcaatggtcagcgccgtgcggggcgagtgaccgaacaggcgcaccaggaagaaggcggccacggatttaccgaagataataattgccagcgtgccgagaacggccagcggttcatcgatgaggatcagcggatcgaacagcatgcccaccgagacaaagaacagtaccgcgaaggcgtcgcgcagcggcagggtatcgtgcgccgcccggtggctcagttcggattcgttcagcaccataccggcgaagaacgcgccgagggcaaaggaaacgtcgaacagctccaccgcgccaaaagcaatgccgagcgccagcgccagcaccgaaagcgtaaagagttcccgcgatccggtcgccgcgctgcgtgcgaggatccacggcaccagacggcggcccaccagcatcatgatggcgataaaggccaccaccttaccgatggtgatactcatatccagcgccagggtggcgaggccgacattgcctttttccatcatgcccgccaccgcaggcagcagcaccagcgtcagcaccatcactaaatcttcaacgatcagccagccaatggcgatttgcccgcgctgactgtcgataagctgccgctcctcaagggcgcgcagcagcaccaccgtactggcggtggaaagacacaaaccaaacacgataccggtcatcagtgaccagcccatcagagacgagagcgccatgcccagcagggttgccaccgcaatctgtgcgatagcgccgggtatggcgatggactttaccgccatcagatccttcagcgaaaaatgcagtcctacgccaaacatcagcaggatcacgcccagctcggccagttcaggcgccagtttggtatcggcaacgaagcccggggtaaagggtccggctaacacacccgccagcaaatagcccaccagtggcgaaatgcgtaatttgttggcaagcatgccgaggataaaagcgagcacaaggccgccgacaatggtggtgataagcggtgtggcgtgatgcatcccatctcctttcgtgaaggtgtgtatccatttttggtcgaaaaccaaaagcccgaattacagtttatgacaattttaaccattatgttgatgaataattgttgaattctgaagaaaagagcaacctgtgctaaaaaatcgggcatcagccaggatctgaaaggagaggggctggcgggcagatggggcgggagaatcgggcgaccacccacacggtttggtcgcccgtaaattacgctttctgccggttatcgggcaggaatatcgttaagatccccagtaatggcaggaaagcacagattttataaaccaaaaagatactggtatggtcggcaaccagccccagcacagcggcgccaaggcctcccatgccaaaagcaaagccgaagaacagaccggaaaccatgccaatccgccccggaagcagctcctgggcatagaccaggatggcggaaaacgccgacgcgagaataaagccaatgatcaccgttaaaatgccggtccagtacagagatgcatagggtaaaacaagggtaaagggcgcaacgccgaggatcgagccccaaatcacatatttacggccaatcttatccccgagagggccgccaatcatggtgccagcggccacagcaaacagaaacgcaaacagatgatactgggcgttttgcaccgataaaccaaatttttccatcaaataaaaggtgtaatagctgctgatgctcgccatatagaaatatttcgaaaaaatcagcatcagcaggatggaaacggcgaggatcaccttattgcgcggtagcggattgattactttcaccgccggtttgcctttattgacgcgatgctgcgccgcataccagcggctgacctgcgccagcaccacgatcgccagcagcgcagccagcacgaaccaggcaacgttgcctttgccgtaaggggcgatcactaacgccgccagcaaagggccaagtgaactgccgaagttgccgcccacctgaaacagggactgcgccaggccatgacgtccaccggaggccatgcgcgccacgcgggatgactccgggtggaacactgacgatcctgtgcccaccagcgcggccgccagcagcaccatgccgaaactgcccgccagtgccagcagcaccagcccgctcagcgtaaagcacatgccaatcggcaatgaccacggcattgggtgtttatcggtataagcaccgaccaccggttgcagcagcgacgaggccatctggaaggtcagggtgatcagaccgatttgcacgaaagtgagggaaaactcagactgtaacagggggtaaatcgccagaatcagcgattgcagcatatcgttaagcagatgagagacgctgatcgcccccagaatgccaaacgaggtgcgcgcctgcggcgacgcaggcgatcccgacaaggccggggcgggttcacttattgccataaaattcacttctttttaatggtggaaggggcaggtgtttatcataaagatgactaataattatctgcctaacatacctgcccgaaaggtttgaaggaagtcgcaattctgaaaacttatttgtctaatattgccgggcacgctactttttgcgtctgttaaggatcagggagagaagcatgaaatttgtaaagcagggcatcgcgctggcaatgctggcggcactggggctgacgactttaccggctcaggcctacgaaaaagataaaacctataaaatcaccattctgcataccaacgatcatcacggccatttctggcgtaacgattaccgtgaatatggtctggcggcgcaaaaaacgctggtggacggtattcgcaaagaggtggcggcagagggcggcagcgtgctgctgctctccggcggcgatatcaataccggcgtgccggaatccgatctgcaggacgccgaacccgattttcgcggcatgaatctgattggttatgacgcgatggccgtcggcaaccacgagtttgataacccgctcagcgtgctgcgccagcaggaaaagtgggcgaaattcccgttcctctccgccaatatttatcagaaaagcaccaacgaacgactgttcaagccctgggcgattttcaaacgccaggacttaaaaattgcggtcatcggcctgaccaccgatgacacggcaaaaatcggcaatcccgagtatttcaccgacattgaattccgcaaaccggcggaagaagcgaagctggtcattcaggagctgaatgccaacgagaagccggacatcctgatcgccaccacgcatatgggccattacgataatggcgagcacggctctaatgcggcaggggatgtggaaatggcacgcagcctgccgacgggcgcgctgacgatgattgtcggggggcactcgcaaaacccggtatgcatggcgtcggaaaacaaaaaacaagtggattacgtgccagggacgccctgcgcgccggatcgccagaatggtatctggatcgtacaggcccatgagtggggaaaatatgtcggacgggctgattttgaattccgcaacggcgagatgaaaatggtgcgttaccagctgatcccggtcaacctgaagaaaaaagtgacctatgataacggcgacagtgaacgcgtgctctacacgccggaaatcccggaaaacgcccagatgctctccctgctgacgccgttccagaacaaaggcaaagcccagctggatgtgaaaattggtaacgtgaacgcgcacctggaaggcgatcgcagcaaagtgcgttttgtgcagaccaacctggcgcatctgatccttgcggcgcaaatggcgcgcaacactgccgatttcgcggtgatgagcggcggcggtattcgggattccattgaggccggggacatcacctacaaagacgtgctgaaagtgcagccctttggcaacatcgtggtctacgtcgacatgagcggcaaagaggtgaaagagtacctgagcgccgtggcgaagatgaaaccagattccggcgcttatccgcagtttgctaacgtcagcttcacttctgcgaacggccagcttaacgatctcaaaatcaagggcgaaccggtggatgacgccaaaacctaccgcatggcgacgctgagctttaacgccaccggtggcgatggctacccgcgcattgatgaaaagccgggctatgtaaataccggctttattgacgcggaagtgctcaagcagtttatccagcagaattcaccgctggatgccgcgacctttgagccgaaaggcgaggtggtctggcagtaaccctttctcttgccctctccctggggagagggccggggtgaggggcctactcgcggcgggcaatatcggcgaatttcgcatcaaggatcttcgcaagatccgccgccgccagctcaatatccagcccgcgtttgccgcccgacacataaatggtggcaaactgctgcgccggggcgtcgatcagcgtcggcagacgctttttctgccctaacggactgatgccgcccaccaggtatcccgtagtgcgttgcgccaccatcggatcggccatatccactttcttcgcgcccagcgccttcgccactttcttcagatccagctgtccggccaccggcgtgacggcgacggctaactgcttcatgtcgccgtttatcgccaccaaaagcgttttataaacctgatcggcattcaggccgagcttacgcaccacttcatcgccaaaattcgtttcgctgggatcgtgatcgtaagtgtgaagctgaaaagtaaccttgtttttttccagtaatttaacggcgggtgtcataaaaatccttcttaccactgaggtatcacacagccagcatacgccgggcaaggggcgcaaaaatagtaccatcttgcgcaatagtgttggcagttgcgctaactttgagcgacaattagcgcgcactggcgttaacgccagaactacaataatgatgaaattcctctttgacgggccaatataattattggccatttttttgccgcaacagcgtcggcaagttcccctctccgtacagatgcagcgcgcccgcggctaccacataatgccccggcggcaacgcctgcaaatgctcacaccatgcctgattacgctgatgcatcaggatctcatacagcggctcgctgaaggtcgacggcagcgcgatgtcccgatccgtgggcggtttgttcatccaccagccaatcatcacctgcaacagccgggcattggtgtgccagtgctccagcgtatccagcagcagggctttaccgtcgtcgggcaactgactcagcagatcgatttgattctgcgtcccttccagttccatcaccggaagcgccgcctgttttgccgcctgcaacagctgataatcaatgccgaaatccggacgcaggcccagccgctgcgcctgggtagcctgcaacaccagcgcgattttccacgcgggctgatcgtcaaagatgtcaggggcaagggataaggtttgtagcagcgtttcaagatcgcgctgttccgcgtccgtcagccgttccgccagcggcgcgcgcggcggaagatcgttgaagggcgaggcctggccggagacatcggcctcgacaatcagcgccgtcgcctgctgaagctttttcagcaagccagcgggcaggggggtcatgtcgcgcgtacccatatgaatactgccgaccagatgaagatgacgcccgccgggcagcgtcaaatctatcgcgggccacggataacggggggcccgcagtgcgtcaaaccaaacttttaaccggctaaacaggttcatacaggctcccgcaaaagaaaggaccatgctagcgcgcgaggaaggtgggtgcaaatcggctaacggcgaccctcccgcaggaaggccgccggtgcggatcaggctttaggtttgtagcgcaacaggcggttggcgttgctcaccacggtgatggatgacagcgccatcgccgcgcccgccactaccgggcttaacagcgagccggtaagcggccacagcacccctgcggcaatgggaatgcccagcgagttatagataaaggcccccagcaggttctgcttcatattgcgcagcgtcgctttcgaaatatccagcgcatccgccacgcccgtcaggctgtgacgcatcagggtgatagccgccgtttcgatggcgacatcgctgccgccgcccatggcgatccccacttccgcctgcgccagcgccggtgcatcattaatgccgtcgccgatcatcgccacctgacggccttcctgctgcaatttcttaatcgcatcggctttgccgtccggcagtaccccggcgattacctcatcgattccggcttcctgcgcaatggctttcgcggttaccgggttatcgccggtgagcatcaccagccggtagccggcctgatgcagacgcgccagcgcgctcacgctgtcggaacgcagcggatcgcggattgccagcagcgccacggcggtgccgtccaccgccaacagcaccggcgtcgcgccctgcgccgcccgggcggcaatcgcctcgtcaagcgcgcgggtatcaacgtgctgttgattaagcagcgcctggttgcccagcaacagcgcgtgattatccaccatgccgctgacccccagcccgccgagggtacggaaatcccgcacctccggcagctcgtcgtcagcggctttttcgacgattgcgcgggccagcggatggccggatccctgctccagcgccgccgccagccgcagcacctcgcgttcttgataagcgccggtcagggtgacggcgaccacctgcggtttgccttccgtcagcgtgccggtcttgtcaaagaccagtgtatccacctggctgccgcgttgcagcgcatcggcatcgcgcaccagcacgccatattcagcagcgcgcccgacgccggagataatcgacatcggcgtggccagccccagcgcgcacggacaggcgatgatcagcaccgtggtgacgatcaccagggtataaacaatttgcggcgcggggccgaagaaataccagatcgcgccgctgaacagggcaatggcgaccaccaccggcacaaaaatggccgagattttatccgccagctgaccgatttccggcttgctgctctgcgcctggcgcaccatgcggataatgcgcgacagggtggtgtggctgccgacggcgctggctttgaacagcacgctgccatcggtcattactgtcccggcgtgaaccgcatcgccctggcttttttgcagcggcaccggttcgccggtaagcatcgcctcatccagccaggcttcgccctggacgatctcgccgtcgaccggcacgcgatcgccggtggtcaggcgcaggatcatgcccggctgcacctccgccagcggcagggttttctcacccgcgtcggtgaccacgcgcgccgagggtggcgttaagtcgagcagacgttccagcgcttttgacgagcgcgcccgcgcccgtgcttccagcatatgcccgaggttaatcaggccgatgatcatcgcgctggcttcataatagaggtggcgggcttccatcgggaaggcgtgcggccaaaggttgacgctgatggaatagagccaggccacgcccgtccccagcgcgacaagggtatccatggtggcagtgcggttcagcaggcttttccaggcgctgcggtaaaaatgcccgcccgcgaacaccatcacggcgagagtgatagcgccgatcaccagccacagggtgcggttagcatcggtgaccatcatattgtcacccgtcatgccccacagcatcaccggaatacccaccagcagcgcgacaatggcctgccagcggaaacgttttaaggtcgcaagggcggtttcctgttggcgctcgcggcgcttcacatcatcttcgatgatctccgcgccgtagccggcattttccaccgcgctcactaattcagcggcggaggcgctgcccattaccagcgcagagcgctccgccagattgacccgtgcctggctgacgcccggtaccgcctgtaaggctttttgcacgcgggagacacagctggcgcagctcatgccgcttaacagcaactgctggctgtcttgcaggtcatccgctgccggaagctcaggttgcgccgctgtcagtgcttccgacgggagtgatgactctgccagcggtttagcctttgggtattcggggctcgcgtcgtacccggcttgtttaatggtatcgataagctccgccgcgctggcgctgccggtcacgtcggcatgggtcagcgtcacttccgcctgttcaacgtcagggcgctgctccagactttctttaacacgtttcacgcagtggccacaggtgaggccatcaagcgctaaagcgatggtttgcgacataattaaactcctgtaatttcggttgaaccaatacacacattgattacagttataaaggttaaaccttccatcaaggggaaggtcaagggggaaagatgaatatcagcgatgtggcgaaaaaaaccggcttaaccagcaaagcgatccgtttttatgaggaaaaagggctggtgacgccgccgttgcgcagtgacaacggttaccggcactacacgcaaaaacatctcgatgagctgacgctgctgcgtcaggcgcggcaggtaggatttaatcttgaggagtgcggcgagctggtggggctgtttaacgatcctgcgcgtcacagcgctgatgtgaaagcgcgcacgctgcaaaaagtggcggagattgagcgccacattgttgagctgcaatcgatgcgcgaacagttgctgacgctggcggcctcctgtccgggcgatgacagcgccgactgcccgattattgataatctctcgggctgctgccatcgcaaggcgcaggcataatcagcctgcttcccccggagaaagcgcctggcgaaaccagcgggtacgcgataacagcaaagtaaacaggccggtgcacagtagcgacgtgcccatggcaacaaagtagatcgtccagtgttccgtaaacaccgacagaaaacccggcagcccggaaatgccaatcgacggggctttcacctgatagctggcgacgatgctgcccgcgatgcctgcgccgaacatcgccgccataaagggaaagcgatagcgcagattaacgccaaagatcgccggttccgtgacgccaagccaggccgataccgcagcgattgcggccacgccctgcatctttttattgcgcaccagaaagaaaatcgtcatcgcgcccattccctgggccaggctcgccatcacctgaatcggccacagggtggtgtaccccagggtgccgatcatttgcagattcacgcctaaaaacagatgatgcatccccgttaccaccagcggcgacaggatagcggcgaaaaccccgcccgccagcccaggcgcgacgtcaaacaaccacaaaatgctgccggtcatgccatttcccagcagcatggtcagcggaccaatcactaaaaatgccgcaaagccggtgaccagcagggtcacgggcgcgacgataatcacctgcaccatatccggaaccacgcgcgccagtaaacgctcagtacgcgccagtaaccaggcgcaaagcagtacggtgatcacctgcccctgataggccacttttttcagttccaggcccataatcgaccagtactgcacctgatccggcgtttttgagaactgctgggcgctcattaaatccgggtggatgagcagcagaccaagcacaatccccagcaccggattaccgccgaattttttcactgccgaccagccaatcagcgcaggcaaaaacagaaaagaggtgttggcgataagattaataatgccggacacgccctgccaggagggataatgttttatcagcgcatcatcaaaaaacagccccggattaaccagaatattattcagccccagtaatagcccggaggcgacaatcgctggcaggaccggaataaatatatcggcaagagtctttatcagttgctgtaaaaggttgccgcgtttttcggatggtttttgggaagggactggagtatttccgcgctgccgggaaatttcctcataaaccttatcaaccagcccggggccgataataatctgaaattgcccgttagcgttaaaacaacctttaactaaatcattgctttccagttcctgaatattaatacacttctcatcatgcagtaccagccgcaatcgcgtcaggcaatgtcccattgaaatgatattattactcccgccaataagtgtaagcagcgaactggcgttatcctccagcgttcctttcatgattttcgtcctgaagtatcgggtgccgctccggataattacacgcgcttttttatactgtcaatacacttaatttattgattttatgaatatattgtttataagttatccgtgctattcgccgttgtttttctggacagaaaccgggcgtagtgccacgatggacgcgatattcttcgcaaatggaattccgatgatgcagcccaatattttgctgatgatttcccatgacagcggacgtaaatttcagaactacggttatcgggtggcaacgccgcatattaatgccctggcgcaacgcggcctgcaatttgacaattgttattgtccagccccgcaatgcagccccagcaggggcgcgttattaaccgggttatacccacataataatggcctcatcgggcttgcgcatctcggtttttgtatttcagagggtgtaactactttaccaaaagaattacaaaaaaacggctattatacggcgctgatcgggctcagtcatgaaaccattaataacgcgccgccggtcgcggaacgcatattctcctctaccaccgcgcttggctacgatgactatatcccggtgcccggcgagcgcgcgtcacaggttgccgattcggtgatcgattttctcctccgccatcagcatgacgatcgcccgttttatcttaacgccggtttttttgaaacccaccgcgatttcgatgaatatcagccagttgcagatcggcctgacgaggtggaggtattcgattttctgccggatgtggatgccgttcgccaggatatcgccctgtttaacggcgcgttaaagatgctggacagtgctgtggggcgtatttgcgcggcgctggatgcaacgggactgggcgataacaccatagtggtgttcaccaccgatcatggcgtcgcctttccgctggcgaaaggcaccttaaaaacggcggggctggagacggcgctgattatcgtgctgccgggcaaagcggctgtcaccggccgtcggcaggcgctgttgtgcaatatcgatctgatgcccaccttgcttgaacttattggcgcagcctgtccccacgggcttgatggcaaaagttttgcttcgcttttgcacagcccgtgcgacgaagggcgggagtcgttctttaccgagctgacctggcacgacaaataccaccctatgcgcggcgtgcgtaccgcccgctacagctacgtcaaaaattttgccgacgggccgctggtctatattcccgttgatgcgcatctgagtctgtctgggcttgcggtgcgggagcggctgtacgtgcctaacgagccggaggagctatacgatctgcatctggatccgctggagaaaaataatcttatcgctcatcctgactatcaggccatcgccgcccggctgcgtgagcgcgtggcaaactggatgcgtgaaaccgacgatccgttgcttagcggtccggtgaaaggcgttgagtcacggcgctgggcgcaggagatcgccgccggtcgggcgtatccgggacgggaaaagtggcagaagcagatgaaaagcccggaggacgatgaccgcaccgggtaaaggggcggccatcgggggaagggatcagcgggcgcatatccgcagcgtgatcccctcaacggctaccaccaccaccggcgtcccggcaggcagatcctcatcggcgctcaccggccaggagctgtcgcccacccgcatgtgtccgcggccattcaccagccccgtttccagcgtaaagcgacggcccaccagctgaacgccccgctgattcagcgcggcatcggcaggtttttgttctttcacccgccgcgccagccagcgccaccacagccaggcggccagcatggtcagcagggaaaacatcaccccctgccactcccagccaaagggcagcagccagaccacaaggcctgtcaccaccgcggccacgccgctccacagcagataaccgttgccgccgagcatttcagccgctagcaggatcccgccgaggcttaaccagaaaatgtgcggatgcgcgagcaggatgtccatggctatttcttccgcgcagtggcgctgtcgctgagcagttctgaaatcccggcgatggatcccatcaggctgctggcgtccagcggcatcatgatcactttgctgttattggacgagccgatatgttgcagcgcttcggtatatttttgcgccacaaagtagttcaccgcctgaatatccccggcggcaatcgcctgagacaccatcttggtcgcctcggcttccgcttccgccgaacgctcgcgcgcttcagcctgcaggaaggcggactgccgctcgccttccgctttcaggatcttcgattgcttctcaccttcggctttcacaatctctgcctggcgaataccttcggcttcgagaatataggcgcgcttggtacgttccgctttcatctgcgcgttcatggcgtcaatcagttccgctggcgggcgcacatcgcggatctcaatacgggtgatcttaataccccacggattcgtcgcttcatcgacaatatgcaacaggcgggtgttaatgttatcgcgctgcgacagcatttcatccagctccatggagcccagcacagtacggatattggtcatcgtcaggttgatgatcgccagctccagattgctcacctcataggcggctttcggcgcgtcgatcacctgaataaagcacaccgcatcaatggatacgttggcgttatctttggagatcacttcctgggacgggatgtcgagcacctgctccatcatattgattttacggccaatgcggtccataaaaggtaccaccaggctcagccccggttgcagggtgtgggtgtaacgcccgaagcgttcgacggtccactgataaccctgcggcacgattttcacccccgcgccgaccaccaccagagcaacaaagataagaatagggataacgataagcataaaacctcctgttattaaatccgtgggtattgaattacatccatttcattgcgggtaagtataacttttatcgccatcaggcacccctgttaatcctgagggtgaaaaagggcgggaatgaaatcaaaagatgcggacgctttatgcaacaggataagaccgcacggcaagtacggaatatgacttttcagactaagtggtaacccgcaggctggcacaataccactgcactccgtaggccgggcaagcctgcgccgcccggcgaaacccatgtcagtacagcaaagaatacagcttacggcgatatttcgacgccagcgcatcacccgtgccaagcgctgccaggatctcctgcaacatcttacgcgcctggccgtcggcggcattcagatccttgctcagatggctgaacagcaactccagcgcttcttcattgcggcccacctgatgcagttgcagcgccagctgcgtggcgagcgttgcgtttgccggatcgatttccacctgctgttgcagcagctggatctccggcgtatccgccgcctgtttcagcagatcgatctgcgccaccagcccctgatagcgggtatcctgatcctgcatcgggatggttttcagcaccgcttccgcatcctcggagcggttaagggcgatttgcgtttccgccagcagcagaccaatttcgctcgcctgatttgaaagctgccaggcctcttttaacagaggcagggcatcagcatagttgccttcttcgatcagctgcattgcctgctgcgctttcagctcttcttcacgcggcagcactttttccagcagcgcgcggatggcttcttccggctgcggcccctggaaaccatccaccggctggccgttctggaacaggtaaacggtcgggatggcgcgcaggccaaactgcgaggccaccatctgctcggcgtcgcaatcgaccttcgccagcaggaactgcccgttatactgcgccgccagcgactccagcaccggcgtcagttgctgacaatgctggctacgctcggaccagaaatagaataacaccggcgtggcgacagactgctccagcgtttgctgtaggttcgcttcggtaacattgacaatattttgtacggacataacgttttctctgttttcgcgtttatctttacatggggtcaggcgtggagccttcaactcagccgcgtaaaattttatccatcagacgatccggtaacaggcgttttaatacccttaccgcatgggtgaccagcgtcaccggataacgtacttttggccgcttactctcaaaagcatggcgcactttggcgaccactgcctccgggccgagggtaaaacgtgcggcgatacccggattttccaccggcttgtcgctggtctgattgacgtttttcgtaaagcgggtgcggatgggaccaggttcaatcaggctcaccttaatgcccgtgtgccgcagctccatacgcagcgcatccgaccaggcttccagcgcatatttactggcggcataggccccgcgaccgggcgtggagatcagccccatcactgatgacgtcatcacgatacggccctcaccgtgggggatcatcgcgggcagcaggcgcatagtgagctggtgcgcgccaaaaaagttggcggaaaactgctgctccatctgctcgcgggacacggtattaagcgcgccatagaccccgtaacccgcattattaaagaggccgtacagacggttttcggtgcgcgcaattacctcatcggccgcgcgatccacactttccggcgagtccagatccagtaaaatgccggtaaaacccatcgcattcatccgcgatacgtcatcgggtttgcggcaggcggcaaggatatgaaatccctggcgcttcatctctactgccgtttccagaccaattccgctggaacatcctgtaattaagaccgatttttgcataactttacccgtcggctttcccgattatttatgaggcgtggtttactaaaggtgccaggcgtgtcgccatccagtcggcgataaacggctgggcgtcagggttaggatgaataccatcgtcctgcatccactgcggtttcagatagacctcttccataaagaagggcaccagaggaatatcgaactcgctggcaagtttgggatagatggcgctgaacgtctcagtgtagcgacggccatagttcgccggcagacggatttgcatcagcagcggttgcgcgtcggcggcttttatttcctgcaaaattttacgcagcgtggcttcggtctgcgccggtgcgaaaccccgcaggccgtcattgccgcccagttccaccagtacccagcgcggctgatgctttttcagcagggcgggcagacgcgccagcccctgctgcgaggtatcgccgcttatactggcattaactaccggcgtcttctgctgccatttatcgttgagcagcgccggccaggccgccgttgccgccatgcgatacccggcgctcaggctgtcacccagaaccaacaacgtgtccgccgcggcggcgcgacaggttaacagaagcataaaaaggaagggcaaatgccagcggaaaacattgttgaagttcatcatcttaagaagtccgtcggtcagggggaacatgagctgtccatcctcaccggagttgagctggttgtcaaacccgcgcagaccatcgcgctgattggcgaatccggatccggcaagtccacactgctggcgatcctcgccgggctggatgatggcagtagcggtgaggtgcacctgctggggcagccattgcacagtatggatgaagaagcgcgggcagccctgcgcgcgcagaacgtcggctttgtctttcagtcctttatgttgatcccaacgctgaacgcgctggaaaacgtcgagctcccggcgctgttgcgcggcgaaaagagcagccagagccgggaaaatgcccgcgcgctgttaagcgaactggggctggcgaagcgtcttgatcaccttccggcgcagctttccggcggcgaacagcagcgcgtggcgctggcgcgcgcctttaacgggcgtcccggcgtgctctttgctgatgaacccaccggcaacctcgatcgccagaccggggataaaatcgccgatctgctgttttccatgaaccagcagtacggcactacgctgatcctcgtcacccacgatccacagctcgctgcccgttgcgatcgtcgtttgcggctggttaacggcctgctgcaggaggaagcatgatcgcccgctggttctggcgcgaatggcgctcgccatcgcttttgatcgtctggatggcgctgagtctcgccgtcgcctgcgtgctggcgctcggcaacatcagcgaccgcatggagaaaggcttaagccagcagagccgcgactttatggcgggcgaccgcgcgctgcgcagttcccgggagatccccgacgcctggctggatgaagcgcgtaagcttggcctgaaagtcggcacgcaaatcagctttgccaccatgacctttgccgatgacacgccgcagctggcgaacgtcaaggcggttgatgacatctacccgatgtacggcgagctggaaacccgcccggctggcgtaaagccgcagccgggaagcgtgctgcttgcgccgcgtctgatggcgctgctgaaactgaaaaccggcgatgaaatcgatgtcggcgatgcccgtttacgtattgccggggaggtgatccaggagccggatgccggtttcaatcccttccagatggcgccgcgcctgctgatgaacgtggcggatgtggcgaaaaccggcgcggtgcagcccggcagccgcgtcacctggcgcatcaagtttggcggcacggccgcgcagctggaagcctacgagaaatggctgctgccgcagttaaagccggagcacaaatggtacggccttgagcaggatgaaggggcgctcggcaaatcccttgagcgctcgcagcagttcctgttgctgtcggcattgctgacgctgctgctggcggttgccgccgtagcggtggcgatggggcattactgccgcagccgctacgatctggtggcgatcctcaaaaccctcggtgcggggcgcgcccagctgcgcaagctgatcgtcggccagtggctgatggtgctggggctgtcagtcattacaggcggcgccatcggcctggtgtttgaacgggtgctgatgatcctgctcaaacctgtgctgcccgccgcgctgccgcctgccagcctgtggccgtggttgtgggcggtgggcaccatggtggtgatctccctgctggtagggctgcgtccgtatcgtttgttactggcaacgcagccgctacgcgtgttgcgccgcgatgcggtggccagcgtctggccgctgaagttttatattccggctattagtatcgtcaccgtcctgctgctggcctggctgatgggcggcagcatgctgctgtgggcggtgctggccggggcggtggtgctggcggcgctgtgcgggctgctcggctggatgctgcttaacgtgctaaaacgcctgacgctgaaagcgctgccgctgcgcctcgcggtgaatcgcctgctgcgccagccctggtccaccttaagccagctgtcggccttctcgctgtcatttatgctgctggcgatgctgctggtgctcagaggcgatctgcttgaccgctggcagcaacagctgccgccggaaagcccgaactatttcctgatcaacattgcttctgagcaggtcacgccgctgaaagggtttctctcggaacatcaggtgatcccggaatccttctatcccattgtaagggcgcggctgacgcagattaacggcacatccacggacggcaatcaggatgaagccttaaaccgcgagcttaacctgacctggcagtcgcaaaaaccggatcacaacccgatcaccgcaggcagctggccgccgaaaaccggggaagtgtcgatggagcaggagctggcgaaacggctgaatatttcgctgggcgacagcgtgacctttatgggcgatacccaggatttcaccgccagagttaccagcctgcgtaaagtggactgggaaagcctgcggcctaacttctacttcatcttcccgcctggcgcgctggacggacagccgcaaagctggctgaccagtttccgctgggaaaacggcaacgagatgctgacgcagcttaaccgcgaattcccgacggtcagcctgctggatatcggcgcgatcctgcaacaggtcggtcaggtgctgcaacaggtgagccgcgcgcttgaagtgatggtggtgctggtgaccgggtgcggcgtgctgctgttgctggcgcaggtgcaggtaggaatgcgtcagcgtcatcaggagctggtggtctaccgcacccttggcgcgggcaaaaaactgctgcgtaccacgctgtggtgcgagtttgcgctgctcggttttgtctccgggctggtggccgccatcggtgcggaaacggcgctggcagttctgcagacgcgtgtgttcgacttcccgtgggagccggactggcggctgtggctggtgctgccgctttccggcgcgctgctgctgtcactgtgcggcggctggcttggcacacggctgctgaagggcaaagcgctgttccgtcagttcagcggttgattctctctgcccctctccctgcgggagggggcatcgtccatcgctccccctctccctgcaggagggggccggggtgagggcattgacgatcccctgtcattcagtgacatactcagtagcatcatgaaatattttcaattactgccgcgccgcctttatgccatcttaaaccgtcaaattctgaatgcgccgcgtagcacggtgcgtcacacagcacatatcacattgatcaggagaaattatgggacgtcgtttcagcgtgcgcgccgccgtcggggcattactgttaacctgcgggcttgcacaggccagcgatccacaaaccatcaccttcggcgtggccccaggcccctatggtgacatggtaaaacaggccatagcgccgtcgctgaaagaaaaaggctacaaagtggtagtgcgcgaattcagcgactacgtacagccgaacatggcgctgtccaacggcagcattgacgccaacctgttccagcactcgctctatttcaacaaattcgttgccgataaaaacctcaagctgacgaagctgattaacgtgccgactgccggcatgggcttttactcgcacaaaatcaaaagcctggatgagctgaaaaagggggatatcgttaccctgtctaacgatcccaccaacctggcgcgcggcctgcgtttcctgcaatccctcggtcttatcaccattaaagacaatatcgatccgaccaaagcttccgagcgcgatatcgccagcaacccgaaagggctggtgttcaaaccgctggaagccgctcagctaccgcgtaccctcgacagcgccaccgccgccctggtcaacggcaactttgctatcgccgcgggcatgaaactggactcggcgctgaagcaggaacagctggatgataatctgaaaaatatcatcgccgtacgtagcgaagacgccgaaaaacccttcgcgaaagacattgttgcagtagtcaaatctccggcttaccgcgcggtgatcgactcgccagacaacgtctacagcgcgttccagaaacctgaatggatggttgctgcggataaaaaataagcggcacacaggattaattctggcaggctgcggcctgccttttgcatttcgaggacggcatgattgagatagataaggtctgcgtggactttcccgcaggccgtggcccgacgacccgggcggtggacgacgtcagcctgcgcattgcgccgggcgaaatttttggcattgtcggcaccagcggcgcgggcaaaagcaccttattgcgcaccctgaacgcgctccagcgtccctcgcagggcagcatcaaaattaatggcgtcgagatatccgcgctggaaggcgtcaccctgcgccgcgcgcggcaacgtatcggcatgatcttccagcattttaacctgatgcacacccgtaccgtggcgcagaacgtcgccttcagcctgaaagcggcaggctgggagcgggcgaaaatcgccccgcgcgtggcggaaattcttgagctggtagggctggcggataaagcgaatcgctacccggtacagctctccggcgggcagaaacagcgcgtcggtattgcccgcgctattgccaatcacccggacgtgctgctgtgcgatgagccgacctccgcgctggatctggaaacctccgccaccattctggcgctgttaaagcagattaatgacaccctcggcatcaccattgtgctgatcacccacgaaatgaacgttatcaaaaccatctgcgatcgcgtggcggtaatgtccggcggcaaagtggtggagatgggcgaggtgtttgatatttttgcccacccgcagcacgcgttcacgcagcagttggtgtctcacaccctgaacctgacgctgccggaacgtctgcaacagcatctgccggggcagttgctgaagatcctgtttattggcgattcggcggagcagccggtgttgtccgacgcggcgatccagtttggcgtggcggtgaacatcctgcacggcaaaatcgaatacctcggcgagcgggcgctcggcattctggtcgtgcagctcaccgctcccgataacccgacggcggtggacgccgccgttgattatattcgcaaccgtacggcacgcgtggaggtgatccgtggatgagttattaccggatttgatgctggcgtttaatgaaaccttccagatgttgagcatttcgacggtgctggcgatagtcggggggttaccgctgggctttctgattttcgtcaccgatcggcacctgttctggcaaaatcgcggcgtttatctcatcagttccgtactggtgaacatcatccgctcggtgccctttgtgatcctgctggtcctgctgctgccgctaacgcagtttctgctcggcaacaccatcgggccgattgccgcctccgtaccgctgtcggtggccgccattgctttctatgcgcggctggtggacggcgcgctgcgggaagtggataagggcattatcgaggcggcggaagcctttggcgccagcccgatgcgtatcatctgcaccgtactgctgccggaggccagcgccgggttgctgcgcggcctcaccatcacgctggtcagcctgattggctactcggcgatggcggggatcgtcggcggcggtggcgtgggggatctggcgatccgctatggctactaccgctacgaaacccaggtgatggtggtgacggtgatcgcgctgattattctggtgcaggtggtgcagatgctgggcgactggctggccgcgcgggcggacaagcggggccgccactgattacccctgtagcagccagccgttgacctcctgccatgagccgcgaaagacgatcttcgcggctttcttttccagctgatagcggtacatcggatcgtaatactccttcagtaacggcaccagccaggcattatgaccttgcgtgtcgccgtgctgccgctggctcgccagcgccgtatcaaggtgcgcgctgagttcggcaaagcgctgcaagcccagacggcgacgaatggcgtacagcccgtgatgcaggtattccgcataggccagccagcccgcgtcttcgccgtacgtcacggtaaaatcgcgctgcatccgcacaaaatattcctcatgcagacgcgccacccgcaggtcgaacggatcctccaccaccgcgatgggcgactgcgccatgcgatcccgcaggcactccggcagatgattagcgccgatcatacggccttcatcttccagcacccagcgcgccgcatcccgcttaagcagtttcaccgccagggcgttctcaaagctcgcctgggaaagttgcggcctgagcgtgcggccaaatgacgaaccgcgatggcgggccagaccttccagatcgatgccgtccgcatgctggcgtaccagatccgtttttccgctgccggtgcagccgccgatcagcaccagcggacgctgtacgcgctgctctgttgcctggatcgccgcctggcgcagcgccttatagccgccggggatgagcggataatcaatgcccgcctcgcgcagccactgttgggtgatatgagagcgctggccgccacgggcgcagcacagatagccatcaggatggcgcaggcaggcatcacgccaggcctgtatgcgctgctcgcgcgcgacgccggataccagttgatgcccgagcttcagcgcggcttccgggccctggcgtttataacaggtgccgaccgccgcgcgctcttcgtcgttcatcaggggaagattgagcgccgacggcattgcaccctgggtaaattcaaccggggcgcgcacgtccagcaggggcgtatcagcggcgaggatcgcgcaataatccatgccagtgttcatgggacttccttctgcacatcaaagggcgacgttttacgtcagatcgccgtattttacgctttcatttgtgcggtggggaaaaaattgcggggctgtgttgccgggtggcggctgcgccttacccggcctacgggggggactttgtaggcccgacaagcctgcgccgccgggcgatagcgctacgctaatttcgactgcgcccaggcgataccgctggcgtattccggcggcagtagcgggagcagggcttcgagggtggcgctcaggcgatcggtgtcggcatcattgagattcagatgtccgaccttacggcccgggcgcacctctttgtcgtaccagtgcagatgcaccagcggcagcttcagccagtcataattgagatcgctgccgatcaggttgatcatcaccgacgggctgttaatcaccggttgcggcatcgccagcccggtaatggcgcgcagatgcagttcaaactggctgatggacgcgccgttctgcgtccagtgcccgctattgtgcacgcgcggggccagctcattgatcagcagtccgccaggggtgacaaagcactccatcgccatcacgccgacgtaattgagttcattcattaccgcgctgagcatggtttccgcctgcgtctgctgggcggcgttcgcctgcggaaaggccacgctggtgcgtaaaataccgtcctgatgcaggttgtgtgtcaggggataaaataccgtgctgccgtcatgcccgcgcgcgccgaccagcgatacttcgccggaaaaattaatgccctgctcaacaatgcattcaccgtagcagtcgtccggcagctgatcggtatcgtccgcacgcagacgccactggccgcgtccgtcgtaaccaccgacgcgacgtttgacgatcgccagctcgcccaggcggtcaaacacgccagaccactcatcgcggctggccagcaactgccagggggcggtggcgaggccgagggtatcgaacagctgcttttgcgtcagacggtcagcgatgatcgggaacacgtcgcggttgacgaacgccgggtgacgggccagctcgcgggtgagggcggtttccggccagcgctcgatttcagcggtgatcacgctttgcgcgaaaggcaccgcttccggctccgcatccagtcccaccggccataccgcaatccccagcggctcaccggcctggcgcagcatccggcccagctgaccgttacctaaaatacagacctgtttcatgcttcgctccgcggatccgggttatccagcacttcatccgtctggctttgtcgccactcgaccaggagctgatgcagctcgcgatcctgagtagcgaggatctgtgccgccagcagcgcggcgttggcggcaccggctttaccaatcgccagcgtgcccaccggaataccgcgcggcatctgcacgatggagtaaagactgtcgacaccgcttaacgcggcgctttgcacgggcacacccagcaccggcaccagcgttttcgccgcaatcatgcccggcagatgtgcagccccccctgcgccggcaatgatcacctgataaccgttctgctctgcgctttcggcgaagctgaacagtttgtcgggggtgcgatgggcggagaccacttcaacatggtaagaaacgtgcagaagatcgaggatttcagtggcgaactgcatggttgcccagtcgcttttggaccccatcacgatggcgatacgcgccggattattgcgggaagacatgcgccttaaaactcctgtgggtgtgcttcagactgcttttaaggccacagagaatagcatggataattagcaaggaaaacggttgcgtaacgcggtaaaggtcaaatacaggcgttttctcagaagggaaacgcgatcagttcaatcttgtcagcggttactttcaccattgagccttcactgtgccaggcacccagtacataacgacaggcgggtttaccgttggcggtcagcgcgtgaatatccgggcgatgggtatgaccgtggatcagatgctgcacctgatgcttttccatcaccttcaccaccgcctgtgggttaacgtccataatcgcctgagatttggtgcggttggcggatttgctgccggcgcgcattttcgcggcgatgcgcatgcggataaacagcggcagggcgaggaacagcttttgcagccaggcctggtgaactttggcgcgaaacgcctgatagcccgcgtcatcggtacacagggtatcgccatgcaggatcagcagccgtttaccgtacagttcaaggactttttcttccggcagcagcctcatgccgctttcccgggcaaaacgctggccgagcagaaaatcgcggttgccgtgaatgaaatacaccgggacgccggactccgccagcgctttcagcgcggcggcgatctgccggtgcaggggattgggatcgtcgtcgccgatccaggcttcaaacagatcgcccagaatgtacaacgcgtccgcttccctggctgtaccggccagaaaacgcagaaaaccggcggtgatcgccggttcttctgtttgcagatggagatctgcaataaagagtgtcgccaccgattactcgctgacggtcacgcttttaatgattacgtcttctttcggaacgtcctggtgcataccgctgcggccagtagaaacggctttgattttatcaaccacgtccatgccttccgccacttcggcgaatacgcagtaaccccagccctgcaggctttcgccgctgaagttcaggaagtcgttatcaaccacgttaatgaagaactgcgcagtcgcagagtgcggcgcctgagtacgggccatggccagcgtgccacgggtgtttttcagaccgttgttggcttcgtttttaatcgcctctttggtctctttctgcttcatacccggttcaaaaccgccgccctggatcataaagccattgatcacacggtggaaaatggtgttgtcgtaaaaaccttcgcggcagtagtcgaggaagtttttaacggtttcaggtgctttatcatcaaaggttttgattacgatatcgccgtgattagtgtggaaagtaaccattgttgcatcctgttctgtttggtaagtcgcgtagacccggcaatgggtcagagataatcgccttttatagcataaccctgaggttcgatcaccttgcaaagggtgctgcttcgctgccgaaatatggttatgataagaaagatattctccacacacgtctaaacggaatcttcgatgcttaaaatttttaataccctgacgcgccagaaagaggaattcaaacctatccatgccggtgaagtgggcatgtacgtgtgtggtatcaccgtttacgatctgtgtcacatcggccatggccgtacctttgtggcctttgatgtggtggcgcgctatctgcgtttcctgggctatcagctgaagtacgtgcgtaacatcaccgatattgacgacaaaatcattaagcgtgccaatgaaaacggcgaggaattcgtcgcgctggtggatcgtatgatcggcgaaatgcatgcggatttcgacgcgctgaatattctgcgtccggacagcgagccgcgcgccactcaccatattcacgagatcatcgatatcaccgcacgtctgatcgagcgcggtcatgcttatgtggctgacaacggcgacgtgatgttctcggtacccaccgatccgaactacggcaagctgtcgcgtcaggatctggatcagttgcaggccggtgcgcgcgtcgaagtggcggacatcaaacgcaacccgatggatttcgtgctgtggaaaatgtccaagccgggcgaaccgagctggagttcgccgtggggtgaaggccgtccgggctggcatattgagtgctcggcgatgaactgcaaacagctgggcaaccatttcgatattcatggcggcggcgcggatctgatgttcccgcatcatgaaaacgagatcgcgcagtccacctgcgcccacgacggcgaatacgttaactactggatgcactccggcatggtgatggttgaccgggaaaagatgtcgaaatccctcggcaacttcttcaccgtgcgcgacgtgctgaagtattacgacgcggaaaccattcgctacttcctgatgtccggtcactaccgcagccagcttaattacagcgaagagaacctcaggcaggcacgttccgcgctggagcgtctgtataccgcgctgcgcggcaccgataaaaacgtggctccggcaggcggcgaggcctttgaagcgcgctttatcgaagcgatggacgacgatttcaacaccccggaagcctattcggtgctgttcgacatggcgcgcgaggttaaccgcctgaaagcggaagatatcaacgccgcgaacggcatggccgcgcagctgcgtaagcttgcgggcgtgttgggcctgctggagcaggatgcagaacagttcctgcaaagcggcgcgcaggccgatgatggcgaagtggccgagatcgaagccttaatcaaacagcgtctggatgcgcgccaggcaaaagactgggccgccgccgatgcggcgcgcgatcgtctcaatgagatgggcatcgtgctggaagacggcccgcagggaaccacctggcgtcgtaagtaagtcagtaacgcccggcgccgcgttgcttgccgggcctacaaattgtcttgtaggccgggtaagcaacgcgcacccggcaattacggctctgtgttgtaggccgggtaagcgtagcgccacccggcaattgcggttctgtcttgtaggccgggtaagcgcagcgccacccggcaacggcaaatcacgcggactcccgcgccactaactggccggacagggttatccgctgggtaagcagatccggctctttcagtttacgtatgatcagcgccgccgcctggcgtccggtctcttcactcgctgacgacacgtaggtgaaggacggtgacgtcagattcacatgcagcatatcttcaaatcccaccagcgccacctgttgcgtcagaaacacatctttacccaccgtgcgcccgacctggctgatgccggacaaacagccaatcaccgcatcaggcgaatggcacagcagggcagtgatcttattgttcttctccagcagctgacgggtggcgtggctggcggcatgggtgccgtcgcagcaggccggggtaaactcttcccgcgtcaccagcccgtactgggttaaggcgctgcgaaaaccgagcagccgctgctggcgaataagattattttcactgccgccgatataggcgatattacggtgaccgcgctcgataagataacgcgtggcaagattggccgcctgacggttatcgcgcatcactaagtcgcagggctcgtccagcagggattgcgacaccaccaccagcggcagcgggcattcccggatctgctgtggtacgttcgcccgcgaggcatccgccgccagatagatcacccccgccacgccctgctgtttaaacgacagcagacagcgctcaaggtgttcctcatcgttgagcggctggccgagaaagaccataaaaccctgtttctccagctcctgcacaatgctggccatcactttgatagaaaaactgtcgctgaaatcccgtaaaattaggccaataagattggaggtactggagcgcagattggctgccgccacgttgtgcacgtagccgagcgtggtgatggacgcctgcactttctcaatggtcgcagccgaaattttccctttctgacgcagcaccagcgaaacggtcgaaacagaaacccccgcatgccttgcgacatcaataatgctgaccttcttcaaacgcgctccctgaaatcaccggataatcagccaaatatgacaacgtctcctgcgcgggcagaagacgttatcaccttaacagcttcgggttatctgcccatcataccggacatggtttgtgcgataaattgtgcgcgcgccccaaaaatcacctgtacgccctgatcgccgacgaacaccacgccccgtgcgcccagattgttcagcccgtctttatccaccagcgtgcccttcgccacttccagacgtaaacgtgtgatgcaggcgccgaccgagctaatgttctgctcaccaccgagcagggcgatgatttccgtggcgagttcgtcatcggttttatcgctgacgctggcggtgatttccgtgcggcccggcgttttgacatcaaaacgacggatcacgaagcggaaggtgaagtagtagatcaacgccatcggcacgccgacgataatcgcgctcaggaagttggtctggaagccgttgaaagacggcaggatgccgaacgacaggtagtcgataaagcccgccgagaaggatttggcgatatgcgcatgcagcagatacatacacatgtacgacagacccgccatgatggcgttaaacacgtacagcaccggcgcgacaaagataaaggtgaattccaccggctcggtgatccccgtcaggaagcaggtgagggcggcggagaacagaataccggcggcaatctttttgtttttggtctgggcttcgtgatacatcgccagacaggccgcaggcagcgcgaacagcatcagcgggaactcgccctgcatgaacttaccggcgttctggtaggtgtcgctgctgaaggatttcacgccttcttccagcattttaaaccagatggtctggtcgccatggatcacctggccggcctgcgtggtgtaatcgccgaaggagtaccagaaagagggataccagatatggtgcagacccagcgggatcagtgcacgttcaaccagcccgaagataaaggttgaggccgcctgattatcgccgttcaccaccaccgacagcgcatcgatccctgactgaatgtgctgccagacatagggcagcaacagaccgagcaggaaggagagaaacgcggtggcgatggctacaaaacgtttacccgagaagaagccaaggaattccggcagctgcaacgtatggaaacggttgtagcaccaggcggcgaggatgccgcagataagcccgccaaacacgcccatctgtaaggtcggaatgccgaccaccatcgcatacttaccgccctgcgaggccatttccggcgtgatcgacagcaccgtacctatagtgatgttagtgacaaacaccgacaccgccgccgatagcgccgcaatacccgattccgacgccagacccaccgcggaaccaatggcgaacagcatcggcaggttatcaaagataacgcccccggcattcatcatcagcggcagctggaatttatcaccgaacgccagtaacagaccggcggcgggtaataacgaaattggcagcatcagcgcgcggccaatcatggacaattttgataacgacttaatgaaacctgacagcatagtcatgccttatcccccgaatgcagacgccttttttgggcgcttatttttgtgagtataacgttctactaaaacgttatacctaatgtcagataagcgcggttttaccgcaactgaaatcacgtggcacgtcagaggattttgttattcttttgaagtcgatcggttaatgaccatggcgggcgcggggagaagggcggtttttaccctctccggcggagagggtaaagcgggatcaggcggtgatggtgatgctctgcccgttaaagctcacggtctgaccggcgacgattttgcagcgcttgcgggtttccacctcgccgtccaccgtcaccagaccgtcggcgataaaaatcttcgcctgcgcgccgctttcgctccagccttccagcttgagcagatcgcagagttcaacatgcggatgtttgcccagggagaatgttgccatcttatgcttccttaacgtcgtgatattcttcgcacgcctgtagcgtgttctggatgagtgtggcgaccgtcatcggcccgacgccgcctggtactggcgtgatgtacgcagcgcgcgcggcggcgtcttcaaacaccacatcgcccactactttaccgctttcaagacggttaatcccgacatcaataacaatcgcgccttctttgatccactcgccggggataaagcccggtttgcccaccgcgacgatcagcagatcggcgttttccacatgctggcgcaggtttttggtgaaacggtgcgtcaccgtggtggtgcaaccggccagcagcagttccatgctcatcgggcggccgacgatattggaggcgccaatcaccacggcattcaggccgtaggtatcgatgttgtagcgctccagcagcgtgacgatgccgcgcggcgtacaggggcgcagacgcggcgcgcgctggcacagacgacccacattataggggtggaaaccgtccacgtctttatccggcgcgatacgctccagcacttttacgttgtcgatgcccgcaggcagcggcagctgcaccagaatgccgtcgatggcgctgtcggcattcagcctgtcgataagcatcagcagttcggcttcggtggtggtttcaggcagatcgtaagagcgggagataaagcccacctcttcacacgctttgcgtttactgcccacatagatttgcgaagccgggttgctgccaaccagaacaacagccagccctggtgcgcgttttcctgcagccagacgtgcctgcactttttccgcaacttcagagcgcacctgctgcgcaatcgttttaccgtcaataatctttgctgccatcagagagaagattccgtctgtgaatagaagagtggggatggctatattttgtcagaagcgggaggcgctgtcagttaacctttatgaaattcacctgcggcagcgtcgtgaagcagttcagggtgctcatttaccgcgcatccggatgcaaagccattgactcaatggaggttgaccgtataatccgaggcgtttccaccataaaaggtgtgacatccgcgtaacgcgcccttagctcagttggatagagcaacggccttctaagccgtaggtcacaggttcgagccctgtagggcgtaccattctgctttcgctcacgcccttcgattaaatttcttccctgatacgttttatccgttttggcatttagcgtcgtcgaccgacgtaaaaaaaaccgccagcgtttcccctgacggtttgtttatcagcccccggtttacagcccttcagtgctctcttttttcgcttccatcgcttcgacatcacgataccagcgcgggtgatgcttctgcgcccagcggcggctcaccttgccgacaatcatgcctttgatggagcctttgacccagaacgccatatacatatgaataagaatggcgtggatcaaaataatcgccgtggtggcatgaataagcaggctataacgcaccactttgatcgggaaataatcggcaaaccacggacgccagataataacgccggttaccagcagcacaaaaatcatgctcataatggtccagaacatcatcttctgcccggcgttatatttgccgacccgcgccactttatgctcgttgcctttcagcacctcgacaatacctttcacccacggaatatcgtgtttatcgggaatattgtgatgcacaaaacgcacgaacataaacatcagcgcgatgaagatcagcaccccaaaccacgggtgcagaatacgacccatctgcggcgtaccgaaggtttccgtcagccattgcagcgtcgggaagaacagcgcgatgccggagagtgccaccaggaaaaagcaaatcacgaccgtccagtggcaggcgcggtcaatgaatttcgtcctgacgatcatcctgctctgcttaatcatggtgttcctcctcgtcttcgtccacttcctcgttcggcccgacgcccacatagtggaagatcagtccggcgaaggtggcgataaaacctgccgccgacagcggtttcagcagccctttccacagggagatcggggtgtcgatgtgcggatcgttcggcagattgtgatacagctccggctgatcggcatgatgcagcacatacatcacgtgcgtgccgcccacgccctgcgggttatagacgcccgcgtgcggatagccgcgcttttgcagcttcgccacgcgctcgtccgccacctccagcatctcttttttggtgccgaaatgaatggcccccgtcgggcaggttttcacgcaggccggctcctggcccacgctcacccgatcaacgcacagcgtgcatttatagacgcggttatcgtctttattcaggcgcggaatgttgaacgggcaaccggcgatgcagtagccgcagccaatgcagtgttccgactgaaaatcgacgatgccattggcgtactgaatgattgcgcccgccgacgggcaggctttcaggcagcccggatcggtgcagtgcatacagccgtccttacggattagccactccagcctgccgttctgcgacgtctcgctaaagcgcatcagcgtccaggatttggcgctcagatcggcgggattgtcatacaccccgacgcagtggcccacgtcgtcgcggatgtcattccactccgagcaggccacctggcacgctttgcagccaatacagctggagacgtcaatcagcttcgcgacctcttctttatagtcgcgggcgcgaggcggcggcgtcatgccgttcgtcgctgaacggcggataatatcctgagattgcatggacataatattgctccttacgccttctcaatgttgaccagaaacgccttgtactccggcgtttgcgagttggcgtcgccgacggacggcgtcagggtattggcgagataacccttacgcgccgtgccttcaaagccccagtgcagcggaataccgatggtttccacctcctggccgcccgcatagagcgtgcgaacgcgtggcgttaccaccgcgacggcgcgaataaagccgcgtttgctgctgaccttcacgcgatcgccattggcaatgcctttggctttcgccagccgctcgctgatttccacaaactgttccggctgcacaatggcgttcagccgcgaatgcttggtccaggtgtggaagtgctccgtcaggcggtaggtggtgccgacatacgggaaagcgtcgcgtttgccgatgcgtcgggcatccgcggcgtacagacgcgctgccgggttcgacaccaccttcgggtgcagcgggttggtgcccagcggcgtttcgaacggctcgtagtgttccgggaacggcccctctgccattttgtcgatggcgaacaggcggcccagaccttccggctgcatgataaagggcccgacgccgctgcccggcggcgcggtgttgtagtcaggaatatcgttgccgacccattttgtgccgttccatttgatcaacatgcgtttcgcgtcccagggtttcccctgcggatcggcggaggcgcggttgtaaatgatgcggcggttcatcggccatgcccaggcccagcccagggtgttacccagcccggacggatcgctgttgtcacggttcgccatctggttgcctttcgccgtccagctcccggcgtagatccagcaggcagacgccgtggtgccgtcgtcacgcagcaacgcaaaggagtccagcaactgaccttttttcgccaacagattgccattggcatcaaagagatcttccagcgcgtagccgttgttctcccgggccacttcggccgattccggatgatccggctgatcgtagtcccagcccattttcagcagcggctcgacgcctttcccgccttcggcgcgatacatttcgcgcagccggtggtacaggcctgcaaggatctcgccgtcgtttcgcgcttcgccaggagcgtccgcgcctttccagtgccactgcaaccagcgcccggagttggcaatggagccatcttcttcggcaaagcaggtggacggcagacggaacacttcggtctgaatagtggccggatccacatcgttcatctcgccgtggttctgccagaagttcgaggtttccgtgaccagcgggtcgatgatcaccagatacttcagcttgctgaggctggcgactactttgtttttatccgggaaggaagcgaccgggttgaagccctggcagatatagccggtgacctgctgacgatccatcatgtcgaaatacttcagcacgtcgtaagactgatcccacttcggcagccagtcgaagccccagttattttcccgggtcgcagcgtcgccatagaaggctttcatcaggctgacgaaaaatttcggatagttgccccagtagttcacctggcccggcagcgtggctttcggcgtattggccgccagataactttccagcgtggtgtgtttttccgacggcagggtcagataccccggcaggctggtggagagcagccccagatccgtcagcccctgaatattggagtggccgcgcagcgcgttcacgccgccgcctgccatgcccatattgccgagcagcagctggatcatcgccatggtacgaatgttctgcgcgccgacggtgtgctgcgtccagccaagcgcatacaggaatgtcgtggtgcgatccgccgcgctggtggaggccagcacttcgcacactttcaggaaatcagccttcggcgtgccgcagatatgttccaccacctccggcgtatagcgagaaacgtgctctttcagcaggttccacacgcagcggggatgctggagggtatcgtcgcgcttcgcataaccgttttcatcgaactgatagttccagctggttttgtcgtactggcgtttcgcctcgtcgtagccgctgaacaggccgtcttcgaagctgaaatcatcccgcaccagcaggctggcgttggtgtagtgtttaacgtattcggcgttgattttgttatgggaaatcagatacaggatgacgcccgacaggaaggtaatgtcggtaccggagcggatcggcgcatagatatccgccaccgaagcggtgcgggtaaagcgcggatcgaccacgatcagcgtggcatcgttattgtttttggcttccatcgcccagcggaaaccgaccgggtgggcttcagcggcgttaccgcccatcaccatcaccacgttggcgtttttgatatcaacccagtggttggtcatcgcaccgcgaccaaatgttggagcaagacttgctaccgttggtccgtgtcagacgcgcgcctggttatcgactgccagcatgcccagcgagcgggcaaatttttgcgtcagcatcccggtttcgttactggctgccgaggcacacagcatgccggtggagagccagcggttaaccgtgacgttctgttcgttcttctcaatgaagttagcgtcgcggtcatctttcatcaggcgggcgatgcgggtaaaggcctcgtcccagctgatgcgctgccatttatcagagccaggcgcgcggtattccgggtagcgcaggcggctgtcgctgtggatataatccagcagtcccgcgccttttgggcacagcgccccgcggctgaccggatgatccggatccccttcgatatggaaaatactggatttggcatttttcgcgccgtcacccatgctgtacatcaataatccacagcctacggaacagtaagtgcaggtattgcgggtttctttcgcgcgcagcagtttgtaattgcgcgtttccgcaagtgcaacggtgggggcaaagcccagcatcgccgccgtggttcctgccattccgccggcgcagattttaaagaattttctgcgactgacgtccatcatatccccaatgttttgacttgttatgacgtgttttcggcggcgaaaataacaggacagcgagcagggatattgcgtgaaatcaattcactatggattgacgggcgactcacctcttatggggtaggtagggcaggcagggcgataatccctttgaggcgtgtatgtccggaccttacgatggcggggacgtgatacaaatgaacgtccctgcccggatgccataaaggtcggcactgcctatcaggcgtaaccgcaggattcaagtgcggcgcctgacaaataaagcgtttttatcaaaagtggaacgcgtctggaaaatagccttgtccaaattgcaggtgtgatgacgcaggcgtactattggctcaaaggttatcgtctttgttcagcagcaatttaccggagatgagagatgacaaagcatggatccctggcgcgaggaccggtcagtaatcggccatctgcgaagcgtcgtgaggttcgtctttctcgtggctcgttagtgggccgcagtttattaatcaatgacactgatgaaaatggacttatgttgcgcaaagtggctattttaatgaaagataaacgatattctctgctcagacggccacaaaccgttgcgcgttcagaaaacgcgctaaaaattaaatcaatttctgctgaagcttcgtcagaactgtccttccgcatgctcagtactctggatattcggatgaaagaagaggactttgatgctttcgagtgagtatagcggtggaattattcccactggcgaattcaaaactgacgattttttaatttctttaaaagaagcattcaagagtcactggcgtaaaggtcatcatccagatttaggcaaagatacgctttttgaaaggcctgacggagcgctttcttttcatttgcgaaaagtgcatgtcaatattcatcagtatgcaaattactcctatagctgcactgaaaagtgctgggataattgggcatttgggccagttgacgaacaggggaatcaccgtccaaagcctgccagtaatgcttatttaatttatgcagttaatgatcgccgagatgcggcgcttctggcgtactgggatccaccagcccatacaaaagcgaatgaagcagtctggatgaattctgttttaaatttcacaaaattatttcatgaaaaaacgaaaaccagtcccctgcccaggcatattgatccatggcactactctttcaaaaataagaagtcagtatagtgagcttttttgtgaatattactggttattagtacgtgctcatgatgatgctatttatattaaatatattttattataattgttcatcgtaaatcgagcattaagcataatgtgacagacatctgttcgcgtagcggcgaagccccttaaatacctgtttctgacagttatctttttaccagcagcggggcgcgaaattactgaaaggcgaaatgacgtggccgcagtaagggaccagcaggggtaacataagggggcttgcgcccccttaatattttagcgatgcgcctcttcatccataatcagcaccactttgccgatatgtttactgtcgtccatcatctgatgcgcctcaccggctttttcaaacgggaaggttttgcatacctggggtttgacggtgcctttttccagcagcggccagacgttctcggtgagcgctttgatcagcgcggctttctcttccggtgaacgtgaacgcaacgttgagccgatatgcgtcaggcgcttgctgagcatcgggaacagattcagctctttggcggcgccgccaattacgccgatctgcacgattcggccattcatcgccgccgcgtcatagtttcgcgccacgtaatcgcccgcgactatatccagaataatgtccgcgccgtggccgtccgtgacctctttagtgacttcaacaaaatccgcttctttatacagcactgcggtatccgccccgagcttcaggctggcttcgtgatgctcttctgatcccacggtggtgatgatttttgccgcgccgaacgccttcgccagcatggtggcggtggtgccgataccggacgcgccgccgtggatcagaataatgtcgcccgccttaaactggccgcgctcgaacatattgagccataccgtcataaaggtctcgggcagggcggcggcctcgatcaggcttaagcccggcggcagcggcagggcgttggtttcatgggccacgcaatactctgcgtaaccgccccccggaatcagcgcggccacatgatcgcccaccgtaaagcttttcacatccgcaccgactgccgccacgatccccgagacttccagtcccggaatatcagacgcccccggcggcggcgcatactggcctttgcgctgcatgatgtcagggccgttaacgcccgcggcgaccacgcggatcagcacttcatgcggctgtggcttcggcaccgggcgggtggtgggctgtaaaacctccgggccgccgggctgcgtgatctcaactgcggtcatggtgtcgggaatggttgtggtgtgttcagacatctttttcctcctgcattcagtgtctttagtatggctgcgatcggtgggcttgtggcaaagaagggtaactgaatgtgaggtaattcaatgctgttctgtttacttccacttcggaggggaaattttcagaataaaactcgcaagtgagagctgttagggtaaatacgtcgaaaagcagtgaggcattttaccaggatggtcaaaagggaaggggatatatgcaactatcaacattaaccactaacgctctgataatacttaacagtgacgccgataagaaagacgagattattcgcacgctggcccgaaaactttttgaaagcggaaaactgacgtcggaagaagcatttttgcaggccgtttatgcacgggaagcgctgggcgaaaccggaatgggagcaggcctcgcgctgccccatgggaaatgcgccgccgtgaaagaagcctgttttgccgtgatgaccacaaaaaagcctgtcatggactgggaatcttttgaagaagatgacggtgttcagcatatttttatgctggcgatcccggaaagcgaagccggtagtatgcatctggcgctgctggcagaactgatgcaaaacatgggcgatgaagaatacagcgagcgcttattttcctcccccacccccgatgcctttattcacaatcttgatatccctgtcgccgccgccgatcagacggcgcagtgccagaaaacgctgctggcggtgaccgcttgtcccgcgggcgtggcgcatacctatatggccgccgacgcgctggtcaaagccgggaaggcgctaggggtcactgtccgggttgaaaagcagggggcgaacggcatagaaggtaaacataccgctgagcaattacgtgaggctgacgcggtgatatttgcggtgtcggtggcggtaaaagaggccgaacgctatgaccatctgccgcaggtaaaagtatcagtgtccgatcccatcagggatgcgcaggctgttattttacaggcgctgaagcaggcggaaacgcaaaagaaaggcgagaatatcccccgggatgctgttaacacggcaggtaaagagaaatcgactatcggcaaactgctggacgacgctaaaagtcatttaatgaccggcgtctcttttatgctgccgtttgtggtcgccggaggcttaattctgaccctcggcctgttgctgggcggcggcgatcaaaaaaccggctttgcacatatgactgtacagactggcgtgctgatattttcgttaatggtgccggttatcgctggatatatttcttattccattgcggataaacctggcatcgttgcgggcatggcggggggcttaattgccagagaaattggcgcaggctttttgggcggcatagttgccggatttgtcgcaggctttattgttaatcaactaaaacgcatccccatgcatgcttatctgacgcagcttaagccgattattattattcctctgctgggatcggggctggtggcgctggtgatgtatacggtgggcgttcccattgcacaattatctgttttactggaaaacggactgaaatccctccagggcggaaatttgattgtgatgggcatgatcatcggcgcgatgatggcgattgatatgggtggcccgattaataaagtggcctttgctttttgcgtcggcatgctggcacagggagtttatgcccctatggccgcctgctggatcggcattatgacgccgcccgcaggactggcgctggccacccgtctggcacccaaaaaattcagcgtggctgagcgaagcagtgccattgccaccgcaatcatggggctgaccggcattacggaaggcgcgatcccctttgcggtggccgatccctggcgcgtaattttatccattgtcaccggatctgcggcaggggcggcgctggccctgggaatgggcgtagaagcgtccgtgccgagcggtggcatattcgtcgtgcccttcttccggcacccgttattatttatgggcgcttttctttttggcgttgcggttaccgcgctgtgcgcgattaccctgaagaaagaatttatcgaacggacaaacgcgtaataaacagaggacgttattatggatttctatattatttcgcacacgcactgggatcgtgagtggcataaaaccttcgaagaataccgggtccggttggtgatatttttcgataatctgatcgagctgttagaacataatccgcattatccctcttttatgatggacgggcagaccatcgtgcttgaggattatctggcaattaaaccgcacaaaaaacagcagttgcagcagttaattgcccacaagagaattatcgtcggcccctggtatattcagccggatgagttcattcccggcggagaattccagatccgcaatctgctcatcggtcagcgcattgcagccgctttcggcggaagtatgcaggtgggttatctgccggactcctttggacaggcggcgcaactgccgcagctgctgcaggggtttgacattgactacgcggtgttctggcggggcataacagaagatgaatgccctgatgtggattttatctggcgaagtgcggatggctcgtcggtaaaaaccacggtactggcggaaggatatggcaacgcgcgcctgctgaatgacgatcccgataataacgtcagcatcataaagaataatcttgctgccctgtacgccagatccgataagcgcaacatgctgctgatgtgcggttttgaccagcgcaatgcaaacccactactgccggagatcgtgaaacagttgaatgctgacctgcctgagcataatttccgcatcggcgcgcttacagattatcttgcggcggtatttaagcagggtgataaaaaagtggtggagggggagtttcgcaaaggaaaatatatgcgggtgcatgtcagcattggtatgacgcgccttgatattaaaattacgaattatcatacgcagacgcagctgcaacggatggccgaaccgttgatgagcatgagcgctctttttggtcaaccttaccagcaggaacttatcggccaggcctgtaaatatattttacaaaatcatgcccatgactccatttgctgcgtctgcactgacagcacccatgcgcaaatgatgcagcgttatcataatgcgcagcaaatttctgccatgctgttacaggatgcctccgaatacatcggtgaccatattgcgtataaaacgcagggtacgccgctggtgctgtttaatttttccggatcggcgcggagtggctatgaaaatgtctcttttgtcacgcccgctgaagatttcacccttatcgacagcgaagggcagcctgttgatttcgcaatcagcgctgtcagcgccattaaccagaatgatgcgcagatcgaaatcgggcaaaaaaaccaggatcgtctgctttaccgttatgagatggcaattaaggtcaggtttccgggcttcggctatcagacgctgtatatgatcccacgatctatgccgcaaagcgaagcaaagggtcagcctttgtttaacgagaataccgcgacctttaccaccgacttttttactctgaccgttcagcaaaatggggcattaacctataccgaccgggcaacgggcgaacagtttgcggatcttaattatttcatcgagaacggaaatgccggtgatgaatatgactattcgccgccggtcagcgatcggctgtgccatccccatcatggcctgccggatattgaggtgctgcataattcctcgctgtcggcagcggtcagacttatttttaatttcgccgtacctgccgatacgggtgccgataaacgcagcgatgaaacccttgatcagcgaatagcatgtattctgcgcatcagtaaagactcacgacgggtagatttttgtaccactctccataatcaggcccgcaatcatcgggtgtgcgttacttttcctgataaccagccgggcaggggacattttgctgaacaacagtacggtatgctttatcgggaaaacagcgttccggatcccgatgcctggcagcgcgaaggatgggaagagcgctattacgccctgtacccacagcaacgctatatgggatttgaacacgccagcggcaaagtgctgatttttaataagggactcgtcacctatgaaataaacagtgacggggctacgccggtcgtttcggtgccgctgatttgcaccatggattatatgggcaagcaggatctggtggatcgtccgggacggcgctcggggctgcatgtacctgtgccggacagcctgatgcccggcgaccatacccttgagtatgcatttatgtatttgccatcgtccgagggcgatattgcggccgaggcagatcgctggcagttgccgctgctggcggcgacgccgcgcggcaagcgggggagcctggcggacgcaatgacgttatttgcggttgaaaccccgaacattagcgtgatggcctttaagcgctgcgaaaaggggccgggttttattctgcggctggtcaatcagttggcggataaagcagatgacgtgcagctgcggcttaacaccacatgcttcaaccgtgtcagacgcgcgacgctcaacgagcaggaaatccccggcgacgtgagcttcaatgcccttaccggcgtgattagcgtcgggcggttacagcccaatgagatcgttacctttattgtggatgctttctgaaagggataaacagatgaacattgccattgcacaaattacgccagaaaccgccaacaaaaatgccaaccttgaaaaaatgacgcgctttgttctggaggcagctcagcagggggctgagctgatagtttttccagagctcgccttgactggttatcattgcggcgatcgtttttttgaggtggcggaaacgctccccggcgtgacaacggattatttcacgcagcttgcccgtcagcatagcattcatattatctggggcatggtggaaaaaacgctgcccggcatcctgtataacgcagcagcactggtggggcctgaaggttatattggaggctggcgaaaaaatactttgccgggccatgccactgataatggcggagcgggtgcgttccccgatcgacgttatttcagtcatggaggtgaacttgaggtctataacactgccattggccgcattggtgcgttaatttgttacgacatcttcttccctgaactggcacgattacttacgctgaaaggggctgatgtcattgtgggtatatcaggttcacctgcctttgagaaagacatttttgaaccaatcgtgaaagcccgggcgatggagaatactgttgattttatctacaccaatctggtggggcaggagggtgaaacaacctactggggtggcggttgtattatcgcagcaggcgattgcggatctaaaatcccgggcagtccggtgatttgtaaagcgccttatgaaggagagtgtataacgctcggcaagacagacattcaaaataaagcaatccggccattattccctgtgctgcgcgatgttacggcccggatgtatgaaaacctgaaacaggcgcatcaaaagcacagataaccatgccggctgcgttaatttccatggaaggggggcgtgcagtgatgctatttccttatcagcgactggctgaactgtatgagacgatccaggcagaaaccctgccgcaggatgagttagcgacgcgttttcaggtgtcggcgcgtacgatccgcaccgatatcgggatactcaatgatgccctccaggattatggggcgcatatccattatgagcgggggacgggctatcgcgtgattgttgacgatcaacgcgcttttgccgccttgccgcagaccgcagggcggaaaaaaatcattccccgcagcagtaaagatcgcatacatcttttgctgctgcgctttctgacccaggctgcgcctgtcaaacttgaccttatcgctgatgaatggtgtgtcagccgtggcacagtgcatcgggatatgaacgaggtaaaagacgctttaaaaaaatatcagctcgcgctggaaacacgcccctggtctggatcccgcgtcagcggaacggagcctgcgatccgcaacgcgattgccgatgttatctggcagatgagcgtcgccgccaataaaccgctgatgaccatggcggtgcaggaattcctgatgaatatcgatctgcatcacctggctaaaattctgcaaaatagcgtggatcgttttgatataaagctgagccacgatgcgcttcactatttgagcatggtgtgtgcggtatccatagtgcgcatcacctccggccatgaaatcatccatctcacagcctgcgatagcgatccggtgatagacaaagccagccaggatattgcgcagggattgtcgttttttctcggcagtgaatattcagccgccgagctggcctggctgcaaattcagattgccgcccggcggattattggatccgctgatgagctgaaaaccgaaatcaatagcgcggaactggtggataatatgcttaattttatccacggcacctataactacgatttacggcacgaccgccagctgcgtgacgatctcacgacacacctggtggcaatgctgacccgggtaaaatatcaggtcagtacgcccaatccattgcttgctgatatcaaaacctattatccctttgcctgggacgtgaccctcagcgccatatcgaaaatggccagttgcgtgccttacaccatcaatgaggatgaggccggttatctggcggtgcatattggcgtcgggctggagcgtaattacagttctggttttgaacgccatccgagggtgattatcgtcagtgattccggtatttcagtactgcgcatgatcgaagaaaagcttctgcgccagttcccgcaaatcgtcgtcgaacgcgttattgccctgcgtgactacgagcaattgcctcacgttgaggaagatttcattatctcgacgctgcgcctgacccagaaaaataagcccgtggtccgcattgccctgtttccgaccccctggcaaatagagcagattggccgcctggtaatagttgatcgcacgcgtccatggatttttgcccgttttttcaatgaacgacgttttatgcggattaacgggccgatgacacaaggagcattatttaaacgcgcctgcaatctgctgaaagagcaggggtttacagcggatgatttttatccctcgctgcttgagcgtgaatccattatgtccactctgctcggcgacggcattgctattccccatgcgctgggcctgcgggctaaaaagaccgcggtggtgacgatcctcgtaccggacggcgtagcctggagcaataaaggtgaggtggcacaggtgattttcttactggcgatcagtaaagaggatagcgacgaggcggtgagaatttacgatctgtttatgacgtttatccgtgaaaaagcaacccgacgactggttaacagcgccagcttcgatgatttccaggcgatagccacggactgttttggccggagtgcataagaaataaagcgcttaccctctggtgcagagggtaagcgcaggggcggcatcaaccaggaataatcttttcctgcttcagtttatcgaacagcgtagtgaaggaatccagcgtgctgcgatagccggtaaagcctgctttgcggcttttgctcatgtcggtgaaggcttccatcggacggcccagatcggcgtcggtatgccaccaggagaccagcttattgatgtcctgctcgcgcaactggtgctgcgcggcgatggtctgccaggcggctgcggcctcctgcatacggccttccagcggcatcatctgcgccggataatctgcggcttcaatgccgaagtaggcggcaagacgtggccacagccagcgccagcggaatacgtcgccgttcacggcgttaaaatcttcgttcgccgccgtcgggctggtggccgcccagctgagctgttctgccagcaggcccgcgtcggtgacatcgctcacgccgttccactgctccggcgagccggggaaaataaacggccagcctttttcacggcacagggtcgcgtagaccgccagcgtctggcccatgttcatggcgttacccacggcatagccgacgatggtgtggggacggtgaacgctccagcgatagccgtacttctcggcaccggcaaagagttcatcttcctgggcgtagtagaagttatccaccggctgacgcccctgttcttcgcggaatggggtaacggcggcgctgcctttgccgtagttctcgaacgggccaaggtagtgtttcaggccggtgaccagcgcgacatgcgcgccgtggaggcgctcgcccagcgcgtcaatcacgtttttgatcatcgcgccgttgacgcggatattggctttttcgttttcctgacgcgcccagacgctgaaaaataccgcgtcaggtttgaccgatttcagcgcttcgctgaccgccgctgcgtcagtgagatccgccgtcaggctggtgcagcctgcgagcacctcgccgcgcccgcgggacaggccggtcacttcccagccgtcctgcaataatttctctgacagcgcgcggccaattacgccgctgataccgacgatcaatgcttttttagtcatctgtgtttacctcgtaacaggggatatatacagactaatagagaatctcattcccggctctggtataaattcacaagatccttaacctgaggtcatcaattcgtgcacgaccagcgtctgaaagatattgtcccttttgtcaccagcgtcgaaaaaggcagctttaccgccgcggcggaatacctgcacgtcaccggatcggcggtgagtaaaagcgtcagccgcctggaagcgcgcctcggatcgcgcctgctggagcgcacgacccggcatctgcaactgaccgacgccgggcacgcgtattatcagacctgtatgcgcattctggaggagctgtcagaagccgagtcggtgctcgccgcccagcgcaccattccctccgggcgtttacggctggcggtgcccaatacctacgggcggctggcggtaatgccgctgctgatgccattttgtcagcagcacccggaaatcgagcttagcctgacgttttccgatcgctttatcgacctgtttgatgagggcatagacgtggcggtgcgtattggcggctcggtggatctgcccgcgtcgctgggctgtcggctgtcggggcgcgagaaaatggtgttttgcgccgcgccggattatctggcccgcgagggctgtccgcgcacggtagaggaattaataaagcaccgcgccattctttacgagcgggtggatggcagcaccaagccctggctgttcactaccgccgacgggcatcagaactggcgaaacgtgccgtaccgcatggcgctgggggatgtggatgcccagcagcaggcggtggtggcggggctgggcgtggcgcaaatgcccacctggctggtgcgcgccccgctgttgcgcggggagcttaaagtgattatgccggaattgcagcccgacggtctggcgctgtcgctggtctggccgcgccgcaagcagtggctgccgaaagtggatgccctgcttaacgtgctgagccagctggacattaccgcgccgctgaatgcgttagccgtttaacagcgccagcaccatttgcggcgtctggttagctttcatcagcacctgcgcccccgcctgttgcaggatctgcgccctcgacatcgctgagacttccgtggcgtagtcggcatcttcaatacgcgatcgggcggcggcgatagttgccgtcgcgccgctctgtaaattttgtacagaagagaggcgattggccaccgcaccgagcttcgtgcgctgcgcatctaccatgctgatggctttatcgagggtggcgagcgggttatccggattgcgtaagcggatctcatcgcccacttccgcaatgctcatggtggtggcgttggttgacgcatcggtggtcgcactgtaagtggtggcgaaatagatctgcacatcgcccacgccctgcagggttttcagcatcagcgtactggcggcatcattctgccggaccagggttgcggttttccccgtggtggagcctgacgcgtccataaaatagttgccgtcggcatcctgacgcagcacatcattggtggaacggccatcggcatcggtataacgcagctcgacgttagcgcgatccatggttaccactgagataccgttaactgaattcaccgccatgaaagcgttctggctggtggcgctcagggcgctgacctgcatgctggtggtggtgccgttcgatgtcgcggtcaccgaagcgttgtaatactgtatgttgccgccgccgttatcgacttccatcagatactgactgccgttcttcaccagccgggccgcgcctgccaccgggttgccgctggcatcggtaaagcttgcggtgctggcattggcgaagggtgtgctggtcaccgccgtcggcagggtggcaaaatcggtatccagcaggccggtcgcgctggacatttgcgcgctgaccgcaccggtcgggccgaagcttaccgtggcgggataccaggtattattctgctcaatataatactgaccgctatccatggtcagcgccgggggcgggctggcacttaaaggcgtgccgctgatgtcggtaaaattcacggacggaatagtgcgggcgggcaggctggcgaccgggctgtacagcggcgaggtgctggtggtgcccacggaaaccgtaccactgccggtggcggtgtaccagctggcgttgtaggttgccgggaaaaaggtcgcctgaccgttgctgtcgttgccctggatatagagctgattattgacggtgctgcgcaccagttgcggggaggtgatcccggcaggggtggcataactcacgctcgccgtgccattggtcagggaaatattattggcgatgcccgtgacggtgttctcatcggtcactttaccgctgatgccgcgaatgatcagatcctttaagcccagttcatccacgctgaagcccggtgatgaaaggtcgagatcgattttttcgttatcgtaagcgccgacctggaaaccgagtttaccggcgctgccatccagcagattgataccgttaaacgtggtcgctgtggtcaggcggtcgatctctttcaggttgaggttgatttctgcctgaatggcgtctgaatcctgctgattccaggtgtcgttaagcccctgaaccgtcaggtcacgaatgcgttgcagcctgccgttaatggcgctcatcgcgccttccgccgtgtccaccagcgacagcccatccccggcgttacgctgtgcctgcgccagcgcgtgttgctggctggaaagccggttgctgatggcctggcctgcggcgtcatcgctggcgccgttaatgcgcagcccggaagataaacgacggatcgcctggtcgagcgacgacgcgcttttgctgagattgtttccggcgttcagtgaaaacacattggtttttagacttatcattaccctgctcacgaatggcatccctgagaggaattatcggcaggcgggaattttctttagggacaaattatggcgtagtgaaagttctcgggcgctcagggcaaatttctggtatttactgtgggataagtcgttttttatcaggttttatgctgctggccgcgacattaaacgaagcggccagcagcattaactgcgatctacaaactctggtaggtgggcttactgctcgcgcctgccttcctccataaagtcatcgtccagctcgtcaacgttgccctgatgatctttaccggagagtaaattccagcaggcgataaagagcgcggcgatcagcgggccgatcacaaaaccgttgatgccataaatttccatgccgccgagcgtggtgataaggatcagatagtccggcattttggtgtctttgccgaccagcagcggacgcagcaggttatccaccagaccgacgatcaccacaaagaagccgacaataaagaagccctgccacatctgcccggtggagaagaggaaaatcgccgccggaacccagacaatcgccgagcctactgccgggatcagcgacaggaacgccatcagcgcgccccacagaatgctgccgtcgatgccgacaatggagaagccgatgccgccgagcacgccctggaccacggccaccaccacggtgccttttaccgtcgcccgcgaaacggtggcgaatttggcgaatagatgatgtttaacgtagcgggagaggggcagcgcctccagcgcctgatgaacgatcaccgggccatccttcagcaggaagaatagcaggtagagcatgacgccaaagctgatggtaaagccaaaggtccccttaccaataataaaggcgctgcccgccatatattgcccgcccttcagcgccacgccggagagcgcctgctggatctgtgtggcgttattcagttcatgttccgcaaggaaattgcgcgcccagtcaggcagatggcgcagcaaatcggcaatcaccaccgggaactgggtgttgttctcctgtaacttgcggtacacaacattaatttcaaaggccagggatgacaggatgatggctaagggtgtgaaaacgataaggcagatgattaagacggtgataagcgaggcgataccgtttttatccgccatcttttcgcgcagcttgttcttcagcggctggaagatcaccgcgaggatagtggcccacaaaatcgccgagaaatagggcgacaggacatcaaaaaacgccagcgtgacgacaaacaggatcaggatgaaaaatcctttcgttagtcccttaaatctcataactacaactcccgatatgcattctgtttccgaaatatagaaggtactggcgagaatacaataaagcctggctacgcttaaaaaatcattagccgctggagtgttgttatgccggaaatttcttacccgaatgtcgaagtgttgctgctggaggcccatgactgggtgccgaacaatccccgcctgccggtgctgctatatcgtggcgttttcacgccgggcgcccaggccatcgccgatgtggaacggctgtttgccgataacggctggccggcgcagtgggtggacggcattttcaattatcaccattaccacagcgaagcccatgaagtgctggctttcacgcagggggaggcgcaggtcatgctgggcgggcctggcgggaccttagtcaccgtgcatgcgggagatattgcgttgctgcctgccggaaccgggcactgtaataaaggcagcagcgatgactttacggtggtgggggcatatccgccgggacagagtgcggatatttgtcgggctgcgccgtcgccggagatgctgaaaagcattgccacgacgccgtttccggcatgcgatccggtgtatggcgcaaaagggcctttattaagtcactggctgggaagcgaacgggaagatgcaaagcagggagggtgagacgaagaaagtcggtaaggcgacatcgaatcccctaccgacaaaaatttcgttcatctgtaaaccgatgtttcaaaagcggacaaatagtaaccacctctgaaacctggagcaagtaaaacttgatcgccatcactatatttacattaccttaagaataccttaagacagcaatcattagtgatgcttattttgtattaagcaaaaattaaacttaatgattataagactatttagctctgccgttgcgcatgtaaattggcgtaattttcaggtaattattctctgtaaagtccgaaaaagaggaatggctgacgcagttggactataaaaataatatgtgacaaaaaaaacagacccgcctgaggtaccgctatgcaaataatttatttcaaagctgaatgcccttttcctgaacttttaccgtcgtcgcccgtttccttacaggaagtgatcctcacccgcgatggtgaaataatttcaagcttctcggatttaaaactgaaaacattgcctttttatctttttcatctggttccgattggttttcgtaaaattgaacatcaggtaagtggcgccagcgacagccatttgcagttctcatccggctatttgcaaagcggagagtatcgggtggaaacgccggatggcgataaaacaatgcgttatgatgcgctgaccgccttgtggaagccggatgcgaatatcgagcgttatctgacgactaatgatttcactgcggaaaattactgcatattgcgaccgctaaaattattttatcgcaatcgccgggacatcatttgctgaatgggattaaccctactaagctcaggtatcaggtgcacggatgtaccgacattttatttttgtgccagagccttcagcgttaaaaataacacctcaaataagtgttgctttcccaaatcagacgtgcgttaatggatcagtcggtttgatacgcagacattatctcgggtagttaactaaagcagtcctcatttctcagtgtatctttgatacctcttctttgagcctccactttttaagcgctgattaaactctgtatttcagaccatctctggccaaaaggcccacagaaaaggttaaaatactcaatgacaacaacttctatgcacttcacctgtccgcgttgccacggttcgcagtacaggacatcaccttttgacatgaccgaaagcaacccgtatggcgcaaaatgtatattttgtaaatcagcgatgatggccagaacggtggtttatacgccggacgttcatgcagacaaacgcctggtcggggcgcgttaatcccgacccgaagagagccttgcagcgatgtgaggcttttttatgcccggacgaaaaaaatcctcatgcagcgccacccggttacggccacgccttttcgcgtcatacagcgccgtatccgccgccgaatagagggtttcaaaatcgctattacgcacccctaaactgacgccaaagctggcggtcacgtaccgatccggcagacattccagcggcgaagcgttcagtgatgcatgcagataaccggcgatcagcattgcctcttcaatgcgcgcgcggggcagcaggatcgtgaattcttccccgccgacccgcccgattgcggcgtgatccggtagcgcacgccgcacccgtgacaccagcgagcagatcacccgatccccggtcggatggccgtactcatcgttaatgcgcttgaaatgatcgatatccagcaggatcagcgccacgtcgccggtcagcagagatttatcgatctgattaataatggcgctgcggttgtataccgcggtgagcggatcgtgcgtcgcttcatattccagcctggccgccagcttttgcagctcctcgttgatgcgggttaactcccgctcggcgcgatcgctgcgggagatgaggcggtaagattcacggatcaaacgctgataatgcttcgcgatggtccacagcttttcgcggcagacctccgcaggcagctgcgcattggcggcggcgatccgggcgtcttccagaacgttatactcttcctgaaaaagctcgttaatatctagcatgcgctcaggtccgcttttaaaaagacggcgattgccgggaaatccatgctcacctcctgcccaaactcttccgagatgtcatcgtccgcgtcgtaataccagtgcagctcgcaggctgttccctgcagggcgaaaccgttcagcagttcgaaaaactcaaacagcagtttggtgctggagctgttgaaatagctgagcgccacatgcagttgcaaaggcgcggtattggccgattgttctcccagccaggtttccaccgccagcaatagcgggcggaaaaaggccgcggcgttttccggccaggattcgcctttcagcaccagacggcgggccgcgaaatcgaaattcacttccggggtggcaggggtggcggccagcacgatagcaggcgtcagtgtcatatcagtcatgggcgaaagtggccttaagatgaaaagcggacaacgtgctggccgctaaaggatggatgcgatattccagcggttcgctggtctcccgcgccatggtcaacaatccaatatttgcgcccttactgctggcaggcgcttcactgcgtaagccttctttccaggcctgtttaatttcggcctgcgtcatggtgcgcagcacgtcgagattgttttgcagtaaggaagaggcttcatgcccgaccaggttggcggtctccagataatagttaccggcatcggtgtgaaagcacagcgaaccaaaacgccgctcatcagccccgcagccaaggtagcgttcatcgcaggagtagcgcacgatgttctggcccatctcgataaataccgaaaacagacggcggcgtagcggcagcgaggcttcatgtttatccagccacgcccgtaccacatcgcccatcgacacaatgtgcgcctgggaaaaatagccggtgtaaaacagttcgacggcgctttgccgttgcagactaatcagcggcagcagcaccgcctctttggcctggaggtcattaaatttcatctcatcactcaccagcgaaaaccaaaccatgtaatgtcgtcccgcgacaactcctgtccctgccatgtctgcaacgccgagcccagcgcgcgggagagatcctgcatcggcaggtgtctttcctgcagcagaaccgactgaatgcgttttttgccgagcataatgccccgctcgccgccgatctgatcggtcagcccgtcggtgactatcagcacctgatcgcccttaacgagcggacgttgatagcgacgccactggtgatcggacggcgtatcgctgtagcccaggcctttgcgatctgcttccagcacgctgacttcttccgcctgcgcccccagcacaaaggcgtgcatttgcgcgttcgcccataacatctgcgcattctggttatcgacatacagggcgatggcatcacagccgtcgttggactggctgagatcggcgctggggtgcagctggctgagcgtctgtttgatatagcggttgatgatggcaagcaggcgctccggctcgtgcggcgcggccagggtctgcgctttttccagcgccgaggcgaagataaaggtcataaaagcgccggggacgccgtggccggtacagtcggcgatcaccgccagccagccctgttcatcacgacggaatgcataaatatcgccgcccacgcagtcgcgcggctgccagaacaggcaccagtcgttaagggtttcctcaatgctctgccgtgaacgggaaagcatcgactcctggatcacccgcgcatattcaatgctctgcataatctgaaaatgctgtttggcctgtaaatctgacacggttttgatgagatcgatgcccagcccgatgccgatgtactgcccgtcttccgtcaggataaagccttccgtcaccgctttatcgccggtttccaccacctggcctgccagaaactccagcccggcgctggcctcgacgatcagcggcgtcttatccataaacgcaatacagcttttttgatcgtaaagctcatgaaagaacgggcggctcatctgtgagagaaaaatatggcgattgatcatgccgaccgggcgattattttccagcaccggcaggccaatcaaagacttatgttcgttaaacagcgccatcacccgcagattggtggaatcgggtgtgacatgtggaacgtcaatacgcaacattcctgcgttaagctgtcgggaggaaagaggaatatccatgaaaatccgcgtgttccctgagataagaattatctgaatcctacagggcatgtatgacggttttatttcagtgacagggcagcggtggggcgtttgcgcaaaaaaaagcccgcacaaggcgggcaacataatactggaagcaatgtgagcaatgtcgtgctgaatacctgagtgttttgctcaactattcagtaatgagaaagataatccttatcatctgaactatcaaccccttctttattgcggattttttccggaggttttgccgcctgttaccgctgctgacaattcgttaaggattgtggcaaatgatcttgcttgcagaaacataatgcgtatagttctcattctctttattgttatggcgcatgagcgctacctccctgactattcgcattgaaggcaaaggattttccacatgaaaatgaaaacgtctgcactggctctgctggttgcggttgccctgagcgggtgcagcgcgccgcatagctccgacgcaaaaaaaccggctgaagcgccgaaaacccagaccaccgctcaggctgacagcagtgtggtaaaacgcgtgctggcggaaggcgtgtacgaactggcgctaagcccggcgggcgatgcgctctatgtcgccagcgcagaaggcttcaaagatgtgcagggcgggatggtctacaaacttgatccgaaaacgctgaaaaccctcggcgtcacccataccgatctgaaaaacttcggcgtggatatgtcggcagacggcaaaaccctgtacgtcaccaactcgctggacgcggggatcagcgccatcaataccgccgacggtaaagtcatcgaccgcgccctgttcccggagcgtaatccggaaggcttcccttacggcgcgcgtcaggtgttgctgcacaacggcctgctgtatatcggcgcggtcgccgatccggcgctgatctgggtcgtggatgcgaaaaccatgaagctgaaaacgcgcatcaaaaacaccggcaaatggatgaccggcctgcattactcagaaaaaaccgggcgcatctatgccgcaaacggcggcggcgagatcctggtgatcaacccgcgtaacaaccgcgtcgaaaaacgctggaagccgctcggcgaaaaagaggcgctgctgctgaatatcgcagaagacagcgccaccggccgcctgttcgtcaccgataactcgaaggcgaaaaccacgctggtgctggacatcaacaccggcacggtgatcaaacagctgccggtcggcgattcgctggctgtgaaattcaatgccaaacgcaacgagctttatatttcccagcgtgattccggcaaagtgctgagcctcgacgccaccacctacgcggtgaaaaaatcctgggatctgccgccacacccgaacagcctgctgctttccgctgacggccagacgctgtttgtcaccgtgaagcaggcgtttaataaagatcactccaccaaaggcccggacagcgtggtccgtattgacctgaataaataaccgaaccggcccggcgacgggccttttatccctttctcataaaagatgaccatgaacagtactgctcctttgcataagacgttgctggcgctggcgatcggtgccgtaacccataccgcgacggcggaaacccagcccccggcggcgacggaagatacgatagtggtccaggcggcgggtagtgattttaccgctggcggcgaccagctggttcccgcgtacttggatggacaggtggcgcacggcgggcgtctggggatgctcggcgagcaaaacgcaatggacgtgccgttcaacgtcatcggttacaccgcgaaagcggtgcaggatcagcaggcgaaaaccatcgccgatgtggtcagcaacgacgcgggcgtgcaggcggtgcagggctacggcaacttcgcggaaacctaccgcattcgcggctttaagctcgatggcgacgacatgaccatgggcggtctgccgggcatcgtgccgcgtcaggtggtggatacgcagatgctggaacgtgtggagatcttcaaaggtgcgaatggtctgctgaacggcgcggcggccagcggcgtgggcggcatgatcaaccttgaacctaagcacgcggaagacacgcctgtcacccgcgttggcgtggattacgccagccaggcgcagatcggcggctcgctggatctggggcgtcgttttggcgatgacaaccagttcggggcgcgggttaatctgctgcacagggaaggcgagggggcagtggatgacgatcaccgtcgcaccacgctggccgccatcgggctggattatcgcggcgagcgtctgcgcacctcgctggacgtgggctaccagaagaaaaccttccacggcagcaacgttggcatcaaaatcagcaaggtcgatttcattcccgatctgccggatcctacgcacaactacagccagcagtggggctacagcgacatcgaaaacgaattcggcatggcgcgtgccgagtttgatgtgacggatgcctggacggcgtacacggcgttcggcggccagcatgcccatgaaaccgggctgtacagctcaccggagatcatcaataagcagggcgatgcgtggatcggccgtctggataccaaccgtatttccgactccttcagcggcatggcgggtctgcgcgggcagtttgataccggcgtggtgtcccacaaggtgaatgccggttattcggcgctgaccaaaaaagacaacaccgcctggcgatccaccgccgaagcgaaccgtccgctgatcaatatctacgataccgacagcgtatcgcgtccgggttataactccgtgggcggtaactatttcgatccgctgaccaccagccgcaaccgcacccagggctggctgttcagcgataccttaggcgtgctggatgaccgcctgcaactgaccgtcgccgcccgtcatcagaaagtggtggtgcgtaactacagcaacgccaccggcgcggaaaccctgaccgcgcgctataccgaaagccgctggatgccaacctatggcgtggtgtataagccgtgggaacaggtatcgctctacgctaaccatactgaatctttacagccaggcagcaacgcgccgaaagacgccgccaacgcctttgaatccgtcggtatcattcacgcgaagcaaaacgaagtgggcgtaaaggtcgactatgggcgtgtcggcgggacgctggcgctgtttgaaatcaaaaagccctccgccattctggacagcgccacaaaacgttacgggctggacggcgagcagcgtaaccgtggcgtggagctgaacgtcttcggcgagccggtacttggcctgcgtctgaacggcagcaccacctggatcgatccggaaatgacccgcaccaaagacggcatcaacgacggcaaagacgctatcggcgtaccgaacttcttcatggtggtgggcgcggagtatgacatcaaaccgatcgacggccttaccgccaccgcgcgcgttaaccacaccggttcacagtacgccgacgccgccaacaccaaaaagctcgacagctacaccaccctggatctcggcatgcgttaccggatgcgccttaacgaggcgcagaacgagatgatctggcgcgtgggcgtggataacgtcactaatgagaaatactggtccggcgtggaagatctcggcacctatattttccagggcgaaggacgcacgctgaaagtctctatgagctacgatttctgatcccccgcacctcgttatgacgggcagggacgcccatcataattgccacctccggcgctaaatgttaaaacgtgccccttcaaataaaagacacacaggggaaagacgtgaaaaacgcgtcacaagtcgcgccggaaaccgggccgacgctgcaacggggcttaaaaaaccgacatattcagcttatcgccctcggcggcgctatcggtaccggactgtttctcggcattggtccggcgatccagatggcgggcccggcggtactgctcggctacgcgctggccgggatcatcgcttttttgatcatgcgccagctgggtgaaatggtggtcgaagagccggtatccggatctttttcccatttcgcctataaatactggggcccgttcgccggcttcctctccggctggaactactgggtgatgttcgtgctggtgggcatggcggaactcaccgccgcgggcatttacatgcagtactggctgccggacgtcccgacctgggtgtgggcggcgaccttcttcattcttatcaacgccgtcaatctggtgaacgtgcgcctgtacggtgagatggagttctggtttgcgctgatcaaagtgctggcgattattgcgatgatcggctttggcctgtggctgctgttctccggcagcggcggcgagcgtgccggtatcgacaacctgtggcagcacggcggctttctggccaccggctggcacgggctgatcctgtcgctggcggtgatcatgttctcctttggcgggctggagctgattggcattacggcggcggaagccagttccccggaaaccaccatcccgaaagcggtgaaccaggtggtgtaccgcattctgctgttttacatcggctcgctggtggtgctgttagcgctctatccgtgggtggatgtgaaagccaacagcagcccctttgtgttgattttccacgatatgaacagcaatatcgtcgcctcggcgctgaacttcatcattctggtggcctcgctgtcggtgtttaacagcggcgtttactccaacagccgtatgctgttcggcctgtcggtgcagggcaacgccccggcgtttttaacccgcgtcaacaaacgcggcgtgccggtgaactccctgttcctgtcagcggccatcacctcgctggtgatcctggtgaactatctgctgccgcaggaagcctttggtctgctgatggcgctggtggttgccaccctgctgctcaactggctgatgatctgcctcgcgcacctcaagttccgcgccgccatgcgccgcaagggacgtgatacccagttcaaagcgctgttttacccggcgagcaactacctgtgcatcgccttcctggtgatgatcctcggcctgatgtgcaccatggaaagtatgcgtacgtctgccattctgctgccggtgtggatcctcttcctgtttgtcgcctttaaggtaatgcgccgccctaaagcgtgatccttttcccctcatcccacggtgaggggagtccctgattatttatcgtgatccgcctcgcggatcccatacgatcaccatgcaccttattttgtaatcgattactttttagctgacggcaatttgtaatcgattacttttttcaggtgaggcaataaaatggtgtcaacaaccgaaagtagcggaagcaatctggcgcagcaccggttactcgtaccgcggctgtcgctgatgatgtttttacagttttttatctggggaagctggtcagtgaccctcggtctggtgatgacgcagcacaatatgtcgctgctgattggcgatgctttttccgccggtcccatcgcctccattctctcgccctttgtgctcggcatgctggtggatcgctttttcgcttcgcaaaaagtaatggcggtgatgcacctcgcaggggcggtcattctctggtttgtgccgcaggcgctggtggcggaaaacggcgcgctgctgattggcctgctgtttggctataccctgtgctacatgccgacgctggcgttaaccaacaacattgcctttcacagcctgcgcaacatcgataaaaccttcccggtggtgcgcgtgttcggcaccatcggctggattgtggcggggatctttatcggcgtcaccggtatcgcctccagcaccagcatctttatggtggcggccatctgctcggtggcgctggcgatttacagtctgacgctgccgcacacgcccgcgcctgccaaagggctgccggtgaaggtgcgcgatctgttctgcgccgatgcctttgcgctgctcaaaacccgccacttctttgtcttttcgctgtgcgcgatgctcatttccgtgccgctgggcacctattatgcctataccgcgtcttatcttgccgacgccggtgtcgcggacgtcagcaccgccatgtccttcgggcagatgtccgagattttcttcatgctggtgatcccgctgctgttccgccgcctgggagtgaaatacatgctgctgatcggcatgttcgcctggttcgtgcgctacgccttttttgcgctgggcgtcagcgaagaggggcgcttcctgctctatctcggcatcctgctgcacggcatctgctatgacttcttcttcgtggtcggctttatctataccgatcgcgtggcgggggaaaaggtgaaaggccaggcgcaaagcatgatcgtgatgttcacttatggtatcggcatgctgctcggctcgcagatttccggcgcactctataaccgtctggtggccgggcaaagcgtgccacaggcatgggtaacgttctggtggatcccggcggtcgccgccgcggtgatcgcgctgattttcatgttgtcatttaaatacgacgataaagaacaggcttaagttgtgggagaagttatgaaaaccattaagggaccgggtattttcctgtcgcagtttattggcagcgacgcgccatttaacacgctggacggcctcgcggcctgggcggcggaacgcggttataaagcgctgcaaattccctgtcaccacccgacgatttttgacgtcgcgcaggcggcggaaagccaggcctactgcgacgatattatcgcaaggctggcgggccacgggctggtcatcagcgaactttccacccatctggaaggacagctgatcgccgtgcatcccgcgtacgatgcggcctttgacggtttcgccccgccggaggtgcgcggcaagcccgtggcgcgtcaggcgtgggccgtggagaagcttgagcaggcggcacgggcgtcacagcggcttggtttaacggcgcacgccaccttttccggcgcgctggcctggccctatttctatccctggccgccgcacaacgcgcaactgctggaggaagcctttcatgaactggccgcccgctggcgtccgatcttcgacgttttcgatcgccacggggttaacgtctgctttgagatccatccgggggaagatctgcacgacggcgcgacctttgagcgctttcttgagttagtggatcatcacccgcgctgcaatatgctctacgatccgagccatctgctgctacagcacatcgattatctggcgtttatcgatcgctatcatgcgcgtattaaagcctttcacgttaaggatgcggagttccgcagcaacgggcgcagcggcgtctacggcggctatcaaccgtggatcgaccgcgccggacgctttcgctcgccgggcgacgggcagatcgacttcggggcgattttcagcaagctgacgcagtacggctacgacggctgggcggtgctggagtgggagtgctgcctgaaaacaggcgatgcgggtgcgcgggaaggcagcgagtttatccgccgtcatatcattccggtggcggatcgcgcctttgatgacttcgccgccagcgcgtcggatcgcgccagcgtgcgcaggatgctgggactgggagacgccttatgatcagggtcggtatcatcggcagcggttttatcggcccggcgcatatcgaagccctgcgccgtccgggcttcgttgaggtggtggcgctgtgcgacagctcgctggcggccgcgcaggagaaagcggcggcgctgaacgtgccgcatgcctacggcacggtggcggattttctggcgcatccggggctggacgtggtgcacaactgcacgcccaatcatcttcatgcggacattaaccggcagatcctgcgcgccgggaagcatgtcttttccgaaaaaccgctctgcatgacgccggaggaagcgcgtgaactggtggcgctggcacaggcggcgggcgtagtgcatggcgtcagcttcgtttaccgccagtttgcgatggtgcagcaggcggcgagtatgcagcgccacgggcagacggggcggctgttctcggtgtacggcagctatttgcaggactggatgctgctggaaaccgactataactggcgggtggacgcggcgaagggcggcctctcccgcgcggtggcggatattggttcccactggtgcgacacggtgcagtttgtcaccgggcggcgcatcaccgaagtgatggcggatctggcgatcgtctggccgacgcgcaaagcacgcaccgacggcggggcgaccttcagccagggggatgaggccgcgcagtatgaggataaaccggtcaccaccgaggacggtggcgcggtgctgctgcgttttgacgacggcagcaaaggttgtttcagcgtctcgcaggtcagcgccggacgcaaaaatcgcctcagctttgagctgaacggcagcgcctgctcactggcctgggatcaggaagtgccgcagcagctgtggatcggccatcgtaaccagcctaatcagatcctgactgacgatccgggactgatggcgcgggacgccgccgccagcgcccattttcccggcgggcatatcgaaggctggccggacgcctttaaaaatatgatgctgcacttttatgaggcggtgcgcgccggaaaaatgcccgatgccggaacggcggctttcgccacctttgaggatggcgcgaacgtgatgtttatcattgatgcgattataaaaagccaccagcagcagcgctggatccgcgtggcatcctgaactacagcccggttcgccgggcagcaaatttgtgatagcctgcaaacattgcattgcgtcaaccgcaggatgtgtcctcgttatgtcaattcagaaaatcgcccggctggcgggcgtttccgtcgccacggtgtcgcgcgtgctcaacaacagcgactccgtgaaagcgaaaaaccgcgaacgggtgctggcggctattcaggaaagcaattatcagcctaacctgctggcccgccagctgcgcaccgcgcgcagctatatgatcctcgtgctggtttccaatatcgccaaccccttttgcgcggaagtggtgaagggcattgaagaagaagccgagaaaaacggctaccgcattctgctgtgtaattccggctctgacgtggcgcgttccacctcggcgctgaaattgctctccggcaaaatcgttgacggcataatcaccatggacgccttcagcaaattgccggaactgaccgccatgattggccaggccccctgggtgcagtgcgccgaatacgccgattccgggaatgtctcctgcgtcggcattaacgacgttgacgccgcccagcacgtgatcgggaaactggtggccggtggtcgccagcgcattgcgctgatcaaccacgatctcagctataaatatgcccggctgcgcgagcgcggctataaaaccggactgcatcaggccaggctggactataacgccgtggaatatgccagcgaactgagcttccgcgcgggcgttgcggcgatggaaaaactgttgcaggccgacgtgcgcccggacgcggtctttgcggtatcggatactctggcggcaggggcgatgctggcaattgctaacgccggactgaaaacgccggaagatatcgcggtcgtcggctttgacggcacagccctggcggagatggtttcgccgccgctcagcaccgttgagcagccttctcaggacattggccgcaccgcggtcgggttactgctgaataaaattgataacccggacgcgcccgcccagcgggtgatgatggactggcactatatttctcgcctgagcgcgtagttttttaagggagagttaccggtgaaccggcaacgacaagctgatctttttctcgtcctgaccaccatgatcgccgcctgcggctggatcttctcccgtgaagccattgccgggatgccggtattcgctttccttgcgctgcgtttttgcggcggtgcgctggtgctgctgccgttctgccgcggccagcgcattgcccgtacccagctgaagccggtgatcatcagcggtttatggatggcgctcaacctgtgcctgtggatctggtcagtgtcggtgacgccatcgctgggggagggggcgtttattatgagcctctccatgctgttcgtgccgctggtggcctggggtatgatgggcgtgcgcccggcgcgggcctactgggagtgcctgccgctggcgattatcgggctggcgctgttaagcctgcacgtgcccatcacctttaacgccagccagggctggtttttactcaccgcctttgtgcagtcgatctccttttgctacaccagtcgcgtcgcccgcgacgtgccgctgatcccgctcaccaccgcgcagctggccatcaccggcctgagcgcgctgttgatctccgcgttgtttgagccctggacgcagggtatcagcctcagcacctttggctggctaatcgccagtattttcatcgccactgcgctgcgctttggcctgcaattgcaggggcaaaaacacgccgccgtcgccagcgccgccatcattatggtgctggagccgctgctgacggtgatcgccgcctcggtgtggtacggcgaacggctgccgctgcagaagatcatcggcggcgtgctgatcctcgtggcgcaaatctggttccgctggcggatggtgaaacggctgcctgcgtagggttactgtttgtcggtgcagaccggcatcaggtgctgacgaccgcagaccgctgccgtcgccagcgccagcatcatcaccacttccacggcgagaaagccgctcagcgccgacgaataatttccctggctgcgcgccagcagatgcaggaacagactccctaacaccgccgggccaaggccgagcgtcgcctgttgcagcgtgctgagaatggcgctgcccgctccggcatcacgggcggcgatatcccgcatcccgatacgataaaagctgttcacaattaacgcctgtccgtagccaatcagcgccgtggacggggccagcgccagcgcgcccaccacccggccggaggcggtcagcgtggcgatcagcgccagcaggccgagcacctgaatggcgatgccggtcagcaaaatggtgctggtggcgtggcgggcaatcagtctgggggcatagcaggcggaaacaaaataggcgacgccgagcgcgataaaactgtttcccgactgccacggcgccatgcccatgcccgcctgcatcgtcagcgccatacagaacataaagccggaccaggcgctgaaaaacagcagggcgataagaataccgaaacggatgctggcgagcttcagcaggcgtggcggcagcaacggttgcaggccacgctgttgctggcgcgcggcatcgctgcgcatccacagcgccagcgggatcaccgccagcagcgccgccgttgtcggccacggccagtgcagttccgggccgagggccagcgggaacagcagacaacagaggatcagcgccagcagcagcgtgccgcgccagtcgatacgtgacggcgcatcgctgcgggtttccggcacgtaacgaggcgtcatcgccagtaccagcagacagatcggcacgttaatgaaaaaggcattacgccagcccagcccggcgatatccgccgacaccagccagccgccgcccatctgcccgatgataaaggcgatgccgccaatgccgccgtacaggctgatggctttcgcccgcgcgctgcccgacagcgtaacgtgcagggtagcgagaatttgcggcacgatcagcgccgcgcccatgccctgcaacgtgcgggcagccagcagcgcgccaaccgagttcgccatgccgcacagcagcgaggcgaggccaaaagccgccacgccccacataaatacccggcgacgaccaagattgtcgccgagcttactgcccatcgccagacagaccgcaaaggccacgccgtacagcgcgacgatcagctccagctgggtggcgctggtatgcagcgagccggtaatggaatcaagggccacattggtaatagaggtgtcgatcagcggtaacatttgtccggtcagcaggacgatcagcgccgcccgacccggcgaaacagcagaggtatgcatggtaactccattgcgtcattcatcagatggacgtagcatcgcggaatcattaaacgggtaccagttcttgcttatactggtactggcactaccatgctggggatgattatgacgatgctggttgaccgggcggcgacgctgaccattcaggatgagaaccgcaaacagcttggcgcgttcttacgtgcgcggcgggaaagccttgatccgcagcgtctggggctgccgcgcagcggtcggcggcgcacgccaggcctgcgacgcgaagaggtggcgatgctcgccgatgtcggcgtcacctggtacacctggcttgagcaggggcgggaggtgaatccctcggcaacggtaatgcaggccattgccactgcgctgcaatgttcccccaccgaaacccggcatctgtttgtgctggctggcttaacgcctggtgaaatcccgccgttgtccggctgcgaactgatcagcgacggcacacgccgactgctcgacagtctcaatccgcagcccgccagcatccagcgcccgagctttgacatcgtggcgtggaacgacagctttagccgtctgatgggcgttgatttcgcgctgatccccgacgatgagcgcaactgtatctatctgtatcttaccaatcccgtctggcgcagccgcctgggagtaagtgatacggtgttgcagacctttgtggcctatttccgcgcggcgatggcggaacaccggggcgagccgttctgggagaataaactggcgcgcttttttgccgtctcgccggaattcgaggcgctgtggcataaacgctatgaggtgtctggcgtagaaaataaaataaaaaccttcagccatccgcagctgggggaattcaccttgcagcagatgtactggtattccgcgccgcgtaacggctcgcggctgctggtttatctgccggtcgatgcggcgggagagcaggcgctggcatttctggcgcgcggctaagcagcggcagtattattccgggcgaatacgctgacgcgcttttttcggcaggcggtccaccaccagatgccaggcgtcgaggatcagatcctccaccaggccttcgctgatatcctcgcccgcgtagattgagatccagtgttttttattcagatgccagccgggctcgatgctcgggtagatctgccggttgagcagcgatttttgcggatcggctttcacgctgaccagcggacgcccgcgggcggtggcggtcatcatgaaaatcttaccgttgaccttaaagacgtcgatgtcaggaccaaagggccagcagtgctcggtaaaggggagttccagcgccacgcgatgcgcgcaggcctgtagggttttgctgtccattattcttcctcaatggacagggcgcgccacatcgcttcaaagccgtgggctttaatatcaaccgcccgctcaggctggcggctggcgaattccatggtggtttccgccagcgataaaaacaacgcatcgccgaatgcgcgaaattcttccgtcataaataccggcaacaatgaacggcgacacagctgacgcagttccgggaacatgtcttccacgatttgcagcgtttcgggggtgatcttttcgctgacggcgagctggcggatcgccccatggccgttgagattacaaatgccccagtcgatatagcgattccagatatggcgggtaaaacgctttggatcgctctccgaacggtcgagatccgccagcattgcctggcagagatcgcttttcagatgcacatagagggcgtttaagaggtcgtctttcgtggcgaagtagcgaaacaaggtgccttccgccacgcccgctttacgggcaatgagcgcggtggacgccgtgatgccggattgcgcaatagcttctgtcgccgcatccagcagggcctgcttcttatcttcacttttcggacgagccactacagatttcctcacattgggcaaaaacgctgattgaatcatgccagacgcgatgtcgcaacgctctgtgtcaaagatcgaaaatcgacttgacgactttcgatgcctttctataatgagtgcttactcactcataatcaagtttgcacttatcgttccagcggacaggagcgattttttttgagccaggatatgaaacgactccttttcagcgtggttattgtcatgttagtcgcagcaacggccagtttaccttttgtcctgaatgcgggcttcggccagccgccgcagggcgcacagcttactgaagtggaaaaatcgccgcactatcgtgacggtcagtttcataacgcgctgcccacgccgggttttaccggtaagaaaaatatgctggcggcgtggtgggagtttctggttaccaaacgcgagaacgcccgtccggcgcagccgctgccgatggtgaacaccgatctggcgggcctgccgttgcaggaagacaccgtcgtctggctggggcactcatcctggtacatgcagctggcaggcaaacgcattctcatcgacccggtgttcagcaattacgccgcgccgttttcctttatcaataaggcctttgccggagagtatccgtggcgggcagagacgatgccggacatcgatctgctgattatttcccatgaccattacgatcatctcgatcacgccaccattaccgcgctgctgccgaaagtgaagcgggtggtgacgccgcttggtgtgggatcgcatctgcgctactggggtatggatccggcgattatcacggaagccgactggaaccaggcggtgcaaatcagcgaagatctgcgcgtgcacgtgctccccgcgcggcatttctccgggcgcggcctgaagcgtaatcagacgctatgggccagctttatgctggaaaccccggcgcgcaaggtttactacagcggcgataccggctacggcccgcatttcagggcgataggcgagcagttcggcagcgtcgatctggcgatccttgagaacggtcagtacgacgaagactggaaatacattcatatgatgccggaagaaaccgcgcaggctgccgttgatctgcatgcccgcgccgttttacccggtcacgccggacgctttgtgctggcaaaacacacctgggacgacccgtacaaacgcctggccacagccagtgagaaccgggattaccggctgcttacgccgcgcctgggcgaacctgtacatgccgccgacgcgctacagcagttcatcgcctggtggcggtaatccatcctgatataactttcgaagagcagagggggagaaaaatgactatttccgctcaggttatcgacactatcgtcgagtggatcgacgacaatctgcatcagcctttgcggattgatgacatcgcccgccacgcaggctactcaaagtggcacctgcaacgcctgtttatgcattacaagggtgaaagtctggggcgttatattcgggagcgtaaactgcggctggccgcgcgggatctgcgcgacaccgatcagaaggtttacgatatttgcctgaaatatggctttgattcacagcagacctttacgcgcatctttacccgcactttccatcagccgccgggagcctatcgccgcgagaatcacggcgtcacgcattaagatccagagcaggggcggggcttagacccagtccctgacctgaataaactcgctcagtgccgcttccgggctgccggtttccggctgatagttatattcccacgccacctgcggcggcagcgacatcaggatcgattcggtgcggccgccggtttgcaggccaaacagcgttccgcgatcccacaccagattaaattccacataacgcccgcgacggtacaactgaaaagcgcgctcgcgctcgccgaacggcagcgatttgcgtttttcgacaatcggcagataggcgcgggtataaccttcgcccaccgcctgcataaaagcaaagcactgcgcaaagtccggggtgttcagatcgtcaaagaacagcccgccgatgccgcgctgctcgttgcggtgttttaagaagaaatagtcgtcgcaccattttttgtagcgtgggtagacgtcttcgccaaacggcaggcagagttcccgggcggtacggtgccagtgcacggcgtcttctgcaaaaccgtaaaacggcgtcagatcaaaaccgccgccaaaccaccataccggatcggcgccgggcttttcggcaatgaaaaagcgcacgttggcatggctggtgggcacatacgggttatgtggatgcaccaccagcgagacgcccatcgcctcaaaagagcggccggccagctccgggcggtgggcggtggccgaggcgggcatggccgcgccataaacgtgggaaaaattcacgcccgcctgctcaaacacgccgccgttgcgtaacacgcgggtacgcccgccgccaccggcttcgcgctgccagttatcttccagaaagtctgcgccgtcgacggcgaaaagctgctgacagatctcgtcctgtaattgcagcaggaaggcttttaccaggttagcgtcaggtgtggtcattaacgttttctcgaatgcgctttctggttatcgaaccagttgaagtaactgatgacgcctgacgcaatggcgctggcgatcttctgacggaaggcggcggtgccgagcaatttttcttccgccggattggtgatgaatgacgtctccaccagcaccgagggcacggatggcgatttcagcaccacaaacgccgcctgttccgtgtgcttactgtgcagacggtgcaccggtttaatctgcttcagaatatgcgagcccagcgtcaggctgtttttgatggtgtcggtctgcaccaggtcgaacagcacctgctgcaaaaggtgatctttatcggtggcttttttaccggccagctcatccacggcgttctcgcgctctgacaggtatttcgccatcgcgctactcgcgccgcgattggagagagcgaacaccgacgcaccggcggcattgggattagtaaagccgtcggcgtggatcgacataaacagatccgcgccgtgcttatgggcaatctccacgcgatcgtagagcgggataaaggtgtcgccggtgcgcgtcagacgggcatcaatgcctttgctgcgcagaatggagcgcacgtttttggcgatcgccagcaccacatgtttctctttcgagccgttaccgccaatcgcgccggtatcaataccgccatgaccgggatccagtaccacgacacggcgtgcgccgctttttttcgccttcggctggctatgactgttggcaaccttcagcgacgcttcttctttggcgagggcttttgacatgccggacagcgtaagaacggccagaccggctttgagcacctggcgacgcgaggtgagtgtttttaagggtttgaatgtgttcatacggcctgaactgtaaaaaaggggtccgtggtgttatatcgtatcgtgttatccgttacgacactcgttgttaagaattgttttacttttcatttcaatacgtgacagagtcctagtatgccattttttcgcgctgacttcgccggatattggtttccccggcacttcacgccataatcaacgttttagcctgaaaagagtaggtcaaaccatggagatacgcgtatttcgccaggccgatttcgaagaagtcattaccctgtgggagcgttgtgaactcctgcgcccgtggaacgatccggaaatggatatcgaacgtaaggtaaatcatgacgtcagcctgtttctggtggcggaagtgaacggggaagtggtgggtaccgtaatgggtggctacgacgggcatcgcggttcggcctactatcttggcgtgcatccggaatatcgcgggcgcggcatcgccaatgccctgctcaatcgtcttgagaaaaagctcattgcccgcggctgcccgaaaattcagattatggtgcgtgaagataacgacgtggtgctcggcatgtatgaacgtctgggctacgagcatgccgacgtgctcaatctgggcaagcgcctgattgaagatgaagaatattgagtttttacccgccgattttgaccagcacggacgcttacgcctgcccctgatgctctggtgcgtgctgttattacaggcgcgcacctgggtgctgtttgtgatggcgggggcatcccgtgagcagggcagcgcgctgctgagcctgttttatccggaccacgatctgttctggtgggggctgttaccgggtcttccggcagtgctgacgtttttgttcagcgggcgtcgtcagcactatccgcgcttgtggccgctgttgcgtggcctgttgatcctggcgcaactggcgctgctggtctggcagccgctgctgtggctgacgggcgaggacatcaccggcacgggattaaccctgcttgcgatcgacagttttgccctctggtggttgctcaccgaccgccgcctgcgcgcctgcttcacgccggaggcgtaatcacggcactttttgccgttctggtactccaactggcgttaactgaaataaaaaggaagtcatcatgaaatcgctgcgtttactgttatgcgctacgccactgctgcttaccggctgctccacgctcagcaacgttaactggtcggcggcgaatccgtggaactggtttggctcgtcactggaagtcaccaaagagggcgtcggcgatctgacgggcagcacggcgctcaacgaagacgccatcaacgcggcgctgggcggagattatcgcctgcgcagcggcatgaaaaccgaaaacggcgccattgtgcgttatttcgaagcgctgaaaggcgacgaactggcgatggtgatccagggcgagcaggggacggtcagccgtatcgacgtgctggacaaagatattgaaaccgccagcggtaccgccatcggcacgccttttggcgatctctatgacaaagcctacggcaactgtgaaaaagccaccggcgacgacagcaacgccgtagaatgccgggcgaaagagagccagcacatcagttatctgttcagcggaaactggagcggcccggaaaacctgatgcctgccgatgacgccctgaaaaactggacgctgacgaaaattatctggcgtcgctaatttgcggcggatcatctgtccctgagaaaaaacgggtacaatacgcccatcaatgccacggtcgcgtggcatctttttttcaggagcgatcgatgtctcaggtacagagcggcattttgccggaacattgccgtgcggcaatatggatggaagcgaacgtcaggggcgacatcaacgccctgcgcgcaggcagtaaaatttttgccgataaactggccacctttcaggcggcatacccggacgccgccctcggcgcggtggtggccttcgggcataacgtctggcgcgagctgagcggcggcgtgggcgcagccgaactgaaagatttcgtgccttacggtaaagggctggcccccgcgacccagtacgacgtgctgatccacattttatccctgcgtcatgatattaacttctccgtcgcccaggcggcgctggaagccttcggcgatgcgctggaggtgaaagaagaagtgcacggtttccgctgggtggaagatcgcgatctgagcgggtttgtcgacggcaccgaaaacccggcgggcgtggaaacgcgtaccgaggtggcggtgatcaaagacggcgtggacgcgggcggcagctatgtatttgtgcagcgctgggaacataacctgaaacagctgaaccgcatgagcgtgccggatcaggagatgatgattggccgcaccaaagtcgccaacgaagagattgacggcgatgcgcgcccgatcacctcgcacctgtcccgcgtcgatctgaaagagaacggcaaggggctgaaaatcgtccgtcagagcctgccttatggtaaggccagcggcacgcacggcctttacttctgcgcctactgcgcccgcctgtacaacattgaacagcaactgctgagcatgtttggcgacaccgacggtaagcgcgacgccatgctgcgcttcacccgtccggtcaccggtggttactattttgcgccatcgctgtcgcggttattagcgctgtaaaagctctgttgattcgcaggccgggtaagccttagcgctacccggcaatttccctgctgccttattctcttttcaacttgcaaatcaccaaacggtatataaaaccgttactcctttcgtactgcttataaataaactgtgatccgaacagtctttctacttataagggtgcgcaccgccatgaccaaacttaaaaaaggatatctgacgcttgcagcatccctgttgctggtggctcaggcgcaggcaacagaactgcttaacagctcctatgatgtctcccgcgagctgtttgccgccctgaatccgccgtttgaacagcagtgggcgaaggacaatggcggcgacaaactgaccatcaaacaatcccatgccggttcttcaaaacaggcgctggcgatcctgcaaggcctgaaggctgacgtggtgacctataaccaggtcactgacgtgcagatcctgcatgataaaggcaagctgatcccggcggactggcagagccgtctgccgaataacagctcgccgttttactccaccatggcgttcctggtgcgcaaaggtaacccgaaaaatatccacgactggaacgatctggtgcgttctgatgtgaagctgatcttcccgaatccgaaaacctccggtaacgcgcgttatacctatctggcggcctggggcgctgcggcaaaagccgacggcggcgataaagccaaaactgaaaaattcatgacccagttcctgaaaaacgtcgaagtctttgataccggcggacgcggcgcgaccaccacctttgtggagcgcggcctcggcgatgtgctgatcacctttgaatcggaagtaaacaacatccgcaaacagtatgaagcgcagggctttgaagtcgtggtgccgaaggtgaatatcctcgcggaattcccggtcgcctgggtggataaaaacgttaaggccaatggcacagaaaaagcggcgaaagcttatctgaactggctgtacagcccgcaggcgcagaccatcatcaccgattactactaccgcgtgaacaatccgcaggtaatggaaaaactgcaggataaattcccgcagaccgacctgttccgcgtggaagatcagttcggcagctggcctgaggtgatgaaaacccacttcaccaccggcggcgagctggacaaactgctggcggcggggcgtagctgatgtttgccatgtcgacccggcgcgtgctgccgggctttaccctgagtcttggcaccagtttactgttcgtctgcctgattttattactgccgttaagcgcgctggtgatgcagctggcgcaaatgagctgggcgcagtactgggaagtgatcactaatccgcaggtggtggcggcctataaagtcacgctgctgtcggcttttgtggcgtccattttcaacggtgtgtttggcctgctgatggcgtggatcctcacccgctaccgttttccggggcgtacgctgctcgacgcgctgatggatttacccttcgcgctgcccacggcggtggcgggcttaaccctggcgtcgctgttttccgttaacggcttttacggccagtggctggcgcagttcgatattaaagtcacctatacctggcttggtatcgcggtggcgatggcctttaccagcatcccctttgtggtgcgtaccgtacagccggtgctggaagagttaggcccggaatacgaagaagccgcgcaaaccctgggcgcaacccgcttacagagtttccgcaaagtggtgatgccggagctttccccggcgttgctggcgggcgtggcgctgtcctttacccgtagtctgggggagtttggcgcggtgatttttatcgccggtaacatcgcgtggaaaacggaagtgacatcgctgatgattttcgtgcgcctccaggagtttgattatccggcggcgagcgccattgcctcggtgatcctcgcggcatccttactgctgctgttttccatcaataccctgcaaagtcgctttggccggcgtgtggtaggtcactaatggcggacgttacccaattgaaacgctttgacgcgccccgtattaactggggcaaatggtttttaattggcaccgggatgctcctttctgcgttcatcctgctggtgccgatgatctatatcttcgtgcaggccttcagcaaagggctgatgccggtgctgcaaaaccttgccgatccggacatgctgcacgccatctggctgacggtaatgattgcgctgatcaccgtgccggtgaacctggtgttcggcattctgctggcctggctggtgacgcgctttgattttccgggccgtcagctgctgctgacgctactggatattccgttcgccgtctcgccggtggtcgccggtttagtctatttgctgttttacggctccaatgggcccctcggcggctggctggacgcgcatgatatgcagatcatgtttgcctggcccggcatggtgctggtgaccatctttgtgacttgtccttttgtggtgcgcgagctggtgccggtgatgttaagccagggcagccatgaagatgaggccgccattttgctcggcgcgtccggctggcagatgttccgccgcgtcaccttacccaatatccgctgggcactgctctatggcgtggtgctgaccaatgcacgcgccatcggtgaattcggggcggtgtcggtggtatccggctcgatccgcggtgaaaccctgtcgctgccgttacagatagaattgctggagcaggattacaacacggtaggctcctttaccgccgccgccctgctgacgttaatggctattttgaccctgtttttaaagagtgggttgcagtggcgtttgcacaatcaggaaaaacgcgcgcaacaggaggaacatcatgagcattgagatcgccaacattaagaagtcattcggacgcacccaggtgctcaatgacatctcgctggatattccttccggacaaatggtggcgctgctggggccgtccggctccggtaaaaccacgttgctgcgcattattgccgggctggagcaccagtccagcggccgcatccgttttcagggcaccgacgtcagccgtctgcatgcccgcgatcgtaaagtcggcttcgtgttccagcattacgcgctgttccgccatatgacggtgttcgacaatattgcctttggcctgacggtgctgccgcgtcgcgagcgtccggatgccctcgccatcaaagcgaaagtcactaaattacttgagatggtgcagctggcgcatctcgccgatcgttacccggcccagctatccggcgggcagaaacagcgtgtggcgctggcccgcgcgctggcaccggatccgcagatcttactgctcgacgagcctttcggcgcgctggatgcgcaggtgcgtaaagagctgcgccgctggctgcgtcagttgcatgaagaactgaaattcaccagcgtgttcgtcacccacgatcaggaagaggcaatggaagtcgcggatcgcgtggtggtaatgagtcagggcaacatcgagcaggttgatgtgccggagcaggtgtggcgcgaaccggcgacccgctttgtgctggaatttatgggcgaagtgaaccgtctgaaaggcacggtacgcggcgggcagttccacgtcggcgcgcaccgctggccgctgggttatacgcctgcccatcagggggacgtggatctgttcctgcgcccgtgggaagtggacatcagccgtcgtaccagtctggattcgccgctgccggtgcaggtcatcgaagccagtccgaaagggcattatacgcagctggtggtgcagccgctgggctggtatgacgaaactttagccgtggtgatgcgcggagatgatgcgccggtgcgcggcgaacggctgtttgtcggcctgcaacacgcgcgtctgtaccacggcaatgagcgaatcgaaaatcacgaagaacagccgctggcggaatccgcgtgaggacgtaatgcccggtggcgcttcgcttaccgggcctacataatggctccttacctgtaggccgggcaagcgaatgtgccgcccggcaaaaaaacacaaccctgtcgcttttttatttcctccacacactcgaaatgcaggtaaggtcacactgactttcattccactgccatttcctcataatgacttgtcattcattatgcgctctaataaaacccataaatggtaatacctgttatcaggagcgccagcatatggatattaaattaagtcaggattttttcctgtcggacatccatgccttttgtctttttaaattaaacaatcaggccatggcagatattcacgggcatgaattcgatgagttggtaattgtatgtggtggctgcggatttcatgtcattaacgatcaggttgagttaattcaccagggtgattttttttacgtgtcggcaaatgatgtacattattataatcagactagtcatttgtcacttatcaatatactgcttcacaaacagcgtccgtttcattttattcatcatgtagatgatctgctggtaatggtaaaaaaacacactgtaccctttacgcagcactatcagccgcttggtgaaaatgaactccggcaggtgatcgccgaggcggcagcagtaagcgcacgacgcgatgacagctatgactgcgcctattttgcgcatactgaatcgcggctgctggggatcttctccacgctgtatcagtgtatcgaacagtcggcgcatcgcaccgctccgggcggcaacggtgtcctgtatttactgaattatattcgtcataactatccgcagcagattcactggcagagcttatgcgaaatggcggggctttcccagcgcaccatgtatcgagcttttcacgatctgaccggagttactccgcaaaaattccagcaaatttttcgtttattaaaagcgcaggagaaattgcgtaccaccgatttgccagtgaaaactattgccacgcattgtggctttattaatgccccgcatttaaccgaaatgtataaaaaacacttttcacgtacgcccacacaggagcgccagttaagccgttcggtcagcgaaacatgatcctctaatgggtggtcaataataaggaaatggagtgaatgttatggataaaaatacacaaccgaatgcctggtatgtgggcgtcgtttcgggcatggcgtcttatatcgactcagcggccattgtttctaatggcactgcgctggttatttatcagaaagcgatcggcaccacagcgacagaaattggcattttgtcgggcatattaaccttatgcatcgcactgggtgcctgcgtcggcgggcgtctgggggatcgcctcggcaggcgtaacgtctttatcaccaccatggcgatgatcgtggccggtacgctattactggcgtttggcaaactcttcccgctgttatttatcggcacagtactggtggggctggcgaccggggccgatctaccggtatcgctcgccaccatcgccgaagccgccagcgatacgaatcgcggcaagatcattggcctgtcgaatttgctgtggacgctgggcattggcaccaccatggcgatctccgccgtggtgggcggctggggggcgacgggggcgcaaatcatgtatctgcatgtgggcgtggtggcggcaacgctgctggtgctgcgctggtcgatccctgaatccccgctgtggctgacggcgtgcgacgagcgattacgcggcgtgagtacggtacgggcgcaaaaagttgcgtttaaagatctgctgcgcggcaaatacgcatggccttttttcgcgctgtgtctgttttattccttcaccaatctggcagcaaataccggcgggcagtttggcacctatgtggcggttaatgttgtcggcatcagcgtggagcaaaattccttgtggaacctgctcatcatgccggtcggtatggtatccggcctgttgtttatgaaagtcgtggatacggcgcaccggatgcggatttttgtagtgggtgcctgtttttttgctggcggattttttatgccggtgctgctgagcttctcgccgctgtcgtggttctgctgtctgttgtttaccggtatcggcagcggtctggcgttcgagggcatcatgaaagtctggtcgcaggagtctttccccaccatgctgcgttccaccgcgcagggcgctattgtcggcctgtcacgtctctcctgcggcattctcgcctttgttaccccggtgttgctcgatgccgggcctgttgtgctctacaccattttatcttctatcgtcgcctcggggttgttgatcggctggctgtgcttccatggccagcagcgcaatgaattcagccttgaggccagcgaattacaggacgaatttaaacaccttcagcaataaggagtcagaattatgctggcagtaagcaagatcaccctcaattatgaacccggactgtgcggcgtggacgcatttccgctggtgggctggcaaattgtcagcgatcggcaaaacgtctatcaacaaagctggcggctacagtgcagtacggacgccgcgttttcacagcttcactatgacagcggtgtggttacggataacgcgtcggcgaatatcacgctgccggacatcccgctattgccttcgacgcgctatttcctgcgcgtgtgtatcagcgataacgatggcgaacagagccgctggagcgaggccgcagaattcgtcactggtatgctaaatgccccctggcaggcggattttatctcggcggaaacgccggaaaatcgccaccagtcgaacggcaccttgctgcgtcataccttcaggctggcagataaagctatcgcggtggcctttgtccacgtcaccgcacttgggctttaccatctttatctcaatggccaacgggtgggcaatgatgaactggcccccggctggacaagctataagcagcatttgctgtatcagacctgggatgtcacagcacaactccgtcagggcaagaatgccattggcgcggaagtaggcgcaggctggtttaaaggggacatgggctttatgcggcaccgcaatttttacggtgagcaaacggcgctgctctgccagctggtggttcgctatgacgacgggacacagcaggtgatcggttccaatgacggctggcgcacggatgcctcgccgatccgcttttccgaactctacgatggcgaagtgtatgacgcccggctggtgcaagatggctgggcgaatacggagtttgacgatcatgggtggcgtccggccagcgtggtgacttttaaccggcaggcgctgaccgctcagggcgcaggtaaggtgaaggcgcaggaaacgctgttgcctcaggctatcatcaccacgccgcagggcgatacggtgattgatttcggccagaatatgagcggctgggtggcgttttgcgttaacggccagcgtggcgacagggtggtattgcgccatttcgaaacgctggacgctcagggaaatgtctatctggacaatctgcgcagtgcgcagcagcgcatcgaatacatccttagcggcgatggcgaagaaacttaccatccacacttcacctttcagggctttcgctatgtaaaagtggagcagtatccgggccggattgaggctgagaattttaaagccattgtgctgcattcggatatgcagcaaaccgggcgatttagctgttcacacgcaggccttaatcagttacatcataatattttatggggactgaagagcaatttcgtcgatgtgccgacggactgcccgcagcgtgacgagcggctgggatggacgggcgatgcgcaaatcttctgccgcaccgccagctacctgatgcaaacgcgcaactttttcgccaaatggctggccgatctgaaaattgaccagacgccggagggcggcgttcctcatgtgatcccggatatactgaccgggcactgcgaggctgaccgttttttgtccgctgggggaactcattcgtcatccgcctgggccgacgcggcggtggtgaatccctggacgctgtacctgatgtacggcgatacccgcattctggacacgcaatatgacagtatgaaagcctggatcgactttatgcatgctcacgctgacaatcacctgtggcgttacaaattgcagttcggtgactgggtggcgctggataccgccgaaggtagctattttggcgccacgcccgattcgctgatttgtaccgcctggtatgcgtattccaccgggcttttcgcccgcgcggcggcagtgctgggtcgccatgatgatgcggcgaattaccgggcgttatatcaggccattgtgcagcactttcacagcgaatttttcaccgctgacggcgcgatgaccgccagaacccagacggcgcatattctggcgttgtatttcaatcttgttcccgatgcctggcgtcagcgcacggtagatacgctggtggaattgttggcggaacaggagggacatctggtaacaggcttcgtcggcacaccctatttttgtcatgcgctgagtcagaacgggcggatcaacgaggcatgggctttgctgatgaaagacgatttcccgtcatggctgtatcaggtgaacgccggggcgaccaccatctgggagcactgggacggcatcagaccggatggttcaatgtggagtcctgacatgaactcctttaatcattatgcctacggagcggtaggggagtggttatatcgtgcggtggcgggtattgaggtcgacgaggcacagcccggctttaagcacgtcattatttccccgctgccgggcggtgaggtgagttttgttgatgccggttatcagtcactgtatggcgaaatcgccgtgcactggtgtcgtgttgatgggcgcatccgactaagcgtgcgtattccggcaaacactaccgccacgctgaaactcgccgcctgcgagattattgtggcgggcgggctggcgtttacgccacacggttcgcaatggtgtgcaacaaccggctcgggggcgtatcaggtggaatatctgcctgctgacgataaggcataagggcttttgccgggcggcgcattcgcttgcccggactgggttggtttgcatgcccggtaatcatagcgccatcgtgcaacacagaaacgtcacagtgaatatagacctgaccgggcgtggctgataagttatcgccatcttgtttttgccgggtggtccaggtctgggttatgcatgtaagcccggtaagcgaagcgccaccgggctttttattggacagcgtttgtgaatacattagaagacactatcggcaatacgccgctggtgaaactccagcgcatgactccggataacggcagtgaaatctgggtcaagctggagggcaataacccggcgggatcggtaaaagatcgcgcggctttatcgatgatcgttcaggcggaaaagcgcggtgaaattaaacccggcgatgtgctgatcgaggccaccagcgggaataccggcattgcgctggcgatgatcgccgcgatgaaaggctaccgcatgaaattgctgatgccggacaacatgagccaggagcgcagggcggcaatgcgcgcctatggcgctgaactggtgctggtcagcaaagagcagggtatggaaggcgcacgcgatctggcggctgagatggcgcagcgcggcgaaggcaagctgctggatcagttcaataatcctgataacccttacgcacactacaccaccaccgggccggaaatctggcagcaaaccggcgggcggatcactcactttgtctccagcatgggtaccaccggcaccatcaccggcgtatcccgttttctgcgcgagcaggaaaaagcggtgaccattgtcggcctgcaaccggaagagggcagcagcattcccggcatccgtcgctggcccgctgaatatatgccggggatctttaatgccgcgctggtggacgaggtactggatattcatcagcgtgaagcggagaataccatgcgcgagctggccacccgggaaggcatcttctgcggcgtcagttcaggcggcgcggtcgccggggcgttacgcgtggcaaaggccacgccgggcgcggtcgtggtggccattatctgcgatcgcggcgatcgttatctctccaccggcgtgtttggtgaagagagttattctcagggttcaggcatctaaaggaggcaacaatgaacatggtgttgttcaacgataaaaccagagcgttacaggcggatattgtcgccgtgcagtcgcaggtagtttacggcagcgtcggtaacagcattggcgtgccgaccatcaaacgtcaccatctcaatgtgatcgccgttccgacggtgctgctcagtaataccccgcattacgataccttctacggcggcgtgatccccgacgagtggttcagcggttatttacaggcgttgcaggagcgggatgcgctgcgccaggtacgcgcggtgaccaccggttatatgggcaatgcgtcgcagattgctattctggcgcgctggctgacggcgctgaaggcgcagcatcctgatctgctgatcctggtggacccggttattggcgacatcgacagcggtatttacgtcaagccggagctgccggacgcctatcgccagcatctgctgccgctggcgcaggggctgacgccgaacgttttcgaactggaagtgctgaccggcaaaccgtgccgcgatcatgacagcgccattgccgccgccaaagggctgctctctgattccctgaaatggattgttatcaccagtgcgccgggcgttgccgacagcgacgacatgcacgtggtgctggtcacggcagacagtgtggaagtgatcacccatccgcgcgtggcgacagatttaaaaggcaccggcgatctgttctgcgccgagctgaccagcggcatcgtaaaaggcttaagcctgagcgacgcggtgaaaaaggcgggaacgcgggtttttgaggtgatgcgttatacgctggataccggccgtgatgaactgctgctgccgccagacctggtctgaacgcaaagtgacaggcaaaaaaaaggcaccctgaaggtgccttttttatgtgcggcaagaattacttcttgatgcggataaccggggtttcgcccacggtcacgctaccggacagtttgatcagctctttgatttcgtccatgttggagataacaaccggcgtcagggtagacttggctttctcttccagcagtgccagatcgaactcgatgaccgggtcgccaactttaacgcgctggccttcttcggcgatacgtttgaaaccttcgcctttcagttcaacggtatcaataccgaagtgaacgaacagctcaatgccgctatcggattcgatagagaaggcatggttggtttcaaagattttgccgatggtaccgtcaaccggtgccaccattttgttgccggttggtttgatagcgatgccatcaccaacgattttttcagcaaacactacatccggcacatcttcaatattgacgatctcgccagacagcggagcgataatctcaatggttccggtatctttcttatcgtcagaaaccagagatttcagtttatcgaacaaacccatgatcttctcctaagcagtaatttgggccgcatctcgtggattagcagattgttttttcttcaatgaacttgttaaccagcgtcattaactcgtccgttgtcggttgagcaagagcctgctctgctaataccttcgcatcttcgaagttcgtgttacggataatcttcttaatgcgcgggatagaaatggcactcatactgaattcatccagacccatccccagcaacagaagtgtagcacgttcatcgcctgctagctcaccacacatgccagtccatttgccttcagcatgagaagcatcaatgacttgcttgataagcgtcagcacggacggtgacatcggctggtaaagatgtgaaatcatatcattaccacggtcaactgccagcgtatactgcgttaaatcattggtaccgatgctaaagaaatcaacttctttcgccaggtgacgggcaatggtcgctgcggcaggggtttccaccatcacgcccacttcaatgctctcgtcaaaggctttaccttcgtcacgcagttcctgtttatagatctcgatctcttttttcagcgtgcgcacttcttcaacagagatgatcatcgggaacatgatgcgcagtttgccgaaggcggaggcgcgcaggatggcgcgaacctgatcgcggaggatctctttacgatccatagcgatacgtaccgcacgccagcccaggaacgggttttcttctttcgggaagttcatgtacggcagctctttatcgccgccaatgtccatggtacggacgataaccgcttgcgagccacaggcttctgcaacggctttataggccgcaaactgctcttcttcgcttggcagagagtcgcgatccatgaacaggaattcggtacggtacaggccgacaccttccgcgccgttacgctcagcaccgtctacatcgcggacagtaccaatgttggcgcacacttcaacctgatggccgtcgagcgtgattgccggcagatctttcagcttcgccagttcagctttttcgctggcgacctgttcctgcacggcacgcagtttttcgatctcttcgttggtcgggttgacgtaaaccagattgtttacggcatccagaatcagatagtcgtcgtttttcacctgcgaggtgacgctaccggtgcccacaatcgctggcagctcaagggaacgcgccatgatagaggtatgggaggtacggccgccaacgtcggtgataaagcccagcaccttcttcaggttaagctgtgcggtttcggacggagtcagatcggcagcgaccaggatgacttcatcctgaattgcgctgagatcgataatcgccaggccaaggatattgcgcagcagacgtttaccgatgtcacgcacgtcagcggcgcgttctttcaggtattcgtcatccagctcttcaagagcggtggcctgaccttcgataatttcgtgcgcggctgcatcagcagtgacgtgcttatctttaatcagggctatgatttcctgctcaagctcctcatcttcgagcagcataatgtgcccttcgaagatggcttctttttcttcaccgaaagtttcgccagctttagtcttaatggcttccagttgcgctgatgccttggcacgaccgctcagaaaacgttcaacttcctgatcaaccttgtcggcagaaatttttttccggtcgatgacgatctcgtcttctttcagcagcaatgctttgccgaaagcgatacccggggatgctaaaatgcctgaaatcataaccctaccttacttgtgactgatttttaaaagaacccgtgaacttactcgagttcagccatcagtttaaccagatgctcaacggctttctgctcgtcttcgccttctgcggacagcgtaaccacagtaccctgagtcagacccagagtttgcagtttgaacaggcttttagcactggcgcttttgccattggaggtcacagtgatctcagaggagaagccttttgcttctttaacaaactgagcagcagggcgggtatgcagaccgttcggagcggtaatggtaacttcttgctggaacattgtatttccccaacttataggtttagtgttgtggaactaaagtctagcctggcggcttaactttagcctgtattgttagcgccgagagtaacgggacgcgatacagaagcgtgttgacgcaaatccgggccggaaacttctggccgttaaggtttcgtccgtcattaatcattatgccgcgaaagcgagacctgaaccaaatgattaaatcgattcagctggcacaaagtcacaattcgattaatttcgcgcttcgaaataaatgtggtgcttaaataccagacctgcaggggcgaagcaatgctgtgcgagcggaaactttgacgtgcgccacaaaaaagcaccctgacaggtgcttttttgcgcgattttactgtgcggacattactgttgcagttctttttcagtgaagagatcggcaaacagcgcagtgctcaaataacgctcacctgaagaagggagaataacgacaatattcttgttggtaaaggtttcgtcttcctgcaatttcaatgctgccgctacggcggctccggaagagatgcctgccaggataccttcttcttccatcagacgacgcgcggtgtcgatggcttcttcgttagtgatggtgaccactttgtcgataagcttaagatccaggttgccaggaataaagcctgcgccgataccctggattttatgcgggcctggcttcagctcttcgcctgccagcgcttgcttgatcaccggggagtcggtcggttcaaccgccacggtgatgagatccgttttgcctttggtatttttaatataacggctcacgccggtcagcgtaccgccggtgcccacgcctgcgataaacacatcaacctgtccgtcggtatcttcccagatttccgggccggtggttttttcgtggatttccgggttcgccgggttgctgaactgctgaagcagcaggtatttggatggatcgctggcgacaatttcttccgccttctggatcgcgcctttcatgcctttcgcgccttcggtcagcaccaggttcgcgcccagcgctttcagcagcttgcggcgttcaatgctcatggtttccggcatggtcagcgtcagcttgtaaccgcgcgcggcagccacataggccagcgcgataccggtgttgccgctggtcggttcaaccagttcaacgccctgtttcagcacaccacgtttttcggcatcccaaatcatattggcaccgatacggcatttcacgctgaagctcgggttgcgggattcaaccttcgccaggatgcgtccattgccgatgcggttcagtcgaaccagcggcgtatgaccgatagtcaacgagttgtcttcaaaaatcttactcatagcccgtccttaactgtatgaatttgggaacgtcatcagcatacgcggttaagaatgatgcggaagtaaggatttcgcatatctatatgctgatgagaaataatgacaacaagtatggaataagaagaggaataatccactcacttccacagcgcgtgttttggccgataacagtccacccacatcgccgttgcgccgcataccgccaccggcatgatgaccaggttaaggaacgggatcagcgtaaacaggctggtcagcgcgccaaactgcatatttgtgaccttttgctggcgtaacgcctcgcgcatggttttaaagggcactttatgattatcaaagggataatcgcagtactggatcgccagcatccaggcgctgaacaggaaccacagcacgggagcgaccgtctgaccaatgccagggatgaaataaagaagcagcaacaccagggcccgcggcagataccacgccagtttctgccattcacgcttcatgatgcgcggaatgtctttcatgatggcggcgatccctgcatccggcggcgttgcgccggtcagacgcgcttccagctgttccgccagcaggccgttgaagggggccgcgatccagttggcgagggttgagaagaaatagccgaacaccagcaccaccgaaatgaccaccagaggccacagtaaatagctcagccactggagccagtcgggtacgtgggacataagttgcgggatccagctgtcgagctgtaaaaagagccataaaaaagcggcgcccatcagcagaatattgaccagcagcggcatgatcacaaagcggcgaatgccggggagggtgatgagcttccagccctgagaaaagtaccagacgccgctacgaggcgcggttgcagatgataaacccatatcaggccagactcctttattaacagccagggaaagtgcacggctatattagcggtttacgcgccgctggctagttcggaaatgttcgaaaaaacagcaaaaagcacgattttgttcatctttatgcagtgaaagccatgtgtgcacttgcacttgcgggaatcggcaaatactcttagtgagtaaatgtttgccgtggtggcaaggtgttagaacaacagagaatataatgatgcaggatttgcgtctgatattaatcattgttggcgcgatcgccataatcgctctgctggtacatgggttctggaccagccggaaagagcgctcttctatgttccgcgatcgcccattaaaacgcatgaagtcgcgtcgcgatgatgaaccttttgaggatgacatcgacgaagacgccgacgatggcgtaggtgaagttcgggttcaccgggttaaccctgcaccgggaacagcccctgagcaggatgccccgcgttcgcctcagcaccagtatcagccgccttatgcgtcggcacagcctcgcccgacggcacccgtgccgccgcgtgacagcgcgccggtggcttatgaggagccgccgcgtcagccggtacagcagccgcagcagcctgttcatcaacagccagtgcatcaacaaccggctcagccgcaacccgtacatcaacagccagttcatccgcaaccggctcaacaacagcctgttcaccagcagcctgtcacgcatcaaccgcagcctgcgccgcacgtcgagccgcagtacagcgcgccgcagcagccagaacccgctccagcgcccgtcgttgaagagccggttatcgcgcctgaaccgccgaagcgtaaagaaacggtgatcgtgatgagcgtagccgcgcatcagggtaccgaactgaacggtgatgtgctgcttaacagcattcaacaggctggctttatgttcggcgacatgaacattttccatcgtcacctcagcccggacggcagcggcccggcactgttcagcctggcgaatatggttaatcctggcacctttgatcctgaaatgaccggcaacttcaccacgcctggcgttactatcttcatgcaggtgccgtcttacggcgatgagttgcaaaacttcaagcttatgctgcaatctgctcagtacattgctgatgaagtcggcggcatggtgttagacgatcagcgccgtatgatgacgccgcaaaagctgcgtgagtatcaggcccgcattcgcgaagttaaagaggcaaacgcataaactgcgtatggctgttctaaccccttcctgaacccccgcctgtcgggggtttttattattgatggtgtgttatggaatcaatcgaacaacaacttacagaactgcgaaccacgcttcgccatcatgaatacctgtatcacgtgatggacgcgccggaagtgcccgatgccgaatacgatcggctgttgcgtgaactgcgtgaactggaagcgcagcatcccgacctgatcacccccgactcgccaacccagcgcgtgggcgccgcccctttaagcgcctttacccagatccgccacgaagtgcccatgctgtcgctggacaacgtctttgatgaagagagctttctggcttttaacaaacgcgtgcaggatcgactgaaaagcaccgacgcgctgagctattgctgcgaactgaagctggacggccttgcggtgagtattctttatgagaacggtgtgctgatccgcgctgccacacgcggcgacggcacgaccggtgaagacatcaccaccaacgtacgcaccatccgcgccattcctctgaagctgcacggtgacaatattccggcgcgcctcgaagtgcgcggcgaagtgttcctcccgcaggcgggatttgagaagatcaacgaggaagcccggcgcactggcggtaaaatttttgccaacccgcgtaacgccgccgcgggctcgctgcgccagcttgatccgcgcatcaccgccaaacgcccgttaaccttcttctgctacggcgtcggtattctggaaggcggcgaactaccgcgcagccatcttgaacggttacagcagttcaaacgctggggactgccggtcagcgaccgtatccgcatttgcgacacgccgcaggcggtgctggatttttatcacaaggtcgaagaagaccgcccgcagctgggtttcgatattgacggcgtggtgatcaaggtggactcgctggatctccaggagcagctcggctttgtcgcccgtgcgccgcgctgggcggtggcctttaaattcccggcccaggagcagatgacctgggtgcgcgatgttgaattccaggtggggcgtaccggtgccatcacgccggtggcgcgtctggagccggtgcatgtcgcgggggtgctggtcagtaacgccacgctgcataacgccgatgaaattgcccgcctggggctgaaaatcggcgataaagtggtgatccgccgcgccggggatgttatcccgcaggtggtgaacgtcattgagtcggagcgtccggcgaatacccgcgaagtagaattcccgacccattgcccggtctgcggctcggatgtggagcgcgtagaaggcgaagcggtaacccgctgtaccggcggcctgatctgcggcgcgcagcgtaaagaatctcttaagcactttgtctcgcgccgtgccatggatgtcgacggcatgggcgataaaattatcgaccagctggtggagaaagagtacgtccatacgccagcggatctgttcagactcaccgccgggaaactcaccgggctggatcgcatggggccgaaatccgcgcagaatatcgttaacgcgctggaaaaatcgaaagagaccacttttgcccgtttcctgtacgcgctgggcattcgtgaagtgggtgaagccaccgccgccgggctggcagcctatttcggcacgctggacgcgctgatcgccgcctccatcgacgaactgcaaaaagtgccggacgtcggcattgtggtcgccacccatgtgcgtcacttcctggatgaagagagcaacagggacgttatccgccagctggtggaagaagtggggatccactgggcggcacctgtggtggtcaatgccgaagaaatcgacagtccgttcgccggtaaaaccatcgtgctgaccggcagcctgagccagatgtcacgtgatgatgccaaagcggcgctgctggcgctgggggcgaaggttgcgggcagcgtatcgaagaaaaccgatctggtgatcgccggcgaagctgccggatcgaagctggcgaaggcgcaggagttggggatagaggtaatcgacgaggcggagatgatccgtttattgggtgcgtgaaatggataaagcgcagctgattgaaatcgccaataccgaaatgccctttgggaaatacaaagggcgcaggctgattgatttaccggaagagtatttgctgtggtttgcccgtaaggatgaattccccgccgggcatcttggtcagctgatggcattcaccctgctgatcaaaaccgaggggctgacgcagctggtacagcccctgcgacgtccttaaccctgcgtggcgtcggaggcggccgcctcctgcgcctgcaacacttctgtctgatgcttatagcgtcgcgccatcaccgcacagaccatcagctggatttggtggaaaatcatcagcggtaacaccatcatgcccaccgccgacgcggggaagagaatgttcgccatcggaataccgttggcgagacttttcttcgagccgcagaaaacaatagtgatctcatcagccttgttgaacccgaagcggcgggcggcaaagatattgatgccgatgataatcgccagcagcacaatgctgacgacgacaataaacagcagcgagcctgcgcccactttatgccagatgccgttcaccacggcctcgctgaaggctgaatagaccaccagcaggatcgacgtctggtccgttttcgaaatccattttttatgcttagtcacaaagcctgcggtccacggacgcgacaggtggcccagcacgaacggcagcagcagttgcagcataatttttcctacctgctcaaggctgccttccgcgccatgcatattcatcaccaggcccaccagcagcggcgacaggaaaatccccagcagactcgacgctgacgccgaacagacggccgcggccacgttacccccggcaagggaagtaaaggcaatggcggactgcacggtggcgggcagaatgcacagatacagaaaaccggtgtatagctccgggctgacgttaaccggcgcccaccaggcaaacaggacgcccagtaccgggaacaccacaaaggtgctgcacatcacccacagatgcagccgccagtggctgccgccggcgatgatggcttcgcgggagagttttgcgccatgcataaagaacagcagggcgatggcggcggtcgtcagtccctcaaaaaagggcacaaagccaccgcgcgccgggaagaacgacgccagtaataccaccgccaccagcgttaaggtgaagggatcgagaatgcggaaaattttcataaacactcctgaagtcagtatcgttattctgcgtttttctctctgcgaaataaaagtcatttctgtcattcatttatgaaacagataggttaaggatccgatacgtgcaattcagaagagtaaaaaaggcagggcgggggaaaggcccggcggaaagccggagccagatgcagttgcgcggttaaatataaatatcgatcttgtggtcgtcagacgggttgttgacgccttcggcctgggtcagctgtttttgctcttgtttcttttccgcttctttggcctgctcgttttgcagctgcgccagctgcgcctggagcatctggatctgcgcgcggatctgctcctgctgcttttgcttttcttcgacagtgcctgagccgttcgccacttctttcagctgcgcggtcagtttgttgattttctgcgtcagacggctgatctgcgccgcggtgtcgttccctgcgctggacgagccagcgctgccgccggtttgcactgacggggtggtcgtcgagatggtggtcatgatgaactccttgtttgccataaaattgttttatcggcatttttcagcagagcttgagactcgcactctttaccattgccagcgtaaataattctgaggacattttgctgacccccgccattgatacagaggcgctatcaataggcaccgaaaagtgtattggtcaggaaagccgatgactcgttataaagccagagtacccgcggaaccctctccgcatggcaatacataacgattaaggacgcgccatgacctcttcgcatttttcagatcatccttttacctgtgctgacatcatccgcgcacgcaaacccaacttcaccccacgcgtggcctttattttaggttccgggctgggcgcgctggcggatcagattcaggatgcggtagccatctcttatgaagacttaccgggcttcccggtcagcaccgtccacggtcacgcgggagagctggtgctcggtacgctggcgggcgtaccggtagcctgtatgaaaggccgcggacacttttatgaaggccgcggcatgacggtgatgaccgatgcggtacgtacctttaagctgctgggctgcgaactgctgttctgtaccaatgctgccggatcgctgcgtccggaagtcgggccgggcagtcttgtcgccctttcagatcacatcaacactatgccgggatcgccgctgtgcgggccgaacgatgaccgcttcggcgaacggtttttctccctggcgaacgcctatgacgcggattaccgcgcgctgctgcacaccgtggcgcaggaagcgggtttcccgctcagtgaaggagtgttcgtctcttactccggcccgaacttcgaaacggcggcggagatccgtatgatgcagattatcggcggcgatgtggtgggcatgtccgtggtgccggaagtcatttccgcccgccattgcggaatgaaagtggtggcggtgtcggccatcaccaacctggcggaagggctgggggaggtgaagctttctcatgcgcagactctcgcggcggcggagctgtcccgccagaacttcatcgacctgatttgcggtttcctgcgcaagctggcctgataatcacacctaccgctccgctggccggggcggtttgtccttctgcgacaaggaaaagactatggggatcacggttcgcttaaaaatcatgtcgtttttgcagtatttcatctggggaagctggctggtgaccctcggttcgtacatgatcaataccctgcattttaccggcgcaaatgtggggatggtctacagctcgaaagggctggcggccattatcatgccgggcattatggggatcatcgccgataaatggctgcgggcggagcgggcttacctgctgtgccatctggtgtgcgccggggcgatgttttacgccgccagcgtcagtacgccggatctgatgttctgggtgatgctggtcaacgcgatggcctttatgccgaccattgcgctgtcgaacagtatttcttactcgtgtcttgcgcaggcagggctggatacggtcagccattttccgccgatccgcgtttacggcacagtgggctttattatcgccatgtggacggtcagcctgatggatctggaactgagcagcgcccagctctatatcgcctctgcttcatcactgtgccttgcggtctactccttaacgctgcccagaatcccgacggtggcgaaaaaagtgtcgcagtcgtggagcagtaagctcggccttgatgcttttgtgttgttcaaaaatccccgtatggcggtgttttttctctttgccatgctgctgggcgcggtgctgcaaatcactaacgtgtttggcaatcccttcctgcatgactttgcccgccagccggagtttgccgacagcctggtggtgagatacccgtcgattttgttgtctgtatcgcaaatggcagagatcggttttatcctcaccatcccgttttttctgcggcgttacggcataaaaacggtgatgctgatgagcatggtggcgtggatgctgcgctttgggctgttcgcctttggcgatccgtcgccgttcggctgtatgctgctgctgatgtcgatgattgtttacggctgcgcttttgatttcttcaacatttccggttcggtgtttgttgagcaggaggtcagttcagagatccgcgccagcgcgcagggcctgtttatgaccatggtcaacggcgtcggtgcgtatgtcggctcaatcctgagcgggctggcggtggattatttttccgttgatggcgtgaaggactggcagaccatctggctggtgtttgctggctatgccctggcgctggcggtgatcttttatttcgcctttaactataaacatcaacctgataagcgcgcagatgtggtacgttcagaggtttaatgatcctcgcaggcgtgcgaatctgatggaaccgctgtacaaaatcgacctgaaactgctgcgctattttctggctgtggcagaagaactgcacttcgggcgggctgcggcccgccttaacatgtcgcagccgcccctgagttttcacatcaaagacctggaaaaccagctggggacgcagctgtttgtccgccattcccgcagcgtggtgttaacccatgcgggaaagattttgctggaggagtcgcgccgtctgctgagtaacgtcaaccaggcgctggcgcgggtggagcagatcgggcgaggcgaggcagggcgcatagagttgggcgtggtgggcacggcgctgtggagcggcatgcgtaacgtcctgtatcgctttctgaaggacaatccggacgtcgaggtgcggtttcgtgagaaatcacccggaaggcagcagacgctgctggagcggcgggaactggatgccggtatctggcggatggcgcaggatctgcccgccgggctgacccgccagcgggtgcagcaggcggcgtttctggtggcgatgccggatgagcatccgctgacggcccgctcatccattccgctgtcgctattgcgcgatgaacattttgtcacgctgccgtcggtgcattctgactgggcgttcctgcaacgggtctgccagcgggcgggattttcaccggtgatcgtgcgcgaagcggtggagccgcaaacagtgctggcgatgatcagcatggggatgggcatcaccctgatggcggacagctacgcgcaaatgcagtggcccggcgtggcatttcgcccgctcgaagaacgtattcccgcggatttgtatgtggtgtatgaggaaaaacaggtgacgccggtgttagcgggtttactggcggcgctgacgcatcaagcgtaactcatgcccggcagcgcaggcttgccgggcatgggcgcggttggatcttgtaggccgggtaagcgcagcgccacccggcaaaaaacgcatagcaaaaaggcgcctttagggcgcctttccacattggtgggtcgtgcaggatgactcgcttcgctcgcccttcgggccgtcgccgccagcggctccgttgtctcgcttcgctcgacccgaacctgcggcaggttctcatcctgcatttcacgcatagcaaaaaggcgcctttagggcgcctttccacattggtgggtcgtgcaggattcgaacctgcgaccaattgattaaaagtcaactgctctaccaactgagctaacgacccgaaatggtgggtgatgacgggctcgaaccgccgaccccctccgtgtaaaggagatgctctaccaactgagctaatcacccatttcggtactgctgttgataaggtgagatatggtgggtgatgacgggctcgaaccgccgaccccctccgtgtaaaggagatgctctaccaactgagctaatcaccccacgtctcaagtcttatctgcactgcgggtctacctttaagtagatggtgggtgatgacgggctcgaaccgccgaccccctccgtgtaaaggagatgctctaccaactgagctaatcacccccgctgtgtggagtcgcattatagggagagttgaaaatgagtcaacgccttttctaaagattttgtttgttcgtcgtaaaattaaacaacgtggcgacaaagcctgcattcgcgcatgatttctcaacaaaaaacggatttgccgcgcccatggcggtaacaacattgaggaatcagcctggagtgatagaatattgcccactcgattttccaggacttgccggttatcggcatctttatcaacgtaaggccaattcatgaaaattaaaactcgcttcgcgccaagccccactggctatctgcatgttggtggtgcgcgtaccgcgctctattcctggctttttgcacgtcatcacgacggtgagtttgtgctgcgtattgaagacaccgatcttgagcgctctacgccggaggctatcgaagccatcatggacggcatgaactggctgagcctggagtgggatgaaggcccgtatttccagactaaacgtttcgatcgctacaacgcggtgatcgacgacatgttaaaagttggcacggcgtataaatgctactgctctaaagagcgcctggacgcgctgcgtgaagaacagatggcgaagggcgaaaagccgcgctacgacggccgctgccgtcacggtcatgagcatcatgctgacgacgaaccctgcgttgtgcgttttgctaacccgcaggaaggttcggtaatttttgacgatcagatccgtggcccgattgagttcagcaaccaggagctggacgatctgattatccgccgtacagacggttccccgacctataacttctgtgtggtggtggacgactgggatatggagatcactcacgtgatccgcggcgaagaccatatcaataacaccccgcgccagattaacatccttaaagcgctgaatgcgccggtgccggtgtatgcgcacgtatcgatgatcaacggcgacgatggcaaaaaactatccaaacgtcacggcgcggtcagcgtcatgcagtatcgcgacgacggctatctgccggaagcgctgctcaactatctggtgcgcctcggctggtccagcggcgatcaggaaattttctcccgtgaagagatgatcaagctgttttcactcggcgcggtcagcaaatccgccagtgcgttcaacaccgaaaaactgcagtggctgaaccaccattacatcaacaccctgccgccggaatacgtcgccacccatctgcaatggcatatcgagcagcagaacatcgacacccgcaacggtccgcagctggcggatctggtgaaactgctgggcgagcgttgcaaaaccctgaaagagatggcggagagctgccactacttctaccaggacttcgaggagctggatgcggatgcggcgaaaaaacacctgcgtccggtagcgtgtcaaccgctggaagtggtgcgcgacaagctggcggccattaccgactggacggcggaaaatgtgcatcacgctattcaggctactgcagacgagctggaagtggggatgggcaaagtggggatgccgctgcgtgtggcggtgacgggcgcaggccagtctccggcgctggacgttaccgtgcatgccatcggtaaaacccgcagcgttgagcgcatcaataaagcgctggaatatattgccgcacgcgaaagccagcagtaattctttcaggtcagcataaaaacgaacggcaggtttatcctgccgtttttttatttgcctgcggcgtccctgtcatggatgtcgaggcggctcagcatgtactgcaatccttccctcttcaacagacgatccagttgcgtttcttcggaagacgtcattgtttgtaaaacgctgacgatctgacgcagtgctggcgatatattgccataaggggcaggggcttcagccagtaaacgaccagctgcaagatgacgaaattttggcagcttcataataaaagcccgcaccttattatcgataaggatctgccttcctcgtccaccttttacgccggggatcttttcggtgtgccagccgtatctgcggatccagcgattcaccgtctgttttgtcatgccaacataatcagccagctcttcagtggttaatctatcaggtattttcatcatgttagttctggtcgcgcagaccgagccgttgtaataagccgctgatgccctcgcgtagcagcaaggaagtcagctgtttttgttctgccggggtcatttccttcgccagcgtcattaaaagcgcttccagcgagggctcaaggccgtacgcctcgtcaccggtactgtcatcgatcgcgcggcgcgcattgcgtataaattcgcgcacctgctcattgatatgcaccagacgggcttttccaccctgaacgcctggttttggcgaggtaacccagccttctttacgcacccatttattgatggtctggcgactgtatcccgtgagcctggcgagctcatccggcgtcatccgttccttgatcatgcaatttcctgacgagatgtgggggttagtggttcatcttatagcaccctttaacaggaaagtgtgacgggtttaactaacgtctgcgagcaggctcgcaatgtcattcatttgactgctttttcagcgattgagcggcgctttctgattttgccgttgacacctcgcggcggaattcatattatgccgcccgtcaacacgacacgctttacgcattggggctatagctcagctgggagagcgcttgcatggcatgcaagaggtcagcggttcgatcccgcttagctccaccaaattctgatcccaacagatttggtgcgtaaataacattgtggggctatagctcagctgggagagcgcttgcatggcatgcaagaggtcagcggttcgatcccgcttagctccaccaaaatttgaaccctcgcctgtggcgggggtttttttatgtctgttgcaaataccgcttcctgttatgtcagttttcttctgtttatcctggataattcctgtaaacctctgtttattgtattgccgcgctaatatcccgcgcttagcttgcctgatattgagaatgaacttattattccggctcggattaacgcggttggtgagattaaatcagtaaacataatgaaaattaatatttataaacacgcaacactatttatacttgcattcattatttgtctcgcagccgttacaacttcccgaattctttcaccaacagcgctggtccaggcgggggatgcttttctggcctggttacccttgagcgcgatgctgtccattattctgctctttggtcgacgaagtatattgccgatcgtcgtggccttcgcgttaataaatcactggctgatggatctctccttacgtgaggccgtgttactgctcttttgccagatcgcgccggtactgctggcctgcgcccttgtgcgatggcggctgggcagccgctggcgttacgcctttccggataaatacatgggtgtccggatattctggttaggatttttcgcgcccgccggtattaaactctcaatgtatttagcgaatgaatggttcgattatccggtttccctttccaacttctcggatcccacgtcggttatttataatattattgatttgcagagtcttatctgcgccgtgctaattttcacccccttgttttattatccgctacgcatgctggtgaacccgcactatgcccgtactttctggcgtcgcagtattattccgattttttctttgcgtaaacgtatttttactgttagctggttgttggctttaagttttattctgatcgttctttgtagtcccatcgaagcgaaatatatcgccggttacctggtgccaatcgtattcatcctgtttatggtcgccgtgcgggaattcacgccgccgctgatcgcgttaagctgggggatcgccgcgtggttcctggtggcctacaatcgcaattttctgcatggcgtcggcacagactattcgctggcttttgtgctgtcggtgctcatcgcggtgacaatctgtattctctatacggcgcatatttatcaccgtagcgagtggctcaggcgggtatggaaatctcaggcgcttaccgacccgctgaccggcctgcccaatctgcgtgccctggagcagcatctggaacagcatccccacgtggtcgtgtgctgtctgcatttgcaaaacctggaatttttaagccgtcactacggcatgatgatgcgcgtgcactgtaagcgcagcattgcccgcgacctgcaaccgctgatgctggcgcatgagaagctgttccgcctgccgggaagcgagttattactggtgctggatgggcaggagccagaagcgcgtttgcagcatatggtggattatctcaacagccggaaaatcttctggcacaacacgccgattgagattgaatttggcgcgtcctggggcgttatcgaaggcgcgggcgaaaacctgcaccatacgctgggacagcttagctggctttccggtcaggccagcacgacacagcgcgtactggcgctgacgcaaagtatcgacagagtcaccgaccagactaccgggcaggtgctgatgttgaacagcgtaaagcgcgcgctggaagaggggggactggtgctctacgcccagccggtccggagggcggatggcagcggctaccacgagattttaacccgtctgcaatgcgacggcgaaatcgttaccccggatcgttttatcccggtgatcagccgttttaatctcagtccgcgctttgacatgctggtggtcgaaaccctgttgcgctggctacgggcgcatccggtcccctgcgacggggcgcgtttttccgtcaacctgatgcccatgacgctgatgcaaaaggcgtcggcgacagaacttatcgcgctctttacgcgttacggcgtgtcgccacagtgcgtgattatcgagatcactgaagagcaggccttttcccatgccgaagccactttgcataacattcagcaactgcgtgatttcggctttaaaatcgccattgatgattttggaaccggctacgccaattttgagcgcttaaaacgtctgcatgcggatattattaaaattgacggcaccttcgtaaaagacatcgagcgtgacccgttagatgcgatgatcgtgcaggcgatttgcacgctggcgaaagcgaaatcgctgacggtggtggcagaatttgtggaaacgcaggcgcagcgtgagctgctgctggagctgggcgtggaatatttgcagggatatttactgggtaaaccgcagcctttaggcgactaaataaaaaaaccgggacaagcccggtttttattaacaccgcagaattacagtaccagcgcggcgattgatgcagacaggatactcaccagcgtcgagccgtagaccagtttcaggccaaagcgagagaccacgttaccctgttcttcattcagacctttaatcgcaccggcaatgataccgatggacgagaagtttgcgaaggaaacgaggaacacagacagaatgccttctgcgcgcggggagagggtgccggcaattttttgcagatccatcatcgccacgaattcgttagataccagcttggtggccataatactgcccacctgcagggcttcatgagatggcacacccatcacccaggcgaccgggtagaagatgtagcccagaatgccctggaaagatataccaaacacggtcgcaaacagagcgttcagcgcagagatcagcgcgataaaaccaatcagcatcgccgccacgataatcgccactttgaagcccgccagaatgtactcacccagcatttcaaagaagctctggccttcgtgcaggttggccatttgcagattttcttcgctctcatcaacacggtacgggttgataagcgacagcacgataaaggtgctgaacatgttcagaaccagcgcggcgacaacgtatttcggttgcagcatggtcatatacgcgcccacgatggacatggacacggtagacatcgccgtggccgccatggtgtacatgcggttacgggacatattgccgaggatgtctttgtaggcgatgaagttttctgactgccccagaatcagcgagctgacggcgttaaaggattccagtttgcccataccgttgacttttgacagcacggtaccaatggcacggatcacaatcggcagcacacgaatgtgttgcaggataccgatcagcgcagaaatgaagacgatagggcacagcactttcaggaagaagaatgccaggccttcatcattcattttgccgaagacgaagtttgtcccttcattggcgaatccgagcagtttttcaaacatttcggagaagcctcttacaaagcccagaccgacatcggagttcaggaagaaccaggccagtaaaacttcaataacaagaagttgaataacaaagcgaatgcgaatttttttgcggtcgctgcttaacaacaaggcaagcaaggccacaacggcaagcgccagaacaaagtgaagaacgcgggacatatttgctccaaatatgaggcaggtttaatttccgtgcacattctatgcaacaagcgtaaagaaaacgagatcaaaaacacactatagtaactacctgtgacgaatctcaaaaatagtgatcaaacatacatttctgttatgttacgtaaagatgagaaaaggctaatattgctgctaagcttttaacaaattgatgaggcaaatgttaagagcgcctttccacctgcacattccttccggctatcgctccgggctatcagaacaatcagtttaaccaaatcaggtgatcttgataatcattctcattttgttagcatgaaacatagcaaaggctatatcaggggcataaatgaacgacagtcgcgttgagagtaacagtggtcgtgcggcgcgcaagcttaggttcgcattaatgggacctgcgttcgttgccgctatcggttatatcgatccaggcaactttgccaccaatattcaggcgggagccagttttggctaccagctgctgtgggtagtggtctgggcgaacctgatggcgatgctcattcagatcctgtctgccaaactgggcattgccaccggtaaaaacctggccgaacagatccgcgaccactatccgcgtccgctggtgtggttttactgggtgcaggcggagatcatcgccatggcgacagatctggcggaatttatcggcgcggccatcggctttaaattactgctcggcgtatcgctgctgcagggcgcggtgctgacgggtatcgccacttttctgatcctgatgctgcaaaaacgcggccaaaaaccgctggaaaaagtgatcggcggcctgctgctgtttgtggcggcggcctatatcgtcgagctgtttttctcgcaaccaaaactggcggcgttaggtaaagggatgctgatccccagtctgccgactaccgaggctgtgtttctcgcggcgggcgtgctgggcgcgaccattatgccgcacgtgatctatttgcactcctcgttgacgcagcatctgcatggcggatcgcgcaaagagcgctattcggccaccaaatgggatgtggcgatcgccatgaccatcgccggttttgttaatctggcgatgatggcgaccgcggcggcagcgttccatttcagcggtcacaccggcgtggccgatctcgatgaagcctatctgacgctggagccgcttctgagccacgcggcggccaccatttttggccttagccttgtggcggcagggctgtcatccaccgtcgtcggcacgctggcgggacaggtagtgatgcagggctttatccgcttccatattccgttatgggtgcgccgtaccgtgactatgctgccgtcgtttattgtgattttgatggggctggatccgacgcgcattctggtgatgagccaggtgttgttaagcttcggtattgcgctggcgctggtgccgctgctggtctttaccagcgacagcaaactgatgggcgagctggtcaacacgccgctggtaaaacgcattggctggctgatcgtgttgctggtggtggtgctgaatatgtggctgctggtgggaacagtaacaggtctttaattcgtgattaaaaagcccggcaatgccgggctttttttgtattaatgatgatggccatgaccatgcccgtgacgaccgcgtccaccgtggtcatcgcgatcgcgccagccttcacgatagccgcgctcgtaggctttacgtttgtcccagccgcggtgatagccgcgatcgtgtggacgccagcggttttcacgccattgatagtgatgatgccagtaatcacggtcgcgccagcggccgccgtcccagtagttaccgtaattatcacgatcgccaatttgtaattttattgagggcagcagggtgatttcgccggcatttgccaccagcggggcagaagccattaaaacagctgccagtatcagtgacctgaacatacttatctccttcacgatcggggccgaaacggcctgttaatgcaatattacggggctgtaaagccccggtgcattggtttaactcttaaatcatgaagggcagcattatttgctaaaagtgctgttattccgggctgttcagtatgtggtcgatggcggtacattcatccgcgctgaagtggcgatttgccagcatgccgaccgcatcgtcaatctgcgccactttacttgcgccaatcagcacggacgttactttatcgtcacgcagcacccaggccagcgccatctgcgacagcttctggccgcgttgctgcgccagatcgtttaactgacgcaccttacgcagttttgcttcggtgagctgatcggggttgaggaaacggctaccgctggcggcgcgggaatccgcaggaatgccctgtaaatagcggtcggtcagctgtccacccgccagcggcgagaaagcaatgctgccgacgcctttctccgccagcacatccagcaattcatcttccacccagcgctcaaacatcgaatattttggctgatggatcaggcagggcgtgccgagatcgttaagaatatcaattgcctgccgcgccatatccgccgggtaattcgacaggcccacgtacagcgccttgccctggcgtacgatgtgatccagcgcgcgcatggtctctttcagcggcgtttccggatccgggcgatggtgatagaagatgtccacatactcaaggcccatgcgtttcaggctctgatcgaggctggcgataagatatttacgcgacccccagtcgccgtaaggaccctcccacatggtgtagcctgccttcgtggagatgatcagctcatcgcgccacgggctaaaatcttcctgcaggatacgaccaaagtgccgctcagcggagcccggcggcggcccgtagttgttggcgagatcgaaatgagtgatgccgagatcaaaagcccggcgcagcagctggcggctggtttctactagggtggcgtctccgaagttatgccacagccccagcgacaccgccggtagctttaaaccgctctcgccacagcggcggaactccatctttttatagcgctcaggatcggcctgataaaccatgcattaatcctcaattggcagacgtaacatcagtgtatacgtttacaccagctttgagactttgctgaaacggtaaagttattctgtgatgaagctcaataatatacaggcactcgtgctatggtcattgttgttaaagcgccttgaatttacagtgtgccaaagaatttttctgacttcagcggagcagtaaaaagaatgacaaagtatgcattagtaggtgacgtgggcggcactaacgcacgcctggcgttgtgtaatgtcgacagcggcgagatttcccgcgccaaaacctattccgggctggattatcccacgctggaagccgtggtccgcgtctatctggacgagacgggcgcagaggttgaggatggctgcatcgccattgcctgcccgatcactggtgactgggtggcgatgaccaaccacacctgggaattctccatcgcggaaatgaagaaaaatctcggctttgcgcatctggaaattattaacgattttaccgccgtatccatggcgatcccgatgctgaaaaatgagcatctgacgcagttcggcggcggcgagccggtagaaggcaaacccattgccgtgtatggcgcgggcactggccttggcgtggcgcacctggtgcacgtcgataagcgctgggtcagcctgccgggcgaaggcggtcacgtggattttgcgccgaacagcgaagaagaggggattatccttgaagagctgcgcagtgaaatcggccacgtttcggctgagcgcgtgctttccggtccggggctggtgaatctgtaccgcgcgattgtgaaatccgacggacgtctgccggaaaatctgcaaccgaaagacatcaccgagcgcgcgctggaagacagctgcatcgactgccgccgcgcgctgtcgctgttctgcgtgatcatgggacgtttcggcggtaacctggcgctgacgctcggcaccttcggcggcgtatacatcgccggtggcattgtgccgcgcttcctcgacttctttactgcctccggcttccgcggcggctttgaagacaaaggccgcttcaaatcctacgtgcaggatattccggtctacctgatcgtgcacgacaacccgggtctgctgggcgcgggtgcgcatttacgtcagacgctgggctactacctgtaagggttacaggtgcattaactgcctgaactctttgactttgctgcgactgaccgggacctgaaaatcaagatcccgcagtcgcagaatataggtgttgttaaaccagggttcgatttcgcggatcttgtccagattcacacagtatgagcgatgacagcgaaagaaatgcgctgccggtagtttgctgcaaaactccgtgatgttcatcggcatcacaaattcatcgcgccgggtatacacgaacgtcatcttctcatgcgcttccgcatagtaaatatcgtgaatactggtaacgatgatgcgctcatctttaatcagattgatggtatcgttttcacgcaccgccgggctgccggaacctgcgccagtctgctgctgccatgcagtctccagcttttgcagcatattgatgatgcgtgattcctgataaggtttcagaatatagtcaaaagcttccagctcgaaggcttcaactgcatgttctttccacgcggtaataaatacgataaagggtttatgggcaaactggctgatattctgcgccagtaaaacgccgtccagcgacgggatattaatatccagaaacagcgcgtccactttgttgtgctgcaaaaacttcagcacgtccaggccgtcgtcaaaggtgccgacgatctccatctggctgtgttctttgatgagccagctcagctcctgctgcgccaggatctcatcttcaacaatgatgactttcatggtgactctcctgattattgcaacagcgtgaccggcgcgggcaggggcgcgcgatcgtgcggcacgtagaaggcgatttccgttcccggctccaggcggcgaatatgcagcccttcgccgtacagcagttttacgcggtgatgcacattgagtaagccgattttattgccgggcatctcattggcctcgacccgctcaatgacctgcggatcgataccgttgccagtatcgcgcacggcgatacgcaccctgttaccgcactctgccacgctgatggtgaccacgccttttcctttacagggctgaatgccgtgcacgatggcgttttccaccagcggctggatcagcaggcttgggatcacacagttaacttcctcgtcgatgtcataaatcaccgtcagtttgtcgccaaagcgcgcctgctcaatggcgatgtaatccttgatttgatacagctctttcttaatatcaatttgctcatcgtctttcagttcaatgttatagcgcaggtagcgcgataaattgtaaatcagctgccgggcggtatccggattaaggcgaatggaggacgaaatggcgttcagggcgttaaacagaaaatgcgggttaattttgctttgcagggcacgcagttccgctttattggccatctcccgcaactgctcggcgcgggacacttccagctgcgtggaaatgatttgcgacaggccgatcgccatctcctgcaacgacgaagtaatttgatgcgcatggcagtagtagatttttaacgtgccggtgaccacgcctttttcccatagcgggatcaccagcatggagtggatttccggcgtgcgatgcgcctcatcattgtttttaatgatgattttaccggagttgatcgcttcaaaggtggtggggctgataatgtcatcgctgtcccggtagttgttttctccgataccgacgtaggccagcacatgatcgacgttggtaatggcgacggcatcggcatgaatatcgcggcggataatatcgcagacctgacgcagggattccgtattcacatggcggaacagcggcagcgttttgttggcaatatccagcgccagcttggcctgccgtgctgcgctggcctcctgctccccttcgacactctgcaccagcagcacaataaagccgatacatacggtaccgaggatcatcggtataccgattttcgacacgatatccagccccagcgcggtagtcggcgcccagagcaccaccaggatcatggtcagggtttcgcacagcatcccggcgataatgccgatgcgccagtggtgcgctttcggcgttttgaggttgatccagcccgccagacaaccggcaataatactggtgataaaacagggaatggccgtcacgccgccaatatcgatcagatagcgatgaatacctgcaatgatgccggtaataatccccacccaggggccgaacaggatcccgccggacatcaccgcaataatacggacgttgaccagcgacccctccaccggcacgccggaccaggtgctgaacagcgcaaacatggaaaagatggccgttacggccagcagctctttaggcgagtgggcggttttatgcagcagttcgcgaaacaggcgcatgcggatcaggaagaacagacaaatcagcattaacgccgcccgatcaaagaccgccagcagcatgttaaatatttcgtgcacggaaaactcgtgtgaatagcgtggaaaagagatgataaaaaatctgacgccggatgaccagttaacttccgcaaagggttaagaggaaaaaccctgttttcaaaaggggattgtgacggacgggcagtcagcgaatggcccgccgtgaaaaacgtcaatggtgggtaatgctctttttatcatcatgttaacttgctgttttatttgtgccttatatcgtgcagcttgtctggtcagacgaaaaatgccttccgctttttcgtggctgataaattattttccgttgcccctcgacagcgggaatttgttcaggctattttctaaacatgccacgcagtggcagcgtcgctcggacggtccgggcgctaacgttacatcgaggaatctatggctgactccagtccagtacgtcgctttacgcgcatcgaacgtcttcccccttatgtttttaacattaccgctgaactgaaaatggccgcgcgtcgccgcggtgaagatattattgatttcagtatgggcaaccctgacggcgccacgccgccgcacattgtcgaaaagctctgcaccgtggcgcaacgcccggatacccatggctattccacatcacgtggtattccacgccttcgccgcgccatttcgcgctggtatcaggagcgctatcaggtggatatcgatccggaaacggaagctattgtcaccatcggctcgaaagagggactggcgcacctgatgctggccacgctcgatcatggcgataccgtgctggtgccgaatcccagctacccgatccatatttatggcgcggtgatcgccggggcgcaggtacgttctgtgccgctggtggagggcgtggacttcttcaatgaactggagcgcgccattcgtgaaagctatccgaagccgaaaatgatgatcctcggtttcccgtcgaacccgacggcgcagtgcgttgagctggagttcttcgagaaagtggtggcgctggcgaagcgttatgatgtgctggtagtgcacgatctggcttacgccgacatcgtctatgacggctggaaagcgccatccatcatggaggtgcccggcgcgcgcgatgtggcggtggaattctttaccctgtcgaaaagctacaatatggccggctggcgtattggttttatggtggggaatcaggagctggttagcgcgctggcgcggattaaaagctaccacgattacggcacctttacgccgttacaggtggccgcgattgccgcgctggaaggcgatcagcagtgcgtgaaggacattgccgcccagtacaaacgccgtcgcgatgtgctggtcaaagggctgcacgaagcgggctggatggtggaagtaccgaaagcgtcaatgtacgtgtgggcgaaaatccctgaacagtacgcggcgatgggatcgctggagtttgccaagaaactgctgaacgaggcgaaggtgtgcgtgtcaccagggatcggcttcggcgattatggcgatacccatgtgcgctttgcgctgatcgagaaccgcgatcgtatccgtcaggccgtgcggggcatcaaagccatgttccgcgctgatggattgctccctaccaccgccagaccgctcaccgaagacgcggaataaacaaaaacaggagccagcggctcctgtttttcgtatgaacgttgctcagatcatcagggcgaaagtaccggcccatacaatgaccattaccgaaatgcccataaagaaatatttcacttttcatcgctccgcacacacatcgtatgcattcatgaacaagacaggactgattatagagagatgacgccaggccagaatcaaaatgagaattatctcgtttagggtggcggcagcacctcagaattcaggtgtgaatcacaccagacggcgctaatgtacgcttaataaatccgggaaacaagtggcattttcttaaatactttccgtcacttagcttgtgtcggggaacggcgacactttaatttcctggggtaataaattgagcttgagcgacgctttttaccttaatgaaaactccctttttcctgcttgatttataaggttaaattgtgagctacgtctcggttttaacgactttacgatagtgtgctgcaaggcataagtgacaaaaaagtgacaccaccttttgtgctatcgcccacaaaacaaaaatccttcctgatgcattccccggtgtcgccacctttcacggcatgataacaactggttttcagcgcagtaaaaggaacgtccgatgcgtaaagacgatttactcacctttttaatcaaccagactgatttctttgatccgcacgacgtcagcgagattttcactgcccgtcatctggcgcagcgtttcgggttacagcgtaataccgccagccactacctcaatcaactggtgacacagggcgtcctgataaaaattaatacccgcccggtgtactttctgcataaggccagcttcgagcagcaattttttccgctttcccgtacagagtttgccagccttgacgaattgctggcggaaaacgacggcgagcgcgtgcaacaggatcacttctccttgctgatcggtcacgaaggttcgctaaaaaagccgatagaacaattaaagaccgcgttgttttatccggatggcggcctgccactgctgatcaccggcgacagcggcaccggcaaaagttatctggcgaacctgatgcatgattacgccattacaaaggggctaatcgatgccgacgccccctttgtcaccctgaactgcgctcagtatgccaataatccggagctgctcgccgccaatttgtttggttatgttaaaggcgcttttaccggcgcgaccagtgataaacccggggcttttgaagccgcggatggcgggattttgtttctggatgaagtacaccggctgcatgcggaagggcaggagaaactctttacctggctcgatcgcggggtaatttatcggctgggagaaaccgccagcgggcgtcgtgttgccgtgcggctgatcttcgccaccaccgaagacattcacagtaccttcctcaccacttttatccggcgtatccccattcaggtggtgctgccggatctggaaagccgtagtcgaaaagagaaggaagcgctgatcctgcaattcttctggcgtgagagcaaaaaggtggggctggcgttgcgtatcagcccacgcctgctgtccgtgctgacgcattatgtctttcgcggcaacgttggcgagctgaaaaacgtcgtcaaatacgtggtggcctcggcttttgcccggcagggcggcgggcagccgctgcatgtgacaatccatgatttaccggagccggtgatggcccagttgcccgcgctcagcgacgcgacaagcggacagggcgaagaaatatgtctggatgagcataccagtctgccatggctgctccagacgcaaaatgccgggcgggtgctcatccacgatgcgcagctcagcgtgctgacgctgtttgaaaaataccgtacggcaccgcattcatgggatgacatcgagcagcgcatcggtcatgaaatcgaaaatctgttcgatcggctgatcttcgataaccaggacaaaaccagttcacagatgctgatgctggtgaccagtcaggtaagggaggaattttaccggctggaaaaaagttacaacatccagtacaacggcaacggcatctacgccatcgggcattatctggttcatcggtcgaccagtgaaccgtcgcggctgaacgtcgaaatgtgtaaacagctcgatcgttttttagagcagaaatacccgttgctgtacctgttttgcgaagaagtactggcgtcgctggcccgcagactggatctgcgtattcaggccatggatcgtattttgttactgctctggctgaacaaaaccggcgtgcagagcagtcacctggtcaccaaagcggttattctcgcccacggttacgccaccgccagcagcattacgaatgtggccaaccggctactgaaacaaaccgtctatgaatcctttgacatgccgcttgacgtcacgccggaggccatcgcccagcaggtgacgcagtacgtggagcgtaacgcgctggcgagtagtctggtgatcctggtggatatgggatcgctcaatgacatccaccactatttcagccgacaggtgacgatgccggtggtgatcatcaataacgtctccacgcgtatggcgctgtacgtgggcgagcgcattttacagggcgactatctggaaaccatcgccgcagatattgccgccgatgtaccggtagagcataaaatcatctggccggaactgaacaagccaaaggcgatcgttaccacctgcgcaacggggattggcgccgccagcaatttatgcagcctgctgaaagcgagtattccgcacgagctgggcatagaagtggtggcgtatgagtacgacaccctggcagaaaacaaactgcgcgagcccatcttttcacgttttgatgtgctggcgctggtcggcaccctcgatcccggaattcccgatgtgccctggatttcgctggatacgttgatctccggtcagggtaaggaaacactgatgacgctgttcggcgcgcttatcagccccgcggatgtcatacagattaacgaacgcatcgtgaaaaacttctctctgcgccgggtgatcgaatcggtgaccattcttgataccagcaaggtgataaatcaggtcgagcaatttctgacgcgctatcagcatctgacggcgatggccgtggcgaacgaccgtaaagtcgcgctttatattcatgtgagttgcctgattgaacgtctgatccgtcaggcggcgatccacaactacgccgggcaccgcgcgcagtgtcaacgccagcaccttccggcgttgcgcgaagcctttagtgtcattgagtcgagctatagtgtccaaatccctgaagcggagcttttttatattcacgatcttttgcatctgcaaacggaatttcttcagtacgatcaagagttttgacgttttcctgctcctgacattttcacctgatcgccgtgccactatttctggcacggcggttgcaatatctgtattaacaggtggaatttattttcgaggtcaggatgaaacgacactatatttttgccagccatggcacttttgctcacggtattctcaattcggtggagctgatcctcggcaggcaaaataatatccatacgctctgcgcttatattaacgaaggggatgacctgaccgaacaggttgagcaacttattagtgcttttcccgccgaagatgaactggtggtgatcaccgatattttcgccggtagtgttaacaacgaatttatccgctttattaaacgtcccggttttcatcttattgccgggcttaacctgccgctgattatcgaaatgctcatcgcccctcaggacgaggcgctgccatcccttattaccgattccctgactaacgcccggcaaagtattcagtactgcaaccagactcttgatgctgcgctggtggcggataaagatttctaagcgaggatctaaaaatgataacactcctgcgggttgaccaccgtttactccacggccaggtggcgttttcctggacgcaatatattggcgcggactgcattctgatcgccaacgatgcggttatgcatgacgaactgcgcaagaccaccatcaagctggctaaaccgccagccgttaagctggttatgaaaaatattaatgatgcgattgccgctattaaaagcggcgttaccgataaatataaattatttatcgtcgtggagtccgtcgaagatgcctggcgtctggcctgcgcagtaccggaaattaaaagtatcaatcttggcggtattaaagccaaagaagggagccagaatatttcaaaagcaataaacgtcctgccagaggaggtgacaatgctcaatgaactggttaaagcgggtacggaagtggaaatccggcaggtgcctaatgacagaaaactgttattcactgactgtctttgaatgacgagggacgcactatgttagaagcattattactgggactggtggcttttattgcccagtcggaatatgccttaggcacttccttaatttcccgcccgattgtcaccggtttactgacaggactggttttaggtgatgtgcaaaccggcgtcataatgggcgcaacgctggagctggcgtttatcggttcgttctcggtaggggcatccattccaccggatgtggtcacaggcgggatccttggcgtggcctttgccatcacctccggcgccggcaccgaaaccgcgttgctgctcggtttgcctatcgccacgctgacgctggtgttgaaaaatatctatctcgggctgtttattcccacccttaaccagaaggcggacgcttacgccgatcgggctgatacacgcggcattgagcggatgcatctgatcgccgggtttggtctttcgctgatgctggccaccgtggtgaccgtctcctttatggttggcagcggcgcggtgaaaagcctgctggatgccattccggagttcatcaaacacgggctgagcgttgccaccggcattattccggcgctgggcttcgccatgctggcccgcctgctgatcaacaaaaaggtcgccccgtatttcttcctcggatttgtactgatggcctatctgaagatcccggtgaccggcattgccattctcggggccattacggccgtggtgatggtaaacgtgatgcaatttaattccccccgtccgacggcggcgcaaggagtccagaatgacgatgaagacgatttctgaggaaactcaggtggccgacgacgccacaaacaccattacccgcaaagagttgcgcagcgtgttctggcgctcgttccagatggagttctcctggaactatgagcggcaaatgaacctggcctttgtctatgccatgatcccggtgctgaaaaagctctacccccgcaaagaggatctggccggcgcgctcaaacggcatctggtgttctttaacaccacgccgcatatcgtcacgctgatcctcggcattaccgccgcgatggaggagaaaaacagcagttcaaagggcatggacgcggcgtccgtcgacagcgtaaaagcctcgctaatggggccgctcgccgggctcggggattcattcttctggggaacgttgcgccttatcgctaccggtatcggcaccagcctggcgctgaagggcagcattctcgggccaatcctttttctgctggtatttaacgttccccatctggcggcgcgttacctgtttacccgctggggctatgtgctgggtaccggcgtgctgcaacgcatccagaagagcggcatgatggaaagcctcacctacggcgcttccatcatcggtctgatggtggtgggcgcgatgactgcctcaatgatcaatatcactatcccggtgaccttcggcacgggcgaggcgaaaacccatgtgcaggacatcatcaacgacattatgcccgcgctgttgccgctggtgagcttcgggatcgtttactggctgctgggccgcaaggttaaaccgctcgccattctgggcggcatggccgtggtcggtatagcgggatcgtggattgggttattctgaggagaaaatgatgtcaaccatgctggattatatagaccaggagtcagatgcgctcacgcgcataatacaggaatatcctgagaagctcgcgccattagtgacctggctggcttcacggccagtgaataagatcatgatcctcgcaacaggatcatcatggaatgctgcgctgtgcgcccgctattatttcgaaacccatttcggcattctggtagatattaaagagccatataatttcacccattatgaacgaattgatccggcaacggatttagttattgcggtgtcccagagcgggaaaagcgcctcgacgctggatgccatgaaaaaagtgcaggcggaagatattccggtattttgcctgacgtcgggtccgcaaagtccggctgcggtgcaggcggacggcatactcgatattaataccggcattgaaagcgtcggctttgtgacgcgcggctttagcgccactgtgcttaatcttttgcttatcgcgctgctggtggctgaacaacggaggcaaatcgaagaggatgaacgcgcggcaaccctggcgagtctcaaagacgcggcgcaggcgatcccggacgtcattgaaaaaaccaacgctttctttgcccgccaccggtcatactttattcaggcgtcgcgctttgtggcgacgggctacggcgcgctgactggcgtggcgaaagaatttgaaaccaagttcacggaaaccgtgcgcctgccgtccagtggttttgaactggaagcctatatgcacggcccgtatctggaggccagcgccagtcatacgctgttttttattgaggacagtgtccatacgcgtacccgcgccctacgggattatatgcagcccgccgtggatgccgtatttaccgtcacgctgacggaagaaaataatgatccccatacgctggcgctgaattatcccttaaaccatcatttcgcgccgttgttattaattgtgccatttcagcttctcgcctttcatatttccacggcgaaaggcatcgatttaagcgtgcgtatttttgacgatttcgacaaggtgcttaaaagcaaaatttaattacttatcaggagaatagctatgttaggttttaatcaggacgagtacctgaccagtgctcgtgacatcattgctgcgcgcaaaattgccgagcagattgcagaaaatatccatcaggcaggatttattaatatatttttcgcctcggtagggggctcgctggcacccatgatggcaatgcaggaatttgccaaagaggtgaccgcattgccggtttataccgaacaggcggcggaattactctgtaagggaaataaaaagctaaccaaagaatctatcgttattacgctgtccaaatcgggcgataccaaagaatcggtcgctattgcgcagtggtgtaaagcgcagggcatccgcgtggtggctatcaccaaaaacgccgattcaccgcttgccgccgcggccacctggcatattccgatgcagcataaaaacggcgtggaatatgaatacatgctgctgtactggctgttcttccggctggtggcgcttaacggcgaatttgatggctatgaccgtttcgccagccagctggagttgttgccggaaaatctgctgcaggccaaacgccagtttaacgaccgcgccgatgagattgcgagccgttaccataccgcagattacatgatgtggatcggcggtgcggagatgtggggcgaagtttacctgttctcaatgtgtattcttgaagagatgcagtggaaacgcaccaaatccgtcagctctgcggagtttttccacggcacgctggagctgctggaaaaagacgtcccgctgtttctggtaaaaggggaagggaagtgtcgaccgcttgacgatcgtattgaggcttttgcccgtaaaattaccgacaacctggtggtcatcgatccgcaggactatacccttaccggtatcgacgatgagttccgctggatcatggcaccctgcgtcgcctccactctgctggtagaccgtctggccgcccacttcgagcactacaccggacacagtctggatattcgccgctattaccggcagtttgaatattgataaaagtgaaaaaggtataatcgctgagagaatggattatggggatatttcagacgagagttctggtgtcccctgcaggaatcgaacctgcaactagcccttaggaggggctcgttatatccatttaactaaggggacaaggcggcacgagtataacgtcatttccgcactgcgttaagcgcgtgaccgcctgaatgctcaaagtgtcgccacttaagcgttattctgctttgctttcaccttctttttcgcctcgtcggcctgcgctttggcttcagccttacgtttgttgctcatgtcgttacggatctgcgcatggcttaacagggcgaaaataaaggtaccgccgcagatattccctgcgagagtcgggagcgcaaacggccagaggaattcactccagtgtagcgaaccggtaaacaccaggtaaaagatttccaccgcgcccaccacgatatgcgtggtatcgcccagcgcaatcagccaggtcatcagaatgatcaccacgattttcgccgagccggcagaagggaacatccataccatagtggcgatcaaccagccggaaataatggcattggcaaacatctccagcggggtatttttcattacgtccatgccgattttgacaaaggcatcgcgcgtcgggtcgtcaaataccggcatataaccaaacgcccaggcgacgatggcggtgccgatcaggttacccagcaataccacgccccacagtcgcatcagaagaccgccattgccccaggtcggattgtgcataaacggcagtacggcggtgacggtgttctcggtgaacagctgctgacgagccatgatgacaataataaagccgaaggtataaccgagattctccagcacaaagccgccgggaataccttcaaactggacgtggaaaatgccttttgccagaaacgatgcgcccattgacaggcccgccgcaatggctgaccagagcagggccatggcatcacgctccagctctttttccccgtcctgacgaatatgttcgtgtatcgccattgcccgtgaaggcagatgctcctcatccacctcgatttcttcaccgcgatctttttcctcactctcgacttcaatgtcgtcggtgtgcttatctaatttttcgtttttcagttcatccatttttgcttcatctttccggggatcatgataataagcgtagcggctttatgtgctaaagcagcgggcttcttcctaaattgtgcaaagggcaaaaaaggtgataacaggatcgcagagaacgtataaaattgaaggcgaaacgagaagagaaagacaagctatgctcaatgcgtgacagctcgtgctgccgctgacgtgcacatcgttaaacgtgctgatacaatcgcttgcgtattccaggcggaaacctgagcgctgcgcgtttatccgtcacggatgatattttgcgatgaccatttattacagggagacatccatgaaatttcgcctgtcggcgctcgcgctgggaactacattactggtcggctgcgccagctctggtgagcagcaacaggggcgctcggatccgttcgaaggatttaaccgcaccatgtataactttaacttcaacgtgctggatccctatgtgctgcggccaattgccgtgggctggcgtgattatgtaccgcagcccgcgcgtaacggcttaagcaatttcaccagtaacctggaagagcccgccattatggtgaactatttcctccagggcgatccctataaaggcatggtgcactttacccgcttcttcctgaataccttactgggtatggggggctttattgacgtcgcgggattatccaacgaaaaactgcaacgtgtggagccgcaccgtttcggcagcaccctcggtcattatggcgtgggttacggtccgtacgttcagttgccgttttatggcagctttaccctgcgtgaagacggcggcgatatggcggatacgctgtatccggtgctctcctggctgacctggccgctctcagtaggtaaatggacggtagaaggtatcgagtcccgcgcgcagttgctggattccgacggcctgctgcgtcagtcgtccgatccttatattctggtacgcgaagcctatttccagcgccacgactttatcgctaacggcggtcagttaaaacctgacgaaaacccgaatgcgcaggctattcaggacgatttaaaagatattgattctgaataaccgcaaagcaggcaataaaaaaaggtgaaccgaagttcacctttttttatatgacggattgatcagaatgcgtagttaaagttagtgccgaacagccaggctttaccttctgaatggaaggtatacgggccttcattaacggtaactttctgaccgtgcatataagacgcacccacatcaaccgacgcattatcattaaaggcgtaagtcgtaccggcgctcagccacagacggtcctgatccggaatggaaatagaacgtttgccagccggaaccgggctatcgtcataggcgataccggtacggaaggtccagttatcatccatgtaataggtggtacccagcgccaggcggtaggaatctttaaagccttcgtctttatagaacagcgtgcggtcgccatcgccggtggctttcagctcctggaactgactccagctggtgtaggcgatgctgtagtgtacagcccattgtggcgcgacgcggttataaccggacagctcccacatttccggcagatgcaaactcagcgagcctggaatagtctggccgccagtaccggcagggaaagccgtgcccgcgccaggtaagcggttagcgagtgggctgatgccgcttttataatcaccgtcaaagtcaacttttacttctgagcggtaagtaaaaccgtaacggttgtctttatccagctcataaaggataccggcgttccagccaaagccccactcatcgccttcaaggcttgcgattttagaactgtttttcggcaatgccgcggtctgctcgccagaatagcgctcaattttcgcgtcagcgtaaacggcgtcaaagccaagaccaaaactccagttgtcatttaagcgataagcgccgctgaggttgaggttaagggtggttaaatcggttttaccgccgtattcgcccgcgatgtagttatcattaaactctgtcgccagaccataattcgaggttactgatgcgccccagccaaattgttcattaattggcgcaacaaagtgcaggttaggcacccaggcagtcggcgcaatattatcggctcgggtgctgcgaccggtataaggcgaacggccagaaatattcacgtccggatcaatatacaccgcgccgccggaaaaggccgggcggtcgaataaagtaattaatgccgggttacggctgacgttgcctgcgtcatccgcaatagcgccttcacctgaataagcgcggccaaggccagaggaagagaattcgtttaactggaagcccgcagaccaggcttgtgtagagacaattgccactgcaactgcgagtgcagatttggtaaaccgggttttctggctcatgaccataacctcatacatttatttttatgcattaattgttacgtaccgtaacaggagcgcgaagtgtagggtctgaggtacgacttacaaatcagaccagtggcggaagtataggtccgaccagagggaatgttgcaaggatgtttataagatttttcaaatgtgatcttcgaaacgcgatctgcgtggcaaatttgtgcaccgttacggttatcagcaacggcgaattttgttttagatcattttaagctgtgataacggtcactatccggcaattgtgagattaacgactggagccacttttacggggcgcgtaaaataaccacatcgtttatggcaccccgagtgcaaatacagaggaaatctacaatgagtaaatgcagtgctgatgaaaccccggtttgctgctgtatggatgtgggcaccattatggataataccgactgcaccgcctcttacagccgcgtatttaccacacgtgccgacgcagaagcgacgcttgccgcattaacggaaaaggcgcgcagcgtggagtcagacccctgccagatcacctccacctttaccgacgttgaagagggtgtgcgtctggatattgattttgttttcgcctgcgaagcggaaaccctgatcttccagctcggcctgcgttaaattccccttatcacgctcctgatcctcaggagcgttttctccatcatctctgtgtattagctcgcaaaaatcccctcagccagttggctaaatgtaaaaaaaaggttaagactaatatcaggtcagaccactttgcatgatgttatttacaggggagtgttatgagtcaggcattaccgcttgtcacccgtcagggcgatcgcattgccattgtcaccggattgcgtaccccttttgcccgccaggccaccgcctttcacggcatcccggccattagcctcgggaaaatggtggtgggcgaaatgctcgcccgcagcgaaattccgcctgacgtcatcgaacaactggtgtttggtcaggtggtgcagatgcccgaagcgccaaacattgcccgcgaaattgtgcttggcaccggcatgaacattcataccgatgcgtacagcgtcagccgtgcctgcgccaccagctttcaggcggtggcgaacgttgccgaaagcctgatggcgggtaccattcgcgccggtatcgcgggcggggcggattccacctccgtactgcccatcggcgtcagcaaaaccctggcgcgtacgctgctcgacctcagcaaagcccgcaccgcagggcagaaactaaaactcttttcccgtctgcgcccgcgggatttactccccgtgccgcccgccgtggcggaatactccaccggtttacgcatgggcgataccgccgagcaaatggcaaaaacctggggcatcagccgcgaacaacaggatgcgctggcgcatcgctcccaccagctggcggcgcaggcctgggcggacggtaaactggcggacgaggtgatgaccgcctacgtgccgccgtaccgtgatcctgtggtgcaggataataatattcgccacaactccacgcttgctgattacagcaaactgcgcccggcgtttgaccgtaaacacggcagcgtcacggcggccaacagtacgccgctgaccgatggcgcggcggcggtgatcctgatgaccgaatcccgcgccagggaactggggctgacgccgctcggattcctgcgcagctacgcctttaccgccgtcggtgtgcagcaggacatgctgctgggtccggcctggtcgacgccgctggcgctggagcgcgcaggcatcacccttaacgatctaacgctgtttgatatgcatgaagcctttgccgcccagacgctggcaaacctcaagctgatggccagcgaccagttcagccgcgaggtgctgggtcgcagtcaggccaccggcgaagtggacgacagcaaatttaacgtgctgggcggctctatcgcctatggtcatccgtttgccgccaccggcgcgcgcatgatcacccagacgctgcatgaattacgccgccggggcgggggatttggcctggtgacggcctgcgccgcaggcggacttggcgcggcaatggtcctggaggccgaataatggatatgacaactgcattctccctgattgtgcgcccggatcagatcgccgtggtgaccattgatgtgcccggcgaaaaaatgaataccctgaaggcggaattcggcgttcaggtgcgggcaattttgaaacaaatccgcgagaacaaagatctgcgtggcgtggtgttcatttcggcgaaaacagacaattttgtcgccggggccgacatccacatgatcgaccgctgcaaaaccgctaaagacgcggaagagctggcccgtcaggggcaacaggtgatggcggaaatccatgcgctcaccatcccggtgattgcggcgatccatggcgcctgtcttggcggcggtcttgagctggcactggcctgccacgggcgcgtctgtactgacgatcccaaaacccagcttgggctgccggaagtgcagctcggcctgttacccggctccggcggcacccagcgcctgccgcgcttaattggcgtcagcacggcgctggagatgatcctcaccggcaaaatgctccgtccgcgccaggcccgtaaagtggggctggtggatgatgtggtgccggtatccattttgctggacgcggccgtggaactggcgaaaaaaggcaaaccgaccgggcgtcgtttgcccgtgcgcgaacgcattatggctggcccgctcgggcgcaccctgctgtttcgtatggtggagaaaaagacgcagcagaaaacccacggcaactatccggccgcgccgcgcattctggacgtggtgcagacggggctggctcaggggcgcagcagcggttatgaggcagaagcccgcgccttcggcgagctggcgatgaccccgcagtcccgtgcgctgcggcatatcttttttaccagtaccgacatcaaaaaagatccgggcagcgccgtcgaacccgcgccgttacgtgcggtgggcattctgggcggtggtctgatgggcggcggcattgcttacgttaccgccagcaaaggcaaactggcggtgcgcatcaaagatattaaacctgccggtatcaatcatgcgctgcaatacagctggcagcagcttgataaaaaagtccgtcgccgccatatccgtcctcaggagcgtgacaacgacatggcgctgatctccggcaccaccgattaccgtggttttgccgggcgcgatatcgtgatcgaagcggtattcgaagatctggcgctaaagcagcaaatggtggcggaagtggagcagcactgctcgccgcagaccatttttgcttctaacacctcgtcgttgccgattggcgatattgctgcgaaagccgcgcggccggaaaatatcatcggcctgcatttcttcagcccggtggagaaaatgccgctggtagaggtgattgcgcatgcgcaaacctcagagcgaaccatcgctactacggtgatgctggcgaaaaagcagggtaaaacgccgatcgttgtggcggataaagcgggcttttacgtcaaccgcattcttgcgccctacatcaacgaagcgatgcgtatgctgacggaaggcgagcaggtcgagcatatcgatcgtgcgctggtaaaatttggcttcccggtcggcccaatccaacttttggatgaggtgggaatcgataccggcactaaaattatccctgtgctggagagtgcttatggagagcgtttttccgcgcctgcaaaggtcgtttctgcaattttgaacgacgatcgcaaaggcagaaaaaatggccgcggattctatctttacggtgcgaaagggcgtacaagcaagaagcaagtggacccggcgatttacccactgattggcgcatccgggaatgcgaaactttcggcggatcaaatcgcggaacgctgtgtgatgatgatgctcaacgaagcggcgcgctgccttgatgagtcggtgatccgcagcgcccgtgatggcgatattggcgcggtatttggcatcgggttcccgccatttttgggcggaccgttccgctatatggatacgcgcggcgcggggaatatcgtggcgacgctggagcgtctggcggcgcagtacggcccacgatttacgccttgtgaatacttgttacaaatggcggcgcagcgcgaaacgttctggcctgcgaataacactgatcctgtaagttaaggtcagtaaagggtaaatctgtcgttgaatgtgtcggcgctgttcattttataaacagtgattgactatacttacgccattgatgtaaaacacagcgtttcattcaacgaatggataaggcacaatgcccggccattgtctgtttcggtgtaaacatgttgtttcattcgggcggttcaatgcttctggttaacaaaagcggtgcaatatgcaagtttttatcatgcgtcacggcgacgctgctctggatgcagccagtgactcggttcgccctttgacttcttgtggctgtgatgagtcccgtcaaatggcaacctggctgttaagccaaaaagtgaacatcgagcgtgtactggtcagtccgtttctgcgtgccgaacagacgctgagcgaggtaggggagtgcatgaacctgccggacgatgtggagatcgacgtcctgcccgagctgacgcccggtggcgatgtgcgtatggtcagcgcgtatttgcagacgctggctaacgaaggtgtatcttcggtgctggtgatttcgcacctgccgctggtgggttacctggtgtcagaactgtgcccgaccctgacgccgccaatgttttctacctcagcgattgccagcgttacgctggataacgcagggaaaggggtgtttaactggcaaatgagtccctgcaatctgaaaatggcgaaagcgatttaatcccgcctgaccctgtaaaaagagccgctgatgcggctcttgttgtttctggcggctggggttttgtcgggtggcgcttcgcttacccgacctacaactggtggctggttttgtcgggtgacgctgtgcttacccgaccgacgggttacgaattcgtaggcccggcaagcctgcgccgccgggcatcccggcaccgggcacgtgctcaggggagttctggcggctgccactcttccacttcgatcagcaccagcagggccgcatcgccgccgtactctttcggtgcctgatggaaggccatcacgtgcggatgctgcgccagccataatggtgtttgctgcttgagaatatgcttcccgtggccatgcatcacacaggcgcaaaacacatgttcgcggcggcaggcggcaatcagcgcgcccagctcctgcttcgcctgcatctgcgtcaaaccatgcaaatccagaaacagctccggggagtaatcaccgcggcggatcttttttaattcgaaatgactgacgtccgggcgcacatactttgccgggccgtcggtattaagcagcggctgaaactcatcagaaaaatagtggctggcatccgcctgctccgataacaggcgcttcaccggcacctccgtcacttttttacgcagcgggcggtgaacaatggtgtcctgctggattttgcgcgtgcctgtcatgagctgccggaacagcgcctgatcctcctcgctgagcgatgctttctttttcatttttctgtctcatcttttatttccgccagtttacccgactcgatgcggcctgtgtgcaggcaaaacgcatttttccccgccgggcaggtgcgagaatgctgatttatcggcgtcttcatggcaaactagccgccgaatttacagcaatgcatgtcctggaggatagtgtggataaaatttttgtcgatgaagcagtcagtgagctgcataccattcaggacatgttacgttggtcggtcagccgattcagcgcggccaatatctggtatgggcacggtaccgataacccctgggacgaagccgtccagctggtgttaccgacgctctacctgccgctggatattccggaagagatgcgtaacgcgcgcctgacctccagcgaacgccaccgcatcgttgagcgcgtgatccgtcgcgtcaacgagcgtatcccggttgcctatctcaccaataaagcctggttctgcggccacgaattttttgtcgatgaacgcgtactggtgccgcgctcgccgattggcgaactgatcaccagccgttttgcgggcctgatcaaccagcaaccacagcatattctcgatatgtgcaccggcagcggctgtatcgccattgcctgcgcttatgaattcccggaagcggaagtggacgcggtggacatctccccggacgcgctggcggtggcggagcacaacatcgaagagcacggcctgatccacaacgtcacgccgatccgctccgatctgttccgcgacctgccaaaggtacagtacgacctcatcgttaccaatccgccgtatgtcgatgaagaagacatgtcggatctgccgaacgaataccgtcacgagccggaactgggtctggcctccggcagcgacggcctgaagctgacgcgccgcattctggcctgtgcgccggactacctgaccgatgacggcatcctgatttgtgaagtgggtaacagcatggtacatctgatggagcagtatccggatgtgcccttcacctggctggagttcgacaacggcggcgacggcgtcttcatgctgaccaaagcgcagctggtggccgcgcgggaacacttcagcatttataaagactaaaccgcacaactaagccgcacaacaacacaacaaaataacggagccgtgatggcaggaaacagtattggacaactctttcgcgtaaccacgtttggcgagtcacacggtctggcgttaggttgcattgttgacggcgtgccgccgggcattccgttgaccgaagccgatttacaacaggatctggatcgccgccgtccgggcacctctcgctacaccacgcagcgtcgcgagccggaccaggtgaaaattctttccggcgtctttgaaggtgtcaccaccggcaccagtatcggtctgctgatcgaaaacaccgatcagcgctcgcaggattacggcgccattaaagacaccttccgtccgggccatgccgattacacctacgaacaaaaatacggcctgcgcgactatcgcggcggcggacgttcctccgcgcgggaaaccgccatgcgcgtggcggcaggggccattgccaagaaatacctggcgcaaaaattcggtatcgtcattcggggctgtctgacccagatgggcgacattccgcttgagatcaaagactggtcgcaggtggaacaaaacccgttcttctgccccgatcccgataaaattgaagcgctggacgaactgatgcgcggcctgaaaaaagagggcgattccattggcgcgaagatcaccgtagtggccgatggcgtcccggcgggcctgggcgaaccggtgtttgatcgtctggatgccgacatcgctcacgcactgatgagcatcaacgccgttaaaggcgtggagatcggcgaaggattcggttctgttgcgctgcgcggcagccagaatcgtgatgaaatcacacaagaaggttttcagagcaaccacgccggcggcattctcggcggcatcagcagcgggcaacagatcgtcgcccatatcgcgcttaaacctacctccagcattacggtgccggggcgcacgattaaccgcgccggtgaagagatcgaaatgatcaccaaaggccgtcacgatccctgcgtgggtattcgtggcgtgcccattgccgaagcgatgctcgccatcgtgctgatggatcacttcatgcgccagcgggcgcagaacggggacgtcacaaccacattgccacgctggtaactatgaaaaaacgtgtcattgcgctggcggcgctgctcgtcagccagttcagccttgccgccacgccctggcaaaaaattacccatccggtggcgggcagcccgcagtccatcggggccttttccaatggctgcatcgtgggggccagcgagctgcctttacagtcggatacctatcaggtgatgcgcaccgatcagcggcgctattttggtcacccggatctggtgctgtttattcagcgtctggggaaccaggtgcataacctggggctgggaaccatgctgatcggcgacatgggcatgcccgccgggggccgtttcaacggcggtcacgccagccatcagaccgggctggacgtcgatattttcctgcagttgccacaaacccgctggacggcggcgcagctgcgtaaaccccaggcgctggatctggtgtcatccgatggtaagcgtgtggtgccttcgctgtggcagccgcagattagccagctgatcaagctggcggcggaagataatgacgtgacgcgtattttcgtcaatccggccattaaacagcagttatgtctggatgccggaacggatcgcgactggctgcaaaaagttcgtccgtggttccagcaccgcgcccatatgcatgtgcgcctgcgctgcccggcggacagtctcgaatgtgaagatcaaccgctgccgccgccaggcgatggatgcggcgcggaattacaaagctggtttgaacccgcaaaacccccgataacgaagcctgagaagaagacaccgccgccgttgccgccttcctgccaggcgctactggatgagcatgcactttaatggacaactttatcgatctctttatggtgtcgccgttactgctggcggtactgttttttgtggccttactggcaggatttatcgatgcgctggcaggcgggggcggtttactgactgtaccggcgctgctggcggcgggcatgacgcctgcccaggcgctggccactaataaattacaggcctgcggcggttcgctgtctgcttcgatctattttgtgcgcctgaaagtcgtcaatctggcggatcagaaactgaatattctgatgacctttatcggctccacgtcaggcgcgctgctggtgcagtatgtgaagtctgacgtgctgcggcagatcttgcccatcctggtcatctgcatcggcctttactttctgctgatgccgaagcttggcgaagaggatcgtcaacggcggctgtatggcctgccgtttgcactggtcgccggtggctgcgtgggtttttacgacggctttttcggacccggcgcaggatcgttttacgcgctggccttcgtcacgctgtgcggtttcaatctggcaaaatccaccgcccatgccaaagtgttgaacgccacctccaatctcggcggcctgttactctttattattggcggcaaagtggtatgggccactggcttcgtgatgcttgccggacagtttcttggcgcgcgtatgggatcacggctggtgctgagcaaaggacaaaaactcattcgcccgatgattgtgattgtctcagcggtaatgagtataaaactgctttttgacagccatggacaggagatccttcactggctggggatgaactgatgaacacgacgcacacttacgagcaattaatagaaatttttgatggctgctttgccggtgattttaatacccgtctgattaaaggcgacgacgaaccgatctatcttcctgctgatgccgacgtgccctataaccgcatcgtctttgcgcacggcttttatgccagcggcttacatgagatttcccactggtgcatcgccgggaaagcgcgtcgcgagcaggtggattttggctactggtattgcccggacgggcgcgatgccacgacgcaggggcagtttgaagacgtagaagtgaagccgcaggcgctggaatggttattctgcgtggcggcgggcttcccgttcaatatcagctgtgacaatctggacggcgatttcgaacccgatcgcatcgcttttcagcgccgggtacatgcccagctgatgacgtatctggaagaggggatccctccgcgtccggcgcgctttatccaggcattacaggattattatcatacgccgccgctaacggcagcacagtttccgtggccggaagatcttaactgaagccacgatttaaagaggaaagaagatgatcgcggagtttgaagcacgcattctggcgttaattgatgacatggtagatacggccggagacgatgagctgtttgccagcggttatctgcgtggccacctgacgctggccgtcgctgaactggagcatggcgatgaccactccccggaagcggttcacgctaacgtcagcgccagcctgtcaaaagcgattcaggccggtgagctttccccgcgcgatcaggcgctggtgctgggcatgtgggacacgctgtttacccaggcgaaaggttaacgggttgcccctctcacgggtgagaggggattaacctatgccaggcgcggatagccatcggcaatcgcatcgccggtaaactgcgccacccagccttcgggattatcaaaaatacgaatagcggtaaaattcggctcggaacccatatcaaaccagtgcggcgtgccggcaggcactgaaatcagatcgtttttctcgcacagtacctgatacacctcattgccgatatgcaggcagaacagccccgcaccctccacaaaaaagcgcacttcatcttcgccgtgcgtatgctcattcaggaattttgcgcgtaacgcgtctttctgcgggttatccgcgcgcaggctgatcacatcccagctctgatagcctttttcggcaaccagcctgtcgatagcagactgataggcatggatcaccgtgtcggctgacgggttttcccctaaatcgcggtccgcctgccagcgctcaaagcgcacgcctttggcgttaagctgctgctggatctctgtggcatcggtgctgtgccaggtgtgctggctggcgtcggtatctgaaaaaatcgtcagggcgctcatgaggggatctgctccggattgatgacatcaaaacgatgaacctggtgatgatggctggcggcatcgtcatcaccgcgaataagctgcacggtacgcagcccggcttcggccgccgcatccagctcctgatgaatatccgacaggaacaaaatctgcgacggggccaggcccagctgttcagcgatgctggtataggaactcacctcgcgtttcgcgccaatgtgcgtatcaaaatagccgctgaacagatgagtaatatcaccttcgtcgctgtagccaaataacagtttctgcgccgcgacggagccggaggaataaacatagagatcaataccctgcgccttccatttttccagcgacggcagcacgtccgggtagagatggccggtaaagtcgccgtgcacatagccttcgcgccagataatgccctgtaaggctttcagcgccgtggatttgcgatcttcatccataaagcggaataacgtgtcgataagctgcgcggtggtggcgtccggctggccgatttcgtcgcgcagattatcgagaatcgaggagaccggttcgccatactgctgcgccgtaatgaaggcggcgagccgctcacgggcataggggaacaggacatcatgcacaaagcgaatatcgctggtggtgccttcaatatcggtaactatcgcgcggatcattctctctccagcaggcggcgctgcatttcacattcgaataagaactcaagaccttccagatgacggcgggcttccgccacactgcgtccccagcaggttaaaccatggccgcgcaggaggaaaccatattgcagcggatgatcctgtgcgaaggcttcaattcggcgggcgagggcgtcaatatcctggtcgttatcgaaaatagccacgggaacgtagtccagatgagtgtgctgcccgctgagggatttttgcatttcgtagccatgcagcatcagttgcgtgcttttctccacccgcgacagcacggtggcattgaccgtgtgcacatgcagtaccgcattagcctcgggaaacaggcggtagatcagcgtatgcaggccggtctccgccgacggcgtacgcccggagggcacgcggtgggtggcaatctccacgcgcagaaaatcgtcgggcgtcaggctgcctttgtccttgccggattcgctgagccagcaccagtccgtgtcttcgcgcaccgacatattgccgccagtggcgggagcccagcctttcgcgcctatccagtgacaggcgtcgacaagggcggagagttgcagattgtctgtcattcagtgtcttcctttatagccgtgaggcaggaatatcattatggtttagacgtctaagcgtcttgattgccaaatactaacatcgtgttatagtggcagcaacacaagtatcacaggcaggcaaccacgcatgagcaataacccgctgatcccacagagcaaacttcccgccctcggcaccactatctttacgcagatgagcgcgctcgcccagcagcatcaggcgatcaatctgtcgcagggcttcccggattacgatggcccgcactatttgcaggaacggctggcgtatcatgtggcgcagggggcgaatcagtacgcgcccatgaccggcgtgcaggcattgcgggaggcgattgctgataaaaccgcagcgctgtacggttacctgccggatgcaaacagcgacgtgaccgttaccgccggagccaccgaagcgctgtacgccgccattaccgcgctggtgcgccagggtgacgaggtgatttgttttgatcccagctatgacagctacgcgcctgccgttgaactgtccggcggggtgttaaaacgtattgccttacagccgccgcattttcgcgtcgactggcagaatttcgccgcgctgctgagcgagaaaacccggctggtgatcctcaacaccccccataacccgtcggcgacggtgtgggaaaaagaggattttgccgccctctggcaggccattgcagagcaggaaatttatgtgatcagcgatgaagtgtacgagcacatctgctttgcacaggagggacacgccagcgtactggctcatccgcagttacgcgagcgggcggtagcggtctcgtcgtttggcaaaacctatcatatgaccggctggaaagtgggctactgtgtggccccggcggccatcagcgccgagctgcgcaaagtgcatcagtatctgaccttttccgtcaataccccggcgcagctggcgctggcggacatgctgcgcgaagcgcctgagcactaccgcgaactgcccgccttttatcagcaaaagcgcgatctgctggtggaggcgttaagccacagccgtctggagattttgccctgcgaaggcacctatttcctgctggcggactacagcgccatttccgatctggatgacgtcagcttctgccagtggctgacaaaagaagcgggcgtggccgccatcccgctatcggtattttgcgcggatcccttcccgcataagctgatccgcctgtgttttgccaagcagagcgccacgctgctcgccgccgccgaacggctgtgtaagctgtagctactccacggtccaggcgctggaaaatcgacggtcggcaaacaactccagcagaccgttgatttgcttcaggcgcagcacttcgtcgctgtccattcccagctctttaccgatgcgctcatcttcccagcccagctgcgccagttcgcgcacgatctctgacatctcctggatctggtgccgcccgcgggcgcgattatggcggatggtcgccgccatgcgctcggacttgcgggtacgggaagcgcgtaaacaggtgaccggcaggtagcctttaagctgctttttcagcgccggtttgctcttacccagttcatgccggtgaaagccgtccacaatttcatactcgtgggcgccggtacggatggcgacgaccggctgagtaaagccatccatctccagcgatttcagcagcagacgcttttccggcggcgccacattgtttggattgtagctgttcggtttgatggcttcgtgcctgacccacagcacgcagtccaccggctgctcgcgaaacgggctgagctcgtgcagcgcctgacgaaaagcattaatagcgtcaatgcgatccgcttcctccagcgagcttaagtaatcctttaagtcatatatcagtcgttgtcgcataaaattccccactccttacgtttatttttcatacgctcgttgtagcgcttatagttgctggtttttgtcgggctgaatgacagggcgcggcaccagtaatcgttattgagcagcaccttgcagatgcgccgccaggaaggaatatccttcgcgccgatgtcgccttcctgaacgtccggaatatcttccatgccttgtctctcataccagcggagataaacggcgattttgttgcggtaatgttcggcggtagagacgggcatactgtcgagaagaaagagagcgtaggagcgccagctgtggccttcgggtttgtacagcttgcggtggccgtaaaactgattatcctgcccggcatacagaccgccgcttcgcgcgccgctgacccgttcacacatgcgtgcccaggtgtgcggctcgagtacgtgatacagccacaggccctgccgttgttccgggccgaaaggttcgcagatgcgcatatagcgtaaggggacgcccgccttgtgcatcagatcgtacagcacgttataggtggcttttgattttgcaaaccaggtccagacgtcggcgattttccagtcatagatagggtagatgtaccagctattaccgcgtggggtgcaggtcgtccagggtttatcatcggcgaaacgctgcttgcgcgaagaggcgatggccagaaagcggttataggattcatcggcgcggatgccgatcatcatggcggcggggcgttgctgtgaaaaccagtccgcaaactggtaaacgaaactttcgaaggtcataccctgctggtaaaagggaaaacaggcagggtcggtaatggcgcagtcggggggctgcctgacccaggctttgccaggctcccagcactgccactccggttcaaattgcgagagggcattctgcgtggtcagcggcagggcaatccaccagaaggtttcgatgacatcctgatactcctcccgcattttattaatatgctttatggtacaggcgaactgcgcttcccagtcaataaataacacgtggatttttttattcatctgtcgggcaagcagggcggtgaggtgcagcataacggtggaatctttgccgccagaaaaagaaacgcaaacgcggggcagattttctaaggtccagcgtattcggccaatactggcttcaaatacgttttccattaactcaatcttatgaattgacatgagtgttaatccagtaagttaaaccatgattaaaaacactggtatgaagatgcggggaaagcccgcgaagagaatatattctgttggctggaggaagattcgtcaatgctgttaatgtaagtaaaaacagcaatactttatcccgggaatttaatacggccggagataatgtcaggccgtatatatcagcgggaggttactgatcctggtcaatactttctaccagttgcgcgaaaacagcgctattcatggaagcgcgattatacatcataaaaacatcaatggtgggcagcgagacgccagcgttaatctgtttaagattaagcgatgctttataatagttgaaggatttaagggggacgatgccgactaaatcagtatggctaatcatattcaaaacagaaatgaatgaatcgctgcggaacagtattttccgttgcggtaactctttttcaatgctggtaaaaatttcgcgggtcccctgtgcaggggtcgaaaaggcggtaaaaccctcttccagcaggtcactaacgctaatggtatcgttaatacgcgggtgcgatttgctgcataccagcaccagcggatcggttctgtagcgggtgcagacaatagaacgattggtgaccggcagcagggagagcaccaggtcggccttgcgatagttaagcaggtcttcggcggtttccggggcgataaaaatgtcgtggtgcacgatattatactgggcgttatcacgcagccggttaattaaactcaccatgccgttcgaaaccagtatctgggggctataaacaacaatggtcttcatcagctcactgttattcataatattgatggttcgttccagatcgttaaggttttcttccaggtgagcatgtaagtttatgcccacggtggtcggggtgacgcctttaccggaacgaacaaatagcgggtcattcagttgggcgcgcaagcgttgcagcgactgactgacggcagaaggcgtaataaataacgtctcagccgccttgctgatactttgatgctgataaatactctcaaaaatcaccagcagattaagatcgaattttttaagatcataaagattagccattaggtcatcctgatttattgactatgatttatttatctgatgattgtttcacgatggtgaagaaaaaaataaatacaatcctttgcgaataccaaacatgactttgtttgataagatgaatatatcatgaaaagcgatatttgaaaggtgcgacccgaaataagttgagggccgcaaaacgcggccctcaaactggcaattgttctggtctgacgcaggcgtttattgttcgcccattatcaccttcagcttttgctcatccggcagaccgaccacctgttgcagcacgttgttttcattcatgtaataaatagcaggagtcgcgctggccccaaggctatccatcaggcgctgatgcatattaagcgaacgcatggctttgtctgcgggtgtcgcgggcacgttaagcttcatcttgccgccggactgctcaaaatcgtgccaggtttttgccggatcggctgaggtcattatcgcggcggcggtcgccgggctttctggtttgatcacgcctaccagcagggtgcgcagctgaactttcccgctatccacccacggacgcgcctgctgccagaactgatggcagtacgggcagaagggatcggcaaagacatagaccaccctcggcgcgtcttttttaccatcgaggatccattctgctttttccatctgctgccagagctctcgtccggcaggggcatagatctctttctcaatcagcttttcgctaagattggcgcccgcgccgtcgtacatgtatcctgagatggcatgtttaccgtccggcgtgacataaatggtcacgcccatatcctgatattttcccagataacccttcatgccgccgggcgcatcgaacggcttaatgatggtgataccctgtttctcaatagctttaaccgcatcaggcagctcgtctgcttgtgcgaaaacaggtaaaagggtcatcagaactacacgctttaacatatcaaggccttgaatataaactgtaaaagtgagttttaggctgcggcggggcaggttgttagatattgcctattgagttgataacgtaaacgcattagccgtggcagtaaaacttgcgtaacttagcactcaacgaaaccacggaggaagtatagatgtccttaattaataccaaaatcaaacctttcaaaaaccaggcgttcaaaaacggcgaattcatcgaagttaccgagaaagataccgaaggccgctggagcgtattcttcttctatccggctgatttcaccttcgtttgcccgaccgagctgggtgacgttgcggatcattacgaagaactgcagaaactgggcgtagacgtgtactccgtttctaccgatacccacttcacccacaaagcatggcacagcagctccgaaaccatcgcaaaaatcaaatatgcgatgatcggcgacccgactggcgcactgacccgtaacttcgaaaacatgcgtgaagacgaaggcctggctgaccgtggcaccttcatcgttgacccgcagggcatcatccaggcgatcgaagtgaccgctgaaggcatcggccgtgacgcttctgacctgctgcgtaaaatcaaagccgctcagtacgttgcttcccacccaggcgaagtgtgcccggctaagtggaaagaaggcgaagcgactctggctccgtccctggacctggttggcaaaatctaatttttcttcggcttttgcatcatagcggcgttggctcactctcgcgccccggtcacttacctgtgtaagctcccggggacttaagtgttcgccgccttgctctgaagcaaaatcctttgaaaaatacgcgttatccgggtgcagctatgcacccgttttcccccaacaccatgattcaagttgcattcaggcagcccggataaggcagcttgcatgatgatgttttttagcaggagattaaaaatgctcgacacaaatatgaaaacccagcttaaggcctaccttgagcgtctgacaaagcctgttgagttgactgccacgctggatgacagcgccaaatcggcggaaatcagggaactgctggtcgaaatcgccgaactgtctgacaaagtgacctttgttgaagacaacagcctggcagtgcgtaagccgtcgttccgtattgctaacccaggctccgatcagggcccgcgtttcgccgggtcgccgctgggtcatgaatttacctcgctggtgctggcgttgctgtggacgggcggtcatccgtcaaaagaagcgcagtctctgctggagcagatccgcgacatcgacggcgatttcgaatttgaaacctactactcgctgacctgccacaactgcccggacgtggtgcaggcgctgaacctgatggcggtacttaacccgcgcatcaaacacactgcgattgacggcggcgcgttccagaacgaaatcaccgatcgcaacgtgatgggcgttccggcagtctatatgaacgggaaagagttcggccagggtcgtatgacgctgacggagatcgtcgccaaagtggacaccggcgcggaaaaacgcgcagccgatgagctgaaccagcgtgaggcctatgacgtgctgatcgtcggttccggcccggcgggcgcagcagcggccgtgtactctgcacgtaaaggtattcgtaccggtctgatgggcgagcgtttcggcggccaggtgctcgacactgtagatattgaaaactatatctccgtgccgaaaactgaaggtcagaagctggcaggcgcgctgaaagcgcacgtggatgattacgatgttgatgttatcgacacgcaaagcgccaccaaactgaccccggcggcagaagaaggcggcctgcaccagattgaaaccgcctccggcgcggtgctgaaagcgcgcagcgtgatcattgccaccggcgcaaaatggcgcaacatgaacgtgccgggcgaagatcaatatcgcaccaaaggcgtaacctattgtccgcactgcgacggcccgctgtttaaaggcaagcgcgtggcggtaattggcggcggtaactccggtgtggaagcggccattgacctggcgggtattgttgagcatgtaaccctgctggagtttgcgccagagatgaaggcggatcaggtattgcagaataaagttcgcagcctgccaaacgttgacatcatcctgaatgcgcagaccacggaagtgaaaggcgacggcacccgcgtgaccggccttgagtatcgtgcccgtgtaagcggcgatacgcaccagttggaactgtcagggatcttcgtgcagattggtctgctgccgaatacgaactggctggaaggcgccattgagcgcaaccgcatgggcgaaatcatcatcgacgccaaatgcgaaaccagcgtgaaaggtgtgttcgcggcgggtgactgcactaccgtgccgtacaaacagattattattgccaccggtgaaggggcaaaagcgtcactgagcgcctttgatcacctgatccgtaccaaaatctgataagaaagtaagatacacctgcatcaaaggcccggcggcatcagcttccgggcctttgtttttatcagaacggcttaacgtatcaccagcacaggcacatgcgcatggctgacgatgcttgaagcgttggatccgagtaagtgagtgctcattgacggattacgcgagccgatcaccactacgtccgcatgcagctcttcggccatttcattcaccacatcgcgtacgctgccaacccgcacatgggttttgagccgttcaggtggcagtgaaaaatggctgagcatggtttgcagacgcgcttgtgcttcattctggatatgctcttcaaagcggcgaatatctgcggcgaagcggtataaactcagatgcgccgagccgggaaccacgtgcagcagatggataattccatcggactgcgcaagaaattcggcgtgacggatcgccttttcactgagttccatgtcaaaaacatcaaccggcataatgatggacttatacataattacgtctccctgttagttccagggcttattcaaccataactaacccgcaatttttgtaaggtttgtcatgcatcctgtaaaagtcaggcgtaacggaaaggattgtacaaaagagcgtgccggaaagaggatgcgcaggcatcctctgcaagacaaagcgcagggcttaatcagaagagttagcgattgaattcaccggccgcttcgggctgataaaggatttcaatcacttcaaggtgggtggaggcgccgccgggtaattcccactggatgctgtcacccacgcgcaggcccagcagtgccgcgccaaccggggccagtacggataactgtttcgtgctgtcgctcatctgcgccggataaaccagcgtacgcacgcggatttcgccgcgggtcagatcgcgaaacttcacttcactgttcatggtcactacatcggctggcatttcttccggcgcgcacatctgcgcgcgatccagttccgcggtcagcgcggcggcaacgggcagcccggcgtagggcgcctgctccagcagccgatcaatgcgcccggcgtctcgttcattaatgataatggcaggtctggacatttcttactccatgtcgttcccggtgacattcaccgaattaatccaaagaaaaaccctcaccgtcagacggcgagggtttagcagatccgatgatactcattcttgcccgatcattgaagtgatatagctcacacccacgtttttccgcgccgctttttttgaatgatttcgcctttccgccgcacaggatccgctaagataacaggctgatttttagcggagcgcccatgccagagaatcccttacccgccgatcagcaatttttcgccgacctcctcagtggcctggtacttaacccacagcggctggggcgcatctggtttgccgtacccgcggctggcggcagcctggcagaatggccgcggctggatattgtgctgcgcggcgaatacggtgcgctgggcgaaggcgaaatgctgtttatcccggcgcggaccgcgatccgccagacgggagataaaccggcgatggtgttaagtctggtgttcgccccggcgtggctggggctgacctttcacgacagccggggacggcagccgctgcgcaacattgagctgccccatccgcagcgcggggaaggggaggcgatgctgacggcgctcacgcacctcgcccgcacgccgcaggatcaggacattattcagccgctggtgttaagcctgctgcatctgtgccggaaggtggtcaacagcctgccgggtcgctccctgccgcgggcggatttcctttatcaaagcctctgtaactggatcgaggataactatgcctcgccgctgacccgcgagagcgtcgccgcgctgtttaacatcaccccaaaccatttatcgcgtctgttttcccggcagggcaccatgagttttgtggactatgtgcgccaggtgcgtatggcaaaggcgcggatgattttgcagaaatatcacctgccgatacatgaggtggcgctgcgttgtggatttcgcgacagcgattacttctgccgcgtgttccggcgtcagttcgggctgacgccgggggagtaccgggcgcgttttcagtaggcttacagctccagctctgcctgcaacagcgccagaatggccggtgcgtctctggcggcaaagagcgcgtcgcggaaggcggtattcatcagcttacgcgccagctgcgaaaataccttcacatggctgatgccttcgctttcgcccagcgtcagcataatcaccatctccacgtcgcccccgtcagcgccccagcttatgggatgcggcagacgggcaatgctgacgctggagtggcgcacccacggggatttggtatgggggatcgccacgccaaagccgatggcggtcgagacaatttcctcccgttgccagacatcttcctccagcgcctgcggcgcatcggtacggccatgcagcgccagattgccgcacaaatactggatcacctgttcacgtgaagcgagcggctcgccaacgcagatggtttccagcgccagcagcgggcgcggcgcttcatgcaccacgatattatttaacgccagctcgatctcctctgcgctgcggcactcgcaggctttctccgccagctcacggcaggccgcataatccagctggcgcaccagcgctttcaccggcgcgatgcgtggtccgctcatgctgagttcatccagatccagccccagcagcagcggcagataacggctttcgccgcccagctcaccgcaaatacccacccgcttatgatggcggtgcgcggtgctgacaatctggcgcagcatacgcaagaacgacggtgtgatggggttatacagcggcgaaacgcgcggattattgcgatccaccgcatacaggtattgcgtcatgtcgttcgagccgatgctgaagaaatccacctcctcgcagaagtgatcgatgataaagcacaccgacgggacttcgaccataatgcccagcggcagggtgggggcgacgcgcaatccctccgctttcagttcggcacgcaccgacttcagcatatttttcacccacaggatctgatcgaggctgtgcaccatcgggatcatcaactgggcattgccgaacgcgctggcgcgcagaatggcgcgcagctgcgtgcgaaacagatcggcaaactccggataaatgcgcaccgcgcgataacccaggaacgggttttcctcatgcgggatcggcagatagggaatatgtttgtcgccgccaatgtccatggtgcggaaaatcaccggctgatcgccggcgctgaccagcacctgctgacaggcttcgaactgctcctgctcgtccggggcgctgtcgcgatccataaacagcatttccgttctgaacaggccgacgccctgcgcgccgctggcaaaggcggcgggggcctccagcgcgctgccgatattggcggcgatatcaacgcggtgtccgtcgagggttatcgccggtaaaccggcatcgttgatttgctgctggtgacgtttcatcgccagcttttgcgccagcgcataatagccgctcaccgcctcgtccggcgtcatcaccagcacgccgcattcgccgtcgagtatgcactcagcgccatcatgcaggccgagtgaggcgggcggcaggccgcttaataccggaatagcgtgggcgcgggcgaggatcagcgtgtgcgaggtgcgcccggttttttccagcaccatgccttttaaataacctaaatcgaggccgagaaactggctcggcgtgacgtcttccgccaccagaatcgtcggctgattcagcgtcaggctgttgccctgccgcacctcaggccaggtgatgtgcagcagttgctcgctgatgtcgcggatatcgctgacccgctcacgcagatagtcgctggcggaggccgccagtttcgcgcatacctgctccatattcgtgatgatcgcctgcgccagcccctggcgctgctcgctcatcagccgacggatattaccgctgaattcggcatcctggatcagcgacagatgggcgctgataatggttttgctttcgccatccagcgcctgcaactgcccgttcagctgttcggccagcgccgccagactgtgctccagccgcgcgttatcttccgcgcgggcgggcagttgccggtaacgatcaagattatcgtgttgccagacggtaagacggcctgcgcctatgccgcctgccagtacgctggcatgaataagcgtgggattaagccgggccagcgagcgcggcaacggcgtggcagacggagctgcctgcgggggcggcaggctatcgctgtcaataaactggtgttcgagatagtgctccagcgcccggcgggcggcctcttcatcgctgccgttgatttccagacggcagctgtcgttaaacagtgtgccggtactcaccagcgccagcgagcttttggcgtcggcctgggtgttgaggcgcaggttaataaagcgaatatcgctgtgccaggcggcgcactgctctttcagcgcccaggcgggacgcgcatgcaggccgtttggcagcgggcagtaaaaggggatggttaacataaatgactccctgaaagagaacctgacctgaaatccgtcagatcgttgaccgttgcggcagtaaacgcgttgatcagcgccaccagcaggcggtgcgtgtccgccagatccgtcagatcggcaatggaggccgcgcagtgaccgtgacgcgtgggcggcccgagcacaatagtcggcacgccggtaccggacaggtgaaccgcgccgccatccgtgccgccgttactgaacatatcgttttgcagcgtaatgccacagtcatgcgctaccttctgcacagccgcggcgagcttcggcggcgcaaccatcgatttatcgtacagcaccagcatcggccctttgccgatctgccggttattggccgggtcgtaatcaaaattattgccccagcaggcggtgtcgagcaccagcgccacatcaggctgcaccgcccgggaggcagtctgcccgccgcgcaaacccacttcttcgctggagctggcgaccagccagacctcgcagggcagcggcgtggcgtgcagttcacgcagcagcgacagcagcagccagcagccgaggcgatcgtcaaaagctttgcccatcacccgctggcggggcagcgtctgaaacggactggcaaaggtaacgcgatcgccgggggcaatgcctgcggcgctgacctcctgctggcttgcggcgccgatatcgacgcgcagatttccgccctgggcgtcgccgtccagcaggccgtgaattttctgtccgtcgcgggtggtgatgcgcaccggctgaagggtgcgcgcgctcaggcgcacattgccgacgggcaatacctcaatcgccccgtcgcggctgatgctgcgtacgataaagccaacttcatccatatgagcgcatatcattacttttggtccggcgctgccgttaagccggatcagcaccgaccccagaccgtcaaactgcaccgctttaccgtacttctgcgcttcgtgaaggaaaatatcccgcacttcctgctcggcggcggcaatggcatccgcctcactgagcgctttcagtaatgcgacatccatcagcattctcccgtcagttgcagttccgtcggctggcgatacagcacctcgtgaccgctgtcggtgaccagcaccatatcttcgatgcgcacgccgccttcgccgggcaggtaaatccccggctcgacggtcagcaccatgcccggctgtaaaggcgtggcgtcagaaggcgcgaaacgcggattttcatgcacatctattccgaccgcatggccggtgttatggccgaagcgatcgccatagcctgcgtcagcgatgagccggcgtgcggcggcatccacctcccggcacagcacgccggggcggatggcgttaatcgccgcccgctgtgcgcgtaagacgatctgataaatatcgtaaagcgacgtctcttcgggcggcgtgtcgcgtccggcgacaaggaaagttctcgtcatatccgaacagtatccctggtactggcagccgaaatcgagggtgacgaactcacccgcgactataactttttctgaggctttgccatgcggcagcgcgccgcgcgcgccgctggccacaatggtgtcgaacgagggcttttccgccccctgttgtttcatataccactccagttcggcggccacttcacgttcacgcatcccgggggcgataaagcggcgaatgtggtcggcgctgacatcggcaatgcggcaggcttcacggatcagcgcgatttccgccgtggtttttatctgccgtaacggatcgagcgacacgctgaccaggctggcgttcagcgcctcgcgccactgattaccggtctgccagctgacgtgctcgccttcaaagccgagggtggcgatgttttcagcggccagcaggcaattgaccactaccggcatggtatgcgcggcatccagcagatgcagctggtagcccttaacccggtcggcgatgtcggcaaaatatcgaaaatccaccagaatatgcgcctgttcacgggtaatcagcacataacctgaactggtggcgatgcccagatgcggcagcttattttgccgggaggcgatcagcaccgcatccagcgcattgtccgacagccagtcacgcaggcggctaagcagtgtcatggtatttatccttgtcattacaggctgtcgattatcagtttgccccggcgatagagcatattgcgcgagacaatcaccagcagggcggtgatcaccgcgccaagcaggatgccgaacatatagacgccaagattagtcaccagcggccacgcccagatcgccgattccgggaaccactgcactgcgccaagccacacggcggtggtggagccgacgatggtgccaatcatataggacgggatagcggtgagcgggctttcaagcgcaaaggggatcgccccttcgctgatgcccataaatgccaggaacatcgcggttttgccctgcgggtacagctgggcgctgaacaggcgtttgccggtcagacggcgatcaagcagggtggcaaggccaaggccaatcgacggaatgacaatggcgatagatcgggcggtgaccggcaggacgtgatccgtggtaaagctgaaggcaacaaaaccggcggctttattgatcggcccgcccaggtcgatggccgtcgtggcggagatgccgacggcatacatcagcgcgcctttttctccggcggcggtcagcagggtgcggatgccgccgttgatccagccgccaaagggcgtgatcacgtagtacatcgccagcatgacaaaaatcgccgacaggatcggtatcaggaaagtggttttaaacgccagcaggtaatcgggcatgcggaacgtctgattcatccacttcaccagataaccggcggcaacagagatgatcagcgcgccgataaaggtcgacggcaccggcgcggtggtaacccattgcagcgcggtcgggtcaaagttcagcaactgcgtgggctgggtggacatcagcccgccaataaatcccgccggaaacgccagtttgccgccgatggagttggcgacaaaggcggcgaacatcggaatggcaaagccaaacagcacgccgccgaacgactgcgacagccaggcgaacttcagcagcgataaattaaagccggtgaattgcccggaattcagggcgtccatgatgccggtatcggcgggaatatccagccagctgtaagcgataagctgtgaaaacgcgaggataacgcctcccatgatgagcgtcggcaccatgcgtgaaatgccggacataatatgttgcggtaactcaccccaaaagcgacgacgggtggccacagtgttgttgaccgtcgccgctgcccctgaaggactggcgaccacggttgcgctgcgttttttaatggccatgtgctgatcctcttaccagggattagtgttctgcggcgatcatgtcttcaatttctttcagcgttccggcggcatttttgatggcgtcctgaagcgtaatttcgtacacgtcgcgggattcaaagcgctcgttatcttccggcgtaatggcgatggcgtgaatgatgatcgtcgcctcggcgatgtcctgcgcggtcaggcggttctggatcccgtccgcgccctgagtttcgatttttacctcgtagcctgcggcttttgcggcgtcttccagcgcctgggcggccataaaagtgtgggcaaggcccatcgggcaggcgcagagcgcgataagttttttggtcatgatgaactcctgatatgagtgggactgaggggattatggtgagggtttagcggacgggttaccggataaataatgcattgactggatttttaatgcggtgaaggggaaatgtgacgcaggtcgcgaagggggctaaaggagaaaacacgaacaaaaaagcgcagcgtctttgtgacactgcgcccctggctgatgcgaggcttaaccagcgatgccaggcaccagaatttccgtggcgacgatcactacaatcagaccgactacaacgggaacagaggtgcgttttaccacttcgaacggcgagatttttgccatcccggccactgctaccaccacgccggaaaccggtgaaatggtgcggccaaggttagacgcctgtagcatcgggatcgacagataggccgggttaatgcccgcttcgtgggccagtttggggatcatctccacaaaggcataaaaaggcgcgttaccggaaccggtggtcatggcggccagcatggtgaggatcaccagcaccagcatcagaataatgctcgcggaaccgaaagaggtggcgatggaaatcaggctctggatgaaaccaatggtgctcaggccctgggcgaagacgccggccgccaccagcaggatcactacgcccgcaaaggcgtcggccataccgcggtacgccacttcgaggccagagaacactttttgcgtgttaaagccgcgcaggaactccaggatggcggccagcagcatacagatcaccagaatggtgatgatgtgcagttccgggccccacttaccgtcaaaaatcagtacgccgacaatgggcgtgaacggcagaatggcatagaacgacggcgctgaggtgacgatgtcgttcacatccagcatttccggggtgatgttctcttttttatccagatagcgctgccagaaaaagtgcgcgatcgccatgcagataatggccgcaatggagatgggcagcgtggttttaaaggcgaaatcaatcagcggcatctctgcggctttcgcggccagcaccacatcgccggaggtcggcgacagaatgatggcagccggcgaggcgcagattgccgccgctgcgccgcggctgatgcctacgttaaccatgaccgggaacagggtggccatcagcaatacgccaaggccggtcgcggaggaaaccgccagtgacatcagacaggccacgaaataagcggcaatcatcagcacatagggagagttaatataacgcagcggtttggacgccagcttgaccaccatgtcgttggcgccgatatgcgtcatgtaagccgcgaagccgcacagcatcatgatcatcataccgaggtcgccgccacggctcatcagcagaatttttatgtattcgacgatgtcggtgacattatagccggtgctggtggcgctggcgggcagtaccttatgacccatcagggcgctgatgattaacagcgtcagaccgcccacaaagagcacgcccgtcgcggaatagcctttgatgatgtagcgcgcgacgcccacgatcaccacgaccccgataagcagttcaataaacgttaacatggtttccccggagagacagaacacggcaaagcattctgtgaaaaaataagtaaatgaaaaaacaaagacgcaatgtgccgaattaatgggcaaaaatagctgattgaaatcaataaacagacgagtaaagcagcttctcacgctgtacgtctatacacatgctaaatatgctggcgcgttgtaaccacgattttgcgcaccccaaccctgcgctgctgcgctttgccggcgcttttttccagtaaaaagaaacactttcattgtcgaaaacgccaaaggcgttgcccccatgcaggcaaaaaagttcgcgacattaatcactttttcgtaaatatcgactggacaaaacccataacaattgttgtactgatacccgacacagcatttgtgtcgtattttcatgtaaaggtaatttagatgtctaagattaaaggtaacgttaagtggtttaatgagtccaaaggattcggtttcattactccggaagatggcagcaaagatgtgttcgtacacttctctgcaatccagagcaatggtttcaaaaccctcgctgaaggtcagcgcgtagagtttgaaatcactaacggtgccaaaggcccttctgctgctaacgtaatgcctatctaagttagcgataagacagaattcaaaaacccgctgagaagcgggttttttttgcgctgagcgcagcggttactgcgcattgacggtggaaaaaatccagaacgccagcgcggtcatggcaaaagagccgaaaagattcagcgccacgttcagcatcgcccagccaaaacgcccgtcctgtaataaaaagacgacctccgctgagaaggtggaaaaggtggtcagtccgccgcaaaagccggtagtgataagtagcttccatagcggatcgatatgcgtcatccggttaaaccaggccagccccataccgataataaatgcgccaataaggttcgccgtcagcgtccccacagggatagcgtgatgagcaggatttaagcgcagactcaaaaaccagcgcagtacacttccggttccgccgccaataaataccgccaaaagaagttgtcccaccgctatgtcctgctatttgatttgtcagaggaatgagtgtaatgctgtcagaataatatgactatcgcaaaaagctgaggagtgacgatgcgggtggcagcgggacaatttgcggtgacgccgtactgggaaaccaatgcgcagatctgtgccgacctcatggcacaggcggtcgcgcagcaggccgctttactggtgctgccggaagccttactggcgcgccgggatgacgacccgacgctgtcggtgaaatcggcgcagccgctggatggcggctttatcacgcgcctgttgcaggcaagccacggcaatactatgaccacggtgctgaccctgcatgtgccttccacggcgggcagggcggtcaatacgctggtggcgatccgcggcggcgagattatcgcccattacgccaagctgcatctctacgacgccttcagtatgctggaatccgcacaggtggacgcgggagataatattgccccgctgattgagattgatggcatgaatgtcgggctgatgacctgttacgatctgcgttttccggagctggcgctgtcgctggcattagggggcgcggatctgctggtgttacccgccgcctgggtgcgcggcccgctgaaagagcagcactgggctacgctgctggcggcccgtgcgctcgacaccacctgttatctgatcgccgccggggagtgcggtaatcgcaacatcggacagagccggattatcgatccacagggtgtgacgctggcggccgccgctgaagatccgcagctgatttttgcagagctaacgcgagagcgtataatgcagacgcgcgaaaagctgccggtgcttaaaaaccgtcgctttgcgccaccgcaattattgtgatgtttttttaaacaacacttgattcaccttgttacagattgctattgtgtgcgcgcgtcatatgaccgttaataacgtcaggttttagggcgcatttcgcagcctgttttatgaaagaaggtatttatgggtgagattagtattaccaaactgctggtggtagccgctctggttgtgctgctgtttggtaccaaaaagttacgtacgctcggcggtgaccttggcgcagccatcaaaggctttaagaaagccatgaacgacgatgacagcagcgcgaagaaaaccgtagacggtgacatcgccgcagagaaactcactcacaaagagtgatagcaatgccccaggcttgcaaaaaaaccggcttatcaggccggtttttttatgcgcatctgtaagtaaatatgtcgtgcttattttacttccagacctttcgcctgcatgtcggcgtgataggacgaacgcacaaacgggccgcaggcggcatgggtaaagcccatcgccagcgcttcggctttcatctcatcaaattcgtccgggctgacgtaacgctgtaccggcaggtgatggcggcttggctgcaagtactgacccagcgtcaacatggtgacaccgtggcgacgcagatcgcgcatcacttcgatgatttcggcgttggtttcacccaggccgaccatcagaccggatttggtcgggatctccgggtgcgcttctttaaaacgctccagcagcttcagcgaccagttatagtccgcgccagggcgtacctgacggtagacgcgcggcacgttttccaggttgtggttaaacacatccggcggcgtggcgttcaggatgtccagcgcgcgatccatacgaccacggaaatcgggaaccagcgtctcgattttgatggtcgggcttttctcgcggatggcggtgatacaatcagcaaagtgctgagcgccgccgtcacgcagatcgtcgcgatccacggaggtgatcaccacatagcgcagcgccatgtcagcgatggtttgcgccagtttatttggttcattcgcatcaggcgcgaccggacgaccatgagcaacgtcacagaacgggcaacggcgggtacaaatcgcgccgaggatcataaaggtggcggtgccgtggttgaaacactccgcaaggttcgggcatgacgcctcttcgcaaacagagtgcaggccgtttttgcgcatagccgctttgataccctggatacgggtggagtctgccgggagtttgattttcatccactccggttttcttaacagggcttcacgctctgttaccacgtttttgaccgggataagagccatcttatcggcgtcgcggtatttaacaccgcgttccatcacaatgggtttactcatagcgtgcgtgttccagttgcgaataacgaaggaaagcttttcaattcaagggaatgttgtatttatcaactatttttgaattagctgcgccgcagtataccattgaaaagggtgataaagcagcctgacggcccggcaaattgtaaaatagttgttgatttgtgcctttactgccagggcacgccgccgttatgtcaggcaaactctcccgtcagaatgcacgggatattacattgatgacgttttccagtaccggatcgcgcatactcaacttgttgtaatacaaagaaatttcaatctgctcattgctgactgccgggaattcaatctcctgtaacggccagcaggcgctaaacagggtaaataaacggaagggcatcagccccaacaggtcactgttgccgatcagtgctgcaatggtgaacatattgtaactgctaaagctcacctgacgctcagggaagagttcctgtatgcgctgacgtaatacgctcaggtgctgtccttccagcatcaacatcgtgtgctcatactggcgcagcgcctcttcagtaatgggctgttgcaggcaaggatgatcttttcggcacattagcaccagacggtcagaatagagcacatgctgattaagcgcgcgggtgctcggcagatgcgtatcgataattaaatcagtctgaaactgactgagctggctttccccgtcgttaatgggaatattgcgcagcagcaaatgcggcgactgtgctttgatagcctgataaatggtcggaataaccagcgcgccaagcgagggcggcgtgcccagcgtaatggtgcgctgtttatcatagctaccggtgagatccagcgcccccagaatagactccagtcccaggctgatatattcgtgcaaatgcgtcgcataggccgttggcgtcacgccctggcccttacggataaacagcggatcgggaaagatagtacggagtttctgaatggactggctgatggctgacggagtgagattaagcacttttgccgcattcacaatgcctttatgcacgtaaacggcttcgaaaatcgtcaataaattaagatcgatattgcgcaatgtacggaagatctgcggttttgcgtcctcgggacgttctgttattcgattttccgacgggtcattataatccacgcgtaaactccgaatttattcatgcgatgaataatgcataacaaataagtgtgatgattattagcgcgcaggacaggcaatcaccagcagtgattgccctgcgctttgattttcctgctgaccccagatgaaatcgtcagcatgaataatatattagacgctaatatgttgatgcgggggattattaagtaaatttaggaaattagcgactaatcgcgggccggttttatcggtgctggcgtcagcaacccactggctcatttgcgccatttccattcctgcataaccgcagggattaatgcgctggaaaggagcaagatccatggcgatatttaacgccaggccgtgaaaagaacagcctttgcgaatgcgcagtcccagcgaacagattttcttgccgctcacatagacgccaggcgcatccgcgcggggataagcttcaatatctgactccgccagcgtgttcaccacggtttgttccagcagggtgaccagttcgcgtacgcccagcttacggcgtttcaggtttaacagcacgtacatcacctgctgacccggtccgtgataggttacctggccgccacggtcgctctggatcacgggaatatcccctggcatcagcacatgttcggcttttccggcctggccctgggtaaacacaggatgatgttccaccagccagatttcatcaggcgtggcgtcgtcgcgggtatcggtgaattcatgcattgccagggagacgggctcgtaaggctgtaaaccaaggtgacggataagaatcgtatcctgaagcaaaacagcatctccggagagagggaagggtggcaggagtatatcataatgacgtgttacctgagatgcccaggtaacacgcctgttaattacagtaccatacgcacgatgtcgatattgccgagctcttcgtacagggtttcaacctgctcaatatgcgtcgcggtgatagtgatagagaccgagtggtaattgcctttgctgctcggttttacctgcggagagtagtcaccaggcgcatggcgctgtaccacttccaccacctgatcaaccagctccggtttcgcctgacccattactttgtaagtaaagggagtcgggaattcaagcagttcgttaagtttggttttcatgtcagctccggcgttacaaaaaagaacaactcccgccacagggcgggagttttattgatgcatagtatatggggatgaaattcagactttcaagtgctgaatttttaaccaaaccagtggtggaacatcagcttgatataatcaatgattttgccaaagaaattgccttccggaatttcctgcaacaccaccagcggacgctgttcaatggttttgccatcaagctggaagttaatggtgcccactacctgatttttttgcagcggcgcgtgcagctccgtgctggtcagcacatagctggccttcagatctttcatgcggccgcgcggaatggtcagataaacatctttatccacgccgagggaggcgcgatcgctgtcgccaaaccaggcgggttcagaagcaaactctttacctgctttgatcgggttaacagtttcaaagaaacggaagccccaggtcagcagttttttgctttcggtttcacggcctttaaaggtgcgcccgcccatcacggcggaaatcagacgcatctggccttcggttgccgaggccaccaggttatagcctgctttatcggtatggccggttttaataccgtcaacgttcaggctgttgtcccacagcaaaccgttgcggttggtctggcggatgccgttaaaggtgaactctttctctttataaatagagtattcgtttggcacatcgcggatcagcgcctggccaatcagcgccatatcgcgggcggagctgtactgaccttcagcgtccaggccgtgaacggtctggaaatgggagtttttcaggcccagcgcgttaacgtagctgttcatcaggccgacaaaagcgtcctggctgcccgcggcaaaatcggccatcgccacgcaggcgtcgttaccggattgcaggttgataccacggatcagctgggataccggcacctgcatgcctggtttcaggaacatcagcgaagagcctttgaacaccgggttgccggttgcccaggcatcgttattgatggttaccaggtccgtttccttgaacttgcctgctttcatggcctgaccgatgacgtagctggtcatcattttggtcaggctggccggatcgcggcgagcatcggcattctgctccgccagcactttaccggagttgtaatcaatcaggatgtaagactcggcatcgatctgcggcacgccggggatcatggttttgatgttcaggtcatcggcatgggcagcagacagggttgcggctgtcagcgcggtggtgagcgcgaggcgcttcacgaaacgaacggaaaaagtggtcttcatggtcagaacaacgacatccgtgatggagtgaaaaaaagtgccttactatagcaaaagctataagggcaggcatctgactttccgcatgatttgtgaatgaaacttacacaaactgacaaagtaagatgccctgttggtatttactgcgcgctggcaataaaggattgcagctgagcttcgctctgcagacgtgactgtaacgcgctggcgtcagccttgctgctaaacggccctaactgaatacgccagaccgcgccgttttgtaccacccgacccggcacggaaaactgctgtgccagacgctgctgatactgctgcgcgcgagtctgatcgctgaccgcgcccacctgcacgacatagccgctggcagcgcctgcggcggctggcgctgcaacgctaccctgcacggagcctggcgcggtgactggcgcggcaggcgtaaccggtgcggcggcaggcgccggggtagccacgacaggctgtggctgagcggcaggcggttcgttaccttccagcacgccgcttgcaagggtggtcggcgcgccgaggaatccgccgctgctgaccggtgagcccagcgtgttttcgcttttcagtgtatcgttgctgatcggctgcacgtcagcctgtgcctgctcaggctgcgggaggctggaggcgctgcccatgccgccggtcagatccggacgggcgggcagggcgtaagtctgtttcgccaccgtcgtacaggcggtgccaggccctgacagcgtgccatcctgcgccacgataatcggatcgatgcgcactttggtattgttggagttgttcagacgatccgcggcggcacgcgacagggaaatcacgcgatcgttaccataaggcccgcgatcgttaatacgcaccacgatcatacggccgttcgccaggttggtgatccgcgcatagctcggtaccggcagcgtcgggtgcgcggcggtgagctgcatgggatcgaaggcttcgccggaggcggtcagattgctgccgggttcggcatcataaatggccgccagacccgcctggctgaagcgcgacggatcctggacgattttataacgcttgccatcgcgttcgtaatcctgattcacggcagggttaagtgactcgtagcgcggctcagccccgccaatttcaacaaccgggccgttacataccgcaggctgcggcgcaaccggggcgggctgttgttgagtgtcacttgtacatgctgccagtaatcctgctgctatgcagactgcaagccattgcttacgcattgcgcacctcttatacgctttttgacaacattttccggtgggtatgaatagacatcacaataccaaacccggccatgagtacgatgagagcggagcctccataactgaccagcggcagaggaacccctaccaccggcagaataccgctcaccataccaatatttacgaagacataaacaaacaaaatcagcattaagccaccggccatcacgcgaccaaaggtggtctgcgcgcgggcggcaatatacagcccacgaataatcagcagcaaatagagcgccagcagcaccaggaagcccaccagacccagctcttccgccactaccgcaaagataaagtcagtatgccgttcgggcaggaattccagctgcgactgtgtaccatgtagccaccctttaccgcgcagcccgccggagccaatggcaattttcgactgaataatatgatagcccgcgcccagcggatcggtttccggatcgagcaacatcatcacgcgctgtcgctgataatcatgcatcaggaagaaccacaggatcgggataaaggccgccagcaggatcgccgcaatgccgatcagacgccagctcaggccggataaaaacagtacgaacagaccggaaagcgcgaccagaatcgacgtacccagatccggctgcgccgccaccagcagcgttggcataaagatcagcaccagcgcaatagcggtatttttcagcgagggtgggcagacgtcgcggttaataaagcgcgccaccatcagcggcacggcgatcttggcgatctcggagggctggaaacgcacaatgccgagatcaagccagcgctgcgcgccttttgagatcgcgccgaaggcgtccaccgccaccagtaaaataacgcagatgatatacagatagggcgcccagccttcgtagacgcgcggcgggatttgcgccatcaccaccatcaccaccagtcccatggcgatctgcccaatcttgcgctcggtcatgccaatatcctggccgctggcgctccagatcaccagcgcgctataggtcagcagagccaggataatcagcagtagcgtcgggtcgatatggattttatcccagaacgattttttgttcggattatccgtcatgatcattggtcctctgctgccgcggttgccggattttccgcaggcaaatcggtattgttatcgcccagcataatgtggtcgaggatctggcgcatgatggtaccgaccgcagggccagcgccgccgttctccagaataatcgccaccgcgacctggggtttatcgtacggcgcaaaggccgtcatcagtttatggtcacgcagacgttcagcgatcttgtgcgcgttataggtttcgttggccttcaggccaaagacctgcgcggtaccggatttggccgccactttgtaaggcgcatcggcaaaatacttatgcccggtgccgttcgcgcggttagccacgccatacataccgtctttggcgatttcccagtaaccggaatgaatatcgcctaccggcggctgttccggctgtttccacgggatttgctgaccattttccagcgtgctcattaacagatgcggcactttaaccacgccgtcgttaatcaaaatcatcatggccttgttcatctggaccggcgttgccgtccagtaaccctggccgatacccaccggaatggtgtcaccctgataccagggttttttgaagcgcttaagcttccattcgcgggttggcatgttgccggagcgctcttccgccagatctatgccggtgtatttgccgtagccgaacttgctcatccattcggaaaggcggtcgatacccatatcgtaggcgacctgatagaagaaggtatccgccgactcttccagggacttggtgatgttcagatgcccgtgtccccattttttccagtcgcgataacgcttctcggagcccggcagctgccaccagcctgggtcaaacaggctggtattgcgggtgatcacccccgtgcttaaggctgataccgcgacgtaaggcttcaccgttgacgccgggggatagacgccctgggtcgcgcggttaaccagcggcgtgttcggatcgttaagcagggcgctgtaatctttgctggagatgccgtcgacaaacaggttcgggttatagcttggcatggataccatcgccagaatgccgccggtgcgcggatcggtcaccaccaccgccgcgcggctgcccgccagcagggtttcgatatagctctgtagcttcagatccagcgtcagggtaatgtcatgaccggcctgcggcggcacttcttttaactgacggatcacccggccacggttgttaacttcaacctcttcatagccggtctgcccgtgcaggacgtcttcgtaataacgttcgattccctgtttaccaatatcatgagtggcggcgtagttagccagcttgccctctttatcgaggcgcttcacgtcgttatcgttgattttggaaacgtagccaagcacgtgggtcagggcggagccatacggataaaagcggcgtttatagcctttgacttccacgccagggaaacggtactggttaacggcaaagcgcgcgacctgcacttctgtcaggttagatttcacgggaatcgaggtgaagcggtgcgagcgggcgcgctcttttttaaagttggcgatgtcgtcatcagtcaaatcgaccacgccacgcagcgcatccagcgtctgctgcacgttatcgactttttccggcatcatctccacctgataaatggtgcggttcagcgccagggggatgccgttacgatcgtaaataatgccgcgactgggggcgataggcaccagtttgatgcggttttcgttcgagcgcgtctggtagtcggtatgccggagaatttgcagattataaagattggcgatcaggacaccagaaagcagcaaaatccccgtaaaggcgaccacagcccggcgcacaaacagcgcggactcagccgtatagtcgcgaaaagaattctgtaatttcatccgctgcgtaatctacctggtctcattactctcggtgataaggatggttggtagtaatgctccatgcacgatagaggctttccgccaccagtacccgaaccagcgggtggggtagcgtcagtgcagagagagaccaactttgttcagctgccgctttacaggcaggggataacccttccggcccgccgatcagcaggctgacgtcgcgtccgtcctgcttccagcgttccagttcatgagccagctgcggcgtatcccagggtttgcccggaatatcgagggtgacaatgcggtttttgccagccgcagccagcattaactcaccctctttatcgagaatgcgtttgatatcggcgttcttaccgcgttttccggcgggaatttctaccagctcgaacggcatgtccttcggaaaacgacgcagatattcagtaaagccggtttgtacccagtccggcattttggtgccgacggcgaccagttgcagcttcacgcattaaccccagagtttttccagctcgtacagcgcacggctctctgcctgcatgacgtgaacaatcacttcgcctaaatcgaccaccacccagtcggcgacgttttcgccttccacgccaagcggcatcatgcccgccgcgcgtgactcctgcaccacatggtcggcaatcgacatcacatggcgggtggaggtgccggtgcaaataatcatgcaatcagtgatgctggacttaccctgaacgtcaattttaacgatgtcctgacctttcaggtcatcaattttgtcgataacaaaatcctggagtgctttaccctgcaagtgttccccctgggagcgtacatatagtcattaatgaaggtatgacagtataactgaactgtcattctggcgggacacatgccgccagtaagatttttgaaagtgggctatcatcccacccgcggcaggagattgcatcgccatttttgtaaaacaatttcttaaagactttgcatggcggggcaagtccggcagcggaggataacagccttgccgggcgtgtcaatcatgtaatgacgcgcaggacgattatccggcgtccggcagccagaccgcgcggctgttcagtacgctcagggtggcaaaatccttgtggaaatcgatggcgctccacgccccctgttcgacgcgaaaatgccacaacgaggcagcaggcatgttaagcagcgtggcgatcagcagactgatcaccccctgatggctgacaatcagcacgttatcgtggtgctgccagtcacgcagcccggcaataaattgttgcacgcgctgtgaaaaatcctgaaacccttcgccgttggtcggcacggcgttctgccagtcgagacaccaggcggcgtaattatcagcgtcttcctgttttaaatcgcgatgatggcgcagttcccagtcgccaaaaaacatctcattgagcaggggcgtggtgtgcagcggaatattacggtcgttcagtaccagccgggcggtatgctgcgcgcgttccagggcgctgcacagcacctgatcaaaaggcacctcccgcagcagcgaatgcagcgccgtggcctgggcaatgccgcgcggcgtcagtgacgtcggcgcatggccgctgtacagcccggcgacgtttgcttcggtttctccatgacgtacaagccataatcgcatacgctatcctccggatattttctgcataaagtctaccattgcgcgctgagcgggcgcggttttttcgctccgatagccgctttaacaggagttcaccgatggctttgtttcacagcgcccacggcggtaatatccgcgaggcggcggacatgctggggatcgcgcctgacgccctgctggatttcagcgccaatattaatcctgccgggatgcccgatacgctgcgccaggcgctggtggataatctgcgccttgccgaacgttacccggatgcggagtatcagcatctgcatcaggcccttgccgcgcatcatcaactgcctgcctcctggctgctggcgggcaacggcgaaacggaagcgatttttaccctggtcgatggccttgcgccgcgccgggcaatgctggtgacgccgggttttgcggagtaccgccgcgcgcttaagcgggccgggtgtgccatagaagatttcgcgctgcgtgaagacgcaggatggcagctcaccggggacattctggatgcgctgaccgccgatctcgactgcctgtttctctgtacgcccaataatccgaccggcttactgcccgatgaaagcttgctgctggccattgccgcgcgctgccgggcgcttgggatcgcgctgatcctcgatgaagcctttatcgattttatcgaaggccactgcggatttattccttatcttgcggcgaacccgcacgtctgggtgctgcgatccttgacgaaattctatgccattccggggctgcgactcggctatctgattaacagcgatgcgcaggcggtcgggcgcttacgccagcggcagatgccgtggtccattaatgcctttgccgcgctggcaggggagatcctgttgcaggatacggattaccagcgcgccacctggcagtggatcaacagggaacggccacgcctgtatcaggcgctgagcgtgctgacagggctgactctgtggccgggggtggcgaattatctgtttttgcgctgcgaggtgcctgggctggatttacagcgggcgctgctggagaagcatattttgatccgcagttgcagtaactatccggggctggacgaacgctattatcgggtggcggtgcgtagccttaaggagaacgacagcttgatcgacgcgatgcaggcggtgcttagcgatacaggccctgctgtttgatgtaatcaagcacactctccggcagcaagtcgtcgcacgcttcgccgcgcgacagtcgctcgcggatcagcgtggcggagatattcagccatggcgtttccgcaaggaaaatcttcccggcgggcagggcgtgcagatcgtcgatgcggtgggtgaggtgctgctccagccactgcaggctggcctcgtcactcatcttttgtggataaccgggacggcggcagaccagcaaatgacagtgatcaagaatggtttcatagcggtgccaggtggggaaggagagcagagaatcctggccgataataaaagccagcggtcgcgtcgggccttgctcttcccgccatgcctgaatagtttgcgatgaccatgagggcgtatcgcgttgcagttcccgctcatccagcctgaacagcggtttatcggcaattgcccgctggatcatggttttacgttgtagcgaactggcttccggctgcggacgatgcggcggcacgttattgggcatgatgatcacctgcgacaggccgatcagattcgccagcgcttccacgggtttaaggtgcccgtaatgaaccggatcgaaagtgccgccaaacagtgcctgtaactgattcatctcatccatcaataaaaatatctgccagtgccttatgacagagtagcagagaaagcccttccagctccgcccataccgattgcccaaagtcctgctttaccgttaattcagtgcgggagagcaggtgtaccgcatgacgtaactgttcgttactgagccggttcagcgcctcgctggtcaccgcgcggcggttctgccagacgcgatgcttatcaaacagcgtgcgcagcggcgtgctggcggactgacgttttaaggtcaccagcagcagcagttcccgctgcagggtgcgcagcaggatcaccggctcgcagccttcaagacgcagctgttgcaggatatgcagcgcgcgtttgcttttcccggcgagcagcgtatccacccagtgaaaaggggtaaagtgcgccgcgtcgttaacggcctgctccacgcgggggagcgtcagcttgccgtcgggccacagcagcgccagccgatccagcgcctgcgccagcgccagcaggttgccttcatagcaatagcacagcaactggctggccgcttcatcaagctgaaggttgttctgttttgcgcggttcgccacccagcggggcagctgtgcctgttccggcgtctgacaggtgaccatcacggagcgctctgtcagcgcgctaaaccaggcggcattttcctgcgctttggtcagtttgttgccccgcaccatcagcagcagatcgtcgtgcagcaggctgaccagcgtggcgagctgttcattgatggcggcattcgggccgttgtcagggagctgcaataacagcgtctgacggctggcaaacaggctcatggcctggcacagtgaaaagagggcggaccagtcggtgctggcatcaatggtcacgctgtgatgctcatcaaaaccctgggcgatcgccgcggcgcgcaccagatcctgactttcctgcaataacagcggatcattacccagtagcagatacgccgcgcgcagcccttcattgagctgcgcgcggagttgttcagggtacagcttcagcatcagttacctaatgatgttggggcgcttggcgcaacatcaggcgtggtcaccggcacatcggcatcctcactattggcatgtacgcttggcagctggcggatcagctgttccgccgctttgtcatacatttcctggatgatcatcgtctgttccgcatcttttgccagcgcgttttgcgggttatcgaagaaggaacgataaaccttggtttttaaaggataaattcctttgccagggatcatcagcgatgcccatacgtccatcaccatctggtattccgctgtacgaccgttctggaaaatagaggccgtgtcctgtacaagactggcggtacccagacggagcgaaggaatatcctgacgtgtgctgcctttctcaaccacttcaactccgttcagccgcagctgggtacgaatcgcacggcttaacggaccataaggatccgaagagtcgaaaatgatggttttcatttcggcaggaacctgggtggtattccgtaaatgccagccgcacccggcggtgaccagcaccgccagtgatagtaaaactgttgccagatatcgcacgcttcctcccgcgcttagccaacgaccagattgagcagtttgcccgggacataaatcactttacgcacggtaacgccctcaagatatttcgcgaccagatgttcctgacccgcacgttcgcgaacctgttgttcggtagcatcgacaggcacggtaattttaccgcgtactttgccgttcacctgcacaaccactaaggtggaatcttccaccatcgcgttttcgtcagcctgcggccatggcgcgttgtcgatatcgccttcgccatgcagttcctgccacagcgtgaagcaggcgtgtggggtgaacgggttgagcatacgcactaccgccagcagcgcttcctgcatcagcgcgcgatcctgctcgccgtcctgcggcgctttcgccagcttattcatcagttccataatagccgcaatcgcggtgttaaaggtctgacgacgaccgatatcatcggtcactttggcgatggttttatgcacatcacggcgcagcgctttctgatcttcgctcaggctcgccacgttcagcgcggcaacctcgccctgagaggtatgttcatacaccagtttccagacgcgtttcaggaagcggttcgcgccttccacgccggattcctgccattccagcgtcatgtctgccggtgaagcgaacatcataaacagacgcacggtgtccgcgccgtaacgttcaaccatttcctgcgggtcgataccgttgtttttcgacttggacattttgctcatgccggtatacaccagctcatggccgtcggcgtctttcgctttcacgatgcggcctttctcgtcgcgctcaacgatggcgtctttcggggacacccaattgcgctcgccgttagcacccacatagtagaaggcgtctgccagcaccatgccctggcacagcagctgcttcgccggttcgctggaggtaaccatgcccgcgtcgcgcatcagtttatggaagaagcggaaatagagcaggtgcatgatggcgtgttcaataccgccaatgtaaatgtccaccggcagccagtagttggcggctttcggatccagcatgccgtcggtgtgctgtggacaggtgtaacgcgcgtaataccaggaggactccataaaggtgtcgaaggtatcggtttcacgcagcgcaggctgaccgttgacggtagttttcgcccactccggatcggccttgatcgggctggtaatgccgtccatgacgacatcttccggcaggatcaccggcagctgatcggcaggggtcgggatcaccgtaccgtcttccagggtcaccatcgggatcggcgcgccccagtaacgctgacgggaaacgccccagtcgcgcaggcggtagttcactttacgctcgccgacgcccagcgccgccagcttgtcagcaatggcgttaaagccctcttcaaagctcaggccgttgaattcgccggagttaaacagggtgcctttttccgtcagcgcctgttcagacagatccggctccgcgccatctgccgtcagaataaccggcttgatggtcaggccgtatttgctggcaaactcatagtcacgctgatcgtggcccggaacggccatcactgcgcccgtaccgtactccatcagcacgaagtttgctgcccataccgggatcgcttcgcccgtcagcggatgaatggctttaaagccggtatcaacgccttttttctccatcgtcgccatgtcagcttccgccactttggtgttgcggcattcgtcgatgaaggtggccagttctggattgctttccgccgccgcctgcgccagcggatgacccgcagctaccgccaggtaggtcgcgcccataaaggtatccgggcgggtggtgtagacggtcagcttgctgtcatggccctgcacgtcaaaggtgatttccacgccttcggaacggccaatccagttacgctgcatggttttaacggtgtccggccagtggtccagcgtatccagatcgtttaacagctcttcagcgtaggcggtgattttaataaaccactgcgggatctctttacgctcaactttggtatcgcagcgccagcagcagccgtcgataacctgctcgttcgccagcacggtctggtcgttcgggcaccagttcaccgcggaggttttcttgtacaccaggccttttttatacagttcggtgaagaacagctgttcccagcgatagtattccggcgtacaggtcgccagctcgcggctccagtcgtaaccgaagcccagcattttgagctggtttttcatgtaattgatgttgtcgtacgtccacggggccggagcggttttgtttttcaccgccgcgccttcagccggcaggccgaacgcatcccagccaatcggctgcagaacgtttttgcccagcatacgctgataacgggcaataacgtcgccgatggtgtagttacggacgtggcccatgtgtagtcgtccagaaggatagggaagcatcgacaggcagtaatacttctctttgctctcgtcttcggttacttcaaatgtgcgcttctcgtcccagtgttgctggacttttgattctatctcttccgggcggtattgctcttgcatggcagccagtgatcctgttttcaatacagctacaagcgtagcattagatgtgatgtctcagatccgcatagcatagcccaaacgcccgcctcaaaacagcctttcgcacaaaaggagggatgccgatccttgcaggaatttacacactctgtggggcggctggcaaagtacgccggaaataacgtctattattagaaggtgttactaagcccggaggcgaaaggatgaacaaggttgctcaatactaccgtgaactggtcggcacgctgaccgaacgcctgcaaaacggcgagcgcgacatcgacgcgcttgtggaacaggccagactgcgcgccacccagaccggggagttaacgcgaaccgaaattgatgaactgctgcgcgccattcgccgcgatctggaggagtttgcccgcagctatggggaaagccagggcgaactgaccgacagcgtttttatgcgggtgatcaaagagagcgtctggcagcagctggcggatattaccgataaaacccagctggagtggcgggaagtcttttccgatctcaatcaccacggggtctatcacagcggggaagtggtggggctgggtaacctggtctgtgaaaagtgccatttccatcttgcggtttacacgccggatgcgctgccgttatgtccgaagtgcggtcatgaccagttccagcgtcgtcctttcgagccgtaaattttaaggccggagcgccttcaggcgtttccggccatcacgctttattctccgtagaacgccagtcgttcggccagtaaatccacaaaagccccgcgatcgacatccatcatcaccgtcgtattcggcgtattgccggtcaggaaatagtaatccaccaccgtcataccctgggtgtactgcccgcgggtttccacgccgacccagcgctccaccgtggtgaaaatttccggtttcagcagccaggcgatggtacagggatcgtgcagcggcgcgcccacaaagccccatttttcctgtttgtgatattccataaagaagtcgagcagttcggccacaatcacagccaccggattgccgatggcgcgaaaacgctccacatccgcggcgtggatctgtgctttatgggtgacatccagccccgccatcaccaccggaatgccggagcggaagacgatttccgccgcttccggatcgacataaatattgaattcggcggcgggcgtccagttacccggtgccattgcgccgcccatgatcacaatacgcgcgatgttgtcatgcagttccggatggctgtttagcagcagcgccacgttggtttgcggcccggtagccaccagcgtgaccggctccgcgctctcgcgcagggtttttgccatcagctcaacggcggtgcagggctgcgccgcaaaacccggctccggtaatgccgggccatcaagcccgctttcgccgtgcacgttatcggcgatgataagctcgcgcatcagcggttttaccgcaccgcccgccaccggaatgtcgctgcgcttaagcagcgtcagcatccgcagcacgttattcagggttttgtccggcgtctggtttccggcggaagaggtgacggctttgacgtccagttccggggaggcaagggcgagtacgagggcgatagcgtcatcatgacctggatcgcaatcaattattacgggcagtgccattggtattccttatccgtgttgttttgtgacaagggtaacgcgtcactgaaaggcagacgataaaggcgggtagaaaacgtgaagcggcgcgcagatatgccctgcgcgccgggaagattaatgcaggattttggcgaggaaatcttttgcgcgatcggaggccggattcgcaaagaactcctctttcggcgaatcttcaacgattttgccttcatccataaagatcacgcggctggcgactttacgcgcaaagcccatttcgtgcgtcaccaccatcatggtcatgccttcctgcgccagctcgaccattacgtccagcacttcgttgatcatctccggatccagcgcggacgtgggttcgtcaaacagcattgccaccggatccatgcagagcgcgcgggcaatagccacacgctgctgctggccgccggagagctgagccgggaatttattggcatgcgccgcaagacccacgcgctccagcagtttgctggctttttcacgggcggcggctttatcgcgcttaagcactttgatctgcgccagcgtcaggttttcgataatcgacagatgcgggaacagctcgaaatgctggaacaccatgccaacgtgggagcgcagctccgccaggttggttttcttgtcggtcacggtggtgccgttcacaacgatctcgcctttctgcaccggctcaaggccgttgacggttttgatcagcgtcgactttccggatccggacgggccgcacaccaccaccacttcaccttttttaaccgtggtagagcagtcggtcagcacctgaaagtgaccataccattttgaaacgtttttcagggaaatcattaaactgtccttttcttcagatagctgaccaacagtgaagcactgagactgataacaaaatagacgaagccggcaaagaggatcatctcaacctgggtaccgtcgcgctcgccgatggtggaggcggtgcggaagaagtccgccaggcttaacacgtacaccagagaggtatcctggaagaggacgatgccctgggttaacagcagcggcaccatcgcccggaacgcctgcggcagaataatcagcttcatcgactgccagtgggtcatgcccagcgccagcgcagcgcttgactggccgcgtgaaatactctgaatacccgcgcgaataatttccgaataataggcggcctcaaacatcgagaaggcgaccatcgcggagatgaggcgaatatccgatttgggcgacagccccagcacatcctgcaacagacccggcacaatcagatagaaccacagcagcaccatcaccagcgggatagagcggaaaacgttcacataggcagtagcgaaccacgccagcggcttgaacgtcgacatgcgcagcaccgccagaatggtgccccagacgataccgacaattaccgccgtgacggtaattttcagcgtcacccagagtccgtcaagcagatagggcatcgccggaataatggaactccagtcaaactcgtacattatttgcctcccatattgccaggcaggcggactttacgttctaccaggttcattaccagcataatcacggcgttaatcaggacgtaggcaagggtgatggcggtaaaggattcccacgcgtgggcggagtaatccagcagcttacccgcctgcgccgccatatccaccagaccaatggtcgaggcgatagcggagtttttcaccaggttcatcatctcagacgtcatcggcggcacgatcacccgataggcgttcggcagcagcacatagcgataggtttgcggcagcgtcaggcccatcgccagcccggcgtttttctggccgcgcggcagcgattcgatcgccgcacgcacctgctcgcacacacgggcggcggtaaacagtccgaggcagatcattgacgacaggaagaactggatattgggatcgagctcggctttaaaccacatgccgagatcttccggcagcagttcaggcacgaccagataccaggtaaagaattgcacgattaacggcacgttacggaagagttcgacgtaaagcgtcccgatgcctgccaggaaccggttaggcacggttctgaggatgccaaacagggagccaaccaggaaagcgaggatccaggcggtgatcgacagcgcgaccgtgacctgaaaaccgctccacagccagccaagataggtggtgttgccgaacggggcttgttgcaggaaaattccccagttccagtctattgacataatctacctctgaaaaaaaagggtagcagcgctacccccgaagattaataagaagctgtaatattcgtgctgaatggggaacgacccttcaacgtatagtctgtccgcgcttcatatcaatcgagagggcaggaggacccgcccctaatggttgtaattagttaagagctttgtcgttaggttctttgaacagcgctttcatctcatccgagagttcaaagttcatgttcagattttttggcggaattgggtttttgaaccacttatcaaaccacttagccgcttcgccagaggtctgcgcctgggcgatggtgtcatccatcagcttcttgaactcggtatcgcctttacgcagcatgcagccataggcttcctgcgactgcggcttgccgacgatttcccagttatccggttttttcgccttcgcacgctcgcccgccaacagggcatcgtccatcataaaggccacggcacgaccgctttccagggtgcggaaggagtcgccatgatctttcgcgctgatgatgcgcatatccattttctgctcttcgttaagcttgtgcagcaacacttcagaggtggtgcctgaggtgacgacgaccgctttacctttcagatcggcgaagtctttcacgttgccgccttttttcgccagcagacgggtgcccacgacgaaaatggtgtcagagaaagcggcctgcttctggcgctccaggttgttggtagtggagccgcactcaaaatcaaaggtgccgttctgcaacagaggaatacggttttgcgaggtgatagggatcagttttacctgcaggtccggcttgttgagctttttctttaccgcttcaacaatggcgttggagtaagcctgcgaataacccaccactttttgctggttatcgtagtaggagaacggtacggaagattcacggtgtccgaccacgatgacgccgtttttggcgattttttccagcgtgctttgcccggccgcaggggctgcatcttcagcctgcgctacgccggcggacattcccatcaccagcattgctgtggccagtttacgtaattgcatatccaactccttcatcgtcagcgccagagacgcattgatacccagtgtgagtgattgtgttgttatatcctgctgcttaagcgtgcagtgttatgcgtgtttgttaacatttagtctggcttaatgtaaagattttgctgcgatattgtttatttttgcgaggcgctccgcaccgtttagaggcataaatcgctgcttgcaccaaattagtgccgccgccgatccgtgctggtgcatcaaggttgcagagccgcaaaaaatcgctgttccctgctaatgggtagcaagaggtgtgccagttttgaaggagtgcaggcccggtgcactgtgtgcgaccggtcctggaggagagggattagtgacgacgctggcgcagactcatcaccagcgcgccgaaaccggcgagcgcggtgaggatccacagcggccagttgccggtgcgggcataaggcgtaaggccacgtgccggcgtgacctctgccgtcagcacctgacgggtaaactgcgggatcatagcctgaatgtcgccctgcggaccaatcacggcggtaatgccattgttggtgctgcgcagcagcggacgtgccagctccagcgaacgcatacgcgccatctggaagtgctgccacgggccgatagatttaccgaaccaggcatcgttggaaatggtcagcaggaagtccgtatccggacggaagttgtcccgcacctgttcgccgagaatgatttcatagcagatggcgggcgtcagattaaacccgtgcgcatgcagctgcggctgcacgtaaggcccgcggctgaatgacgacatcggcaggtcaaagaacggcgccagcggacgcaggatcgactccagcggcacgaactcgccaaacggcaccagatggtttttgttgtagcgattggtggagtcataacgatacggactgtctttacccagcgtaatgatagtgttgtaggtatcgtagcgattctgctgattcagacgcgcatccacaatgccggtgataagcgttgtgtctctgtcacgcagctgcgcgtccagcgagcttaaaaagcgctgctggttgatttccagatccggaatggcggactccggccagatgatcagttgcgatttgcccatctcccgctcgctgttgctaaggtagatctccagcgtattcaccagctggttttcatcccatttcagcgactgcggaatatcgccctgcaccagcgacacctgcgtggctttttccggcagcaacgtataccactgaacatagcgcagcgggaagggcagcgcgaacagcaccacgcccgccgccagcggacgccagttgcgggtcgcgatagccagcgccagcaggccgctgactatcatcagaagggcgttgatcgcttccacgcccatcaccggcgccagccctttcagcgggccgtcgatctggctgtagccaaactgcaaccacgggaagccggtcagcacccagccgcgcaggaattccgtcagctgccagacgacaggcgcggcaatcgccacgcgcagccagttcgtcttcggccacaggcgggagaggatcccggcaaacagaccggtatagagcgacagataggcggccagcagtacgacgaggaaaatattgatcgggccgggcatgccgccgaactgcgcgatgctgacgtaaacccagttgatgccggaaccaaacagccccagcccccagaaataaccaatccaggcggcctgcagggggcggcggttgagggtcagcccctgcagccccatcagagacagcagcgcggcaggccagatatcataaggagaaaaagccagcgttccgctggctccgagtatcagcgccagcagcaggcgatagcgctggcgttccattaatggggcaaaaaccatttattcatccagtagtggttttattcgtccagttttggctggggagaatcatccggtattctgacgtgaacctgaataatacggcggctgtcggccatcgcaactttaaactggtaaccatcaatgtcgatggattcgccgcgcgcaggcaggtgcccgaacgcctgcattaccaggccgccgatggtatccacttcttcatcgctgaagttcgtaccgaaggtttcgttgaagtcttcaatggaggccagcgcgcgcaccgtccaggtatgacggctgagctggcggaattcgatatcctcttcttcatcgtattcgtcttcaatttcgccgacgatcaactcaagaatatcttcaatggtcaccagacctgaaacgccaccaaattcatcaatgacgatcgccatatggtaacgttgtgaacggaactctttcagcatgcggtcaacccgcttgctttccggtacaaccaccacctgacgtaacactttctccatgctaaaggcttcggcatcgctgcgcataaacggcagcagatctttggccatcagaatcccttcaatgtgatctctgtcttcgctgatcaccggaaaacgcgagtgggcagactcgatgataacgtcgagacattcatccagcgtttgattgcgtttgagggtgatcatttgcgagcgggggatcatgatgtcgcggacgcgctggtcggcaatatccattaccccttcgagcatgtcacgcgtatcttcgtcgataagatcgttctgcccggaatcacggattagcgccagtaattcatcgcggtttttaggttcaccgtggaaaagctggctcagtaagagggaaaaaaatccctttttgctgttaagtgtatcgttactgtgggaattgtcgtcgctcatggcgtcgtgtgggatctcatgttaatcaaaatgtcgcacgtcacgcgtaaactcagcgccagacggcatgaaaagcagccgcgccggtaaaccggcgcacagactactccttctcggcaatgtacggatcctcatagcccagagcaagcattatctctgtttcgatgccttccatttcttctgcttcgtcatcttcaatatgatcatatcccagcaggtgcaaactgccgtgaataaccatgtgcgcccagtgcgcgtccagcggtttcccctgttcgcgggcttcctgttccaccacctgacggcagataatcaaatcccccagcagcggcatttcaatccccggcggcgcttcaaacgggaacgacagcacgttggtggatttatctttaccgcggtaggtcagattcagttcatgactttcggcgtcgtccaccacgcggatggtaacttctgattcttcctgaaactgcgggatcaccgcattcagccagtcctggaactgggcttcagtcggcaggcctgcggtatcctcgcaggccagttgtaaatcgagtatcacagaactcatttttgctcctgctgctgggcttcgcgtttgcgctcggcggccagttcagctttacgtttttggtcggcctcttcccaggcctcgtaagcgttaacgatacgggcaaccaccgggtggcgcaccacgtcttcgctgtggaagaagttaaagctgatctcatccacctcggccagcacctcaatagcgtggcgcagaccggatttcaggttacgcggcaggtcaatctgcgtcacgtcaccggtgatcaccgctttcgagttaaagccgatacgcgtcaggaacattttcatctgttcgatggtggtgttctgactctcatccaggatgatgaacgcatcgtttaacgtacggccacgcatatacgccagcggtgccacttcgattacgttgcgctccatcagcttttcaactttctcaaagccgagcatctcgaacaacgcgtcatacagtgggcgcagataaggatccactttctggcttaaatcaccaggcaggaagccgagtttttcaccggcttccaccgccgggcgggtcagcagaatgcggcgcacgtcctgacgctctaaggcgtcgacggcggcagccacggcgagataggtcttaccggtaccggcaggccctacgccaaaggtgatgtcgtgatcgagaatgttggccacgtactgcgcctgattcggcgtacggggtttgatcaccccgcgcttggttttgatgtggatcgccttgccgtattccggcacgctttccgcactctgttccagcacgcgggcttctttgatcgccagatggatctgttcaggctcgatctcctgcgtctgaccgcgcatcggggcggtatcgacgtacaggctacgcagaatatcggcagccgcgttcacgctgatcgggcgaccggtcagtttgaagtggttatctcggcggttgatttcgatacccagacggcgctcaagctgtttcacgttgtcatcaaacgggccgcacaggcttaacagacgttcattatcggcgggttcaaggctgatttcgcgggtttctgtattcaaattaatcctcttatacctttaagcctgccagcaaaaggctgacgggcgtgatgtcatcattaccgaaagtatttacggcatggggaaaaggcgcaagcatggtattggatatgggggctggagggggcaaaacaaggcctgccagcgacggcaggccgcaatgattatggctggaaaagaccgacgccaagctcattttctttacgggtgcgggcgatcaccgactccggcgtttcgctgatgcgcaggcccatctcatcttccgtgcgtaccactacgccgcgcagggagttggtcagaacatccgtgatttccacgtcgacgaatttgccgatcatctccggcgtgccctcgaagttcaccacgcggttattttcagtacggccggaaagctccatcacgctcttacgggaggtgccttccaccagaatacgctgggtggtgcccagcatacggcggctccaggccattgcctgctgggtgatgcgctcctgcaaaatgtacagccgctgctttttgtcctcttccggcacatcgtccaccatatcggcggcaggcgtacccggacgggcggaaaagataaagctgtagctcatatcgaagtttacatcggcaatcagcttcatcgtctgctcgaaatcctgggtggtttcaccagggaagccgacgataaagtcagagcttatctgaatgtccggacgcgccgcgcgcagcttacggataatcgccttgtactccagcgccgtatgggtacggcccatcaggttaagcacgcgatcggaaccgctttgtaccggcaggtgcaggaagctcaccagctccggcgtatcgcggtagacttcaataatgtcatcggtaaattcgatgggatggctggtggtaaaacgcacgcggtcaataccgtcgatggcggccaccaggcgcagcagctcggcaaaggagccggtggtaccgtcatagttttcaccgcgccaggcgttgacgttctgccccagcaggttcacttcacgcacgccctgggcggccagctgggcgatttcaaacagaatatcatcgcacggacggctgacttcttcgccacgggtataaggcaccacgcagtaggtgcagtatttattgcagccttccatgatggagacaaaggcggtcgggccatcggcgcggggttccggcagacggtcgaatttttcaatttccgggaagctgatgtccaccaccgggctgcgattgccgcgcacggaattgatcatctccggcaggcggtgcagggtctgtggcccgaaaacgatgtcgacatagtgggcgcgctgacgaataagatcgccttcctgggacgccacacagccgccgacgccaatgatcaggtcaggatttttctcttttaataatttccagcgacctaactgatggaagactttttcctgcgccttttcgcgaatcgaacaggtgttaagcagcagcacatcggcttcttccgccacctcggtgagttgatacccgtgggtggcatccagcagatcggccatctttgatgaatcgtattcgttcatctgacagccccaggttttaatatggagtttttttgtcatcgacttgctctgttaatcgccaggaatgcaggccgcgtattgtaatgctttgacccggcgctgaccatagttcatgtcccgccccacgaaaatgaaaaatccggtaaacttaagggaattaaaaataaggaaaaaagaccatgatgaatcaaccaacggaagtggccgtggtcggcggcgggatggtcggcagcgcgctggcgctggggctggcgcagcacggttttcaggtaacggtgatcgagcagacgacgccgcccgtctttgatagcgcggccgcgccggatgtgcgcatatcggccatcagcgccgcctctgtctctctgctgcgcagtcttggcgtctgggattcgatcgagaatatgcgttgtcatccataccggcagctggaaacctgggagtgggaaagcgcgcacgtcctgtttgacgccgctgaactcaagctgccgctgctgggttacatggtggaaaacaacgtattgcaacgcgcactgtgggaagcgctggagcgccagccgaatatcaccctgcgcgcgcccgcctgtctgcgcgccatgcaccgcgaggccgatcatcatgcgctggaatttgtcgatggcgataccctgcgcgccaggctggtgattggcgctgacggggcgaattcacaggtacgccagtgggctggcatcggtatccacgcctggcagtacgaacaatcctgcatgttgatcaccgtgcagtgcgaaaatccgccgggcgacgccacctggcagcagttcacccctgacgggccacatgcttttctgccgctgtttgataactgggcctcgctggtctggtacgaccgcccggcacgcatccgccagctgaagtcgctcaatatgatgcagctgcagcgggagattgaaaaaaccttcccggcacggctggggaaagtcataccggtgcaggcgggcgctttcccgctgacccgccgtcatgcgcggcactatgtgcagccggggctggcgctggtgggcgatgcggcgcataccattcatccgctggcggggcagggcgtcaacctgggctaccgcgatgtggatgcgctgctggacgtgctggcagaggcgcgcagcgtcggcgagccctgggccagccacagcgttctgcaacgctaccagcgccgtcgcatggcggataacttcattatgcagagcggcatggatctgttctatgccggattcagcaataatctggggccgctacgggtggtgcgaaacctgggcctgatggcggcgcagcgcgcaggcgtgctgaaaacgaaggcgctgaaatatgcgttaggcttgtaagtttcagcccggcgacaggacgttgccggggacgtttatgaaaggacaaaaacaaaaaagcccgccgaagcgagcttttttgttttttatggctggggtacgaggattcgaacctcggaatgctggtatcagaaaccagagccttaccgcttggcgataccccaacagggtgttgctataaattggctggggtacgaggattcgaacctcggaatggtggaatcagaatccactgccttaccgcttggcgataccccaacaattttttactgctaaagcctctttaaaagacgcttccagaatatggtggctactacgggaatcgaacctgtgaccccagcattatgagtgctgtgctctaaccagctgagctaagtagccaaattttactgctttaccagccatcgactggctggggtacctggattcgaaccagggaatgccggtatcaaaaaccggtgccttaccgcttggcgataccccaacgactgacgtgttaatacacaggagtcgaagaaaagtggctggggtacctggattcgaaccagggaatgccggtatcaaaaaccggtgccttaccgcttggcgataccccatccgtgcaacgcttactgggaatggtgcgggaggcgagacttgaactcgcacaccttgcggcgccagaacctaaatctggtgcgtctaccaatttcgccactcccgcaaaaaaagatggtggctacgacgggattcgaacctgtgaccccatcattatgagtgatgtgctctaaccaactgagctacgtagccatctttttttcgcgttaccttatcggcgttgcggggcgcattatgcgtattgggtcgatgatggtcaacacctttttcatcgaaaattgccggattgtgactgtttggttgggttgtgaacagcctggcgcattattcagcaaccaaagcaaacaggccccgcagggcctgtaataataacacggacttatttgtaagcggactggtgaacgcccaccgcgcggcctgatggatcgttcatggttttgaaggcttcatcccattcaatggctttggccgacgaacaggccactgacggaccgccaggcacgcattctgcggcacttggcaccgggaacagctcttcaaaaatctcgcggtacaggtagccttcttttgacgacggcgtgttgtacgggaaacggtagcttgcggtggccagttgctgatcggtcacctgctgcgccgccacttctttcagcgagtcgatccagctgtagcctacaccatcagagaactgctctttctgacgccatgccacgctggccggtaaataggactcgaagcattcgcgcagcacatgtttttccatcttgccgttgccgcacattttatcctgcgggttgatacgcatcgccacatcgaggaattttttatccaggaagggtacacgcgcttccacgccccaggcggacatcgctttgttggcgcgggcgcagtcgaacatatgcagcgcctgcaatttacgcacagtttcttcgtgcagctctttggcatccggcgctttatggaaatagaggtagccgccgaacacttcgtcagacccttcgccggagagcaccattttaatgcccatcgctttgattttacgcgacatcaaatacatcggcgtcgaggcgcgaatggtagtcacatcataggtttcaatgtgatagatcacgtcgcggatcgcgtccagcccttcctgcacggtgaaatgaatttcatggtgcacggtgcccagatggttcgccacttcctgcgcggccttcagatccggcgaaccgacgaggcccacggcgaaggagtgcagctgcggccaccaggcttctgaacgctcctgatcttccacgcggcgcgcggcgtattttttggtgatagccgagatcaccgatgaatccaggccgccggagagcagcacgccgtaaggcacgtcagacatcaggtggcttttcaccgcctcttccagcgcattgcgcagctgttctttattggtgacgttgtctttcaccgcgtcatagtcgaaccagtcacgctggtagtagctgcggatctcaccatctttgctccacaggtagctgcctgccgggaactctttgatggtgcggcacaccggcaccagcgctttcatttctgaggcgataaacatgttgccgtgttcgtcgtagcccatatacagcgggataataccgatatggtcgcggccaatcaggtaagcgtctttttcgctgtcatagagggcgaaggcaaacatcccctgcaaatcgtcgaggaattccgggcctttttcctgatacagcgcgaggatcacttcgcagtcagagccggtctggaaggcataacgttcgctgtattcagcgcgcagcgcctgatggttgtagatttcaccgttaacggccagcgcatgggttttttgttcgttatacagcggctgggcaccggcgttgacgtcaacaatcgacagacgctcatgggcaaggatggctttatcgctggcatagacgccggaccagtccgggccgcggtggcgcatcagacgtgacagctccagtgcttttttgcgcagttcaaccgcgtcagttttaatatccagtacgccaaaaatcgaacacataaccttctccgttaaccctgtaatggtgcgttgtcttatcgcctgttaatgaaaatgccgcaaaggagcagggggcgcaagccttttagcgggtcggcaataaatagtgcaatgagcgttgtcgattcatgaaaattgcacaggagaagaccgcaataattaacggatcggtaattattgacgggttttattgaatggggtgatttacccgggaacgaaataatgcccggcagttcgcaggcccggcaagcatgcgccgccgggcaactgtgcatcagatcacgtcgatttcagcgacagacgggtaaatccagctcggacggaacggcatatcatcaatgtcatcaatctgcgagacgccggagagcaccagaatggtgtccagcccggcctggaaaccggccagaatatcggtgcgcagattatcgccgacgatcaccgtatgttcagagtgcgcctgcatggtgttcagcgccgcgcggatgatccacgggctgggcttgccgaccacgaacggcttgcggccagagattttctcaatgcccgcgcacagcgcgccgcaggccggatagaagccgcgaccgtgcgtatccgggttggtggcgataaagcgcgcgccgttggctacaaagaaggacgccttatgcatcatctcccagttgtaagagcgggtctccccgacaatcacaaaatcaggattgatatcggtgatagtaaatccggctttatacagctcatggatcagcgcgccttcgcccaccacgtaggctttttttccttcctgacgcttaagaaaatcagcggtcgccatggcggaggtgtaaaacacgctgtccggcacgtcaatgcccgccgaggcaaagcggttcgccagatcctggccggtttgtgacgggtaattggttaacaacaccagcggcatgcctttttccatcacccgcgtcaggaactcagcggcgcccggtacagcaacgttgtcatgcatcagcacgccgtcaatatcacaaattacattcttaatggtcatggactacccggataaaaaatgaaggcccgactatatgatcgcctcagctttccagcaaccgttgcagcagaatgccgttaagcatggcacgtttaaccagcgcaaaggcgccgatcgccgagcggtgatcgagggtcgagcgcaccaccggcaggtttttacggaacgcttttaacgcctgggtattaatgcagccttcaatggccggcagcagcactttttccgcctcaacgatctcaccggcaatcaccactttctgcggattaaacaggttaatggcgatggcgatggtttttccgagatgacggccaacatattcaaccacttcgcaggcgaggggatcgcctttgttggcggctttacagatggctttgatggagcagtcatccagcgtcacgcggctctgatagccctgttccagcagatgacgcacgcgctgttcgatagcggcgttggcggcgacggtttccaggcagccaaagttaccgcagtggcagcgctcccccagcggttccacctggatgtgcccgatctcgccgacattaccattacggccaataaaaattcgcccgttggagatgatccccgccccggtgccacggtgcacgcgcaccagaatggagtcttcacagtcctggcttgcgccaaaatagtgctccgccagcgccagactacgaatatcgtgaccgacaaaacaggtgacgttaaaacgtttttgcagcgcctccaccagcgcccagttttccacctgaatgtgcggcatatagcggatcacgccgctttccggatccaccagccccggcaggatcaccgagatggcgatcagttcgcggattttgcgctgacagctctctataaaggaagcgatggtattcagcaacgcatgttccagcgtttcctgggtgcgttccggcagcggataatgctcttctgccagcgttttgctgctcaaatcgtacagcgtaagggtggtgtcatgacggcccagacggacgccgatggcgtgaaaattgcgggtttcggtaacgatggaaatcgcccggcggcccccggtggaggcctgctggtcgacttctttgataagcccacgctcaatgagctggcgggtgattttggtgacgctggcgggcgcaagctggctgtgatcggcgatctgaatacgcgagataggcccgtgctggtcgatcaggcggtaaacggccgcactgttaagttgtttaacgaggtcaacgttaccaatttgagcttgtccgcctgatgtcattcttttacttacccggtgacgacctcgttaccattaacgatggtcttgattactttataatcgcgggtgaaggcggtcaggttggcgaccatccccggcgcgatactgcctaactgcttgtcaacgccaatggcgcgagccgggtagagcgtggccatgcgcagggcttcatccagcgcgatattcacatgctccaccagattcttaaccccctcgatcatcgtcagggcagaaccgctcagcgtgccgttttcgtcaacgcagagtccattccggtagtatattgttttaccagcaaaaatgaactgttcaatgtttgcgcctgccggggcagtggcatccgtcaccaggcaaagtttctcgcctttcagacgcttagcgagacgcacattactgtaatcaacatgtaaaccatcaacaataataccgcaataaatatctgcatcgtcgaggatagcacccgtcagacccggttcgcgtccggtgatgtacggcatggcgttgaataaatgcgtcgcaaagcgaatccctgcgcggaagcccgctttggcttctttcagggtcgcgttggaatgtccggcggataccacaataccggcggccgccagtttgctgatggtgtcgctgcccgccatttccggcgcgagagtgattttggtgatgacatcggcgttctggcagaggaaatccaccagcgcgggatccggcttacgcacgaattccgggttgtgcgtgcctttcttcaccatattcagccagggcccttccagatgcagacccagcgcctgatgcggatgcttcgccagatactcgcgcatcacgcgcacaccctgtttcatcagatcgtcgctggtggtgatcagcgtcggcaggtagctggtgcagcccgatttttcattcgcgcgctgcatgatttccagggtttcgatgctgacggcttccgcagtatcgttaaactgcacgccgccgcagccgttgagctgcacgtcaataaagccgggggccagtatggcgcctgccagtgaacgctgctcaatatcaggcggcagatccgccagcgggcagagacggtcgatcaggccattggcgacaataagcgcatggtcatccagaatttcatggccggtaaaaatccgacattgggttaaagcatacataacgacccccggtaaaaatggcgttccgtccttcacagatcgtagaggaaggacggaaacgtaattacagacctttaatattttcagcttctaattcgttgaaatatttcagcgttttaactttcagctccatggtggacggctcatcgcataccaccaccgctttcgggtgcagttgcagacagctgatggtccacatgtggttgacgttgccttccaccgccgcctgcagcgcctgtgctttcacgctgccgagcaccaggatcatcacttcttccgcatccagcagcgtacccacgcccacggtcagcgcatattttggcacctgatccacatcgccatcaaagaagcgggaattcgccacgcgggtatcgtgggtcagcgttttaatacgggtacgggaagccagtgaggacgccggttcgttgaacgcgatgtgcccatcgttgcccacgccgcccataaacaggtgaattttgccgtacgcgcggattttttcttcatactgacggcattctgcgtcaatatctggcgcattgccattcagcaggttgatattttctgcgggaatatcaacgtgatcaaaaaagttgcggtgcataaagctgtgatagctttccgggtgctctttcggcaggccgacatattcatccatattaaaggtgaccacgtgcttaaagctaacctggcccgttttatgcatttctaccagagctttatacgcggtgaggggagtgcccccggttggcagacccagcacgaacggacgatccgccgttggtttgaaggcattgatgcgattaacgatatgacgggcagcccattttccgacttgttcggcggttgccagggggatcagtctcatgtttcacctctacaatttagataaataaatggacgggttgggcattctgcctgctcttgtaagggtaacgcagtatagccgtcgagtggcaacaatccgtcttgattttttgaatcataaaataagttttgtttgttagccagcggaagggagggtaaataacgatatttggtgattttaatcacaaaaaaagggtgtttaatttgcggggcgaattaattttttacacactcattcagtaagtgaaaaatagcctttgcttcaggctggtcggactataaaaaaaactgcttgtgatgaagcctgacagggtttcatagggggaataaaagtgagtattttaggctatctgcaaaaggttggccgcgcgcttatggtgccggtcgccacgctgcctgccgcagcaattttaatgggtgtcggctactggattgaccccgtgggttggggtggtgataacgcactggcggcgttcttcattaaatccgggtcggccattatcgacaacatgtccgtactctttgccattggcgtggcgtatggcatgtcaaaagacaaagacggcgcggcggcgttaaccggctttgttggtttcctggtattaaccacgctctgctcgcccgctgcggtttccatgatccagaaaatccctctggaccaggtaccggcggcattcggcaaaatcagcaaccagtttgtgggcatcctggtgggtattatctccgctgagctgtacaaccgtttcagcagcgtagaactgccgaaggcgctctccttcttcagcggtcgccgtctggtgccgatcctcacttcctttgtgatgatcatcgtcgctttcattctgatgtacatctggccggtgatttttgatggcctggtgaacttcggtgaacagatccagaaactcggctccgtgggcgcgggcgtttacgccttctttaaccgcttgctgatcccggtgggtctgcaccacgccctgaactccgtgttctggttcgacgtggcgggcatcaacgacatccctaacttcctcggcggcgcacagtctatcgaagcaggtaaagcggttgtcggtatcaccggtcgttatcaggcgggcttcttcccgatcatgatgttcggtctgccgggggcagcgctggcgatttatcactgcgcgcgtccggagaacaaagcgaaagtgctgggtatcatgatggccggcgcctttgccgctttttttaccggcatcactgaaccgctggaattctccttcatgttcgtggcgccggtgctgtacgttattcacgccgtgctgaccggtatctctgtattcatcgccgccagcatgcagtggattgccggtttcggcttcagcgccggtctggtggatatggtgctctcgtcccgcaacccgctggccacgcactggtacatgctgatcctgcagggtctggtgttcttcgtgatctactatgtggtgttccgcttcacgatcaccaaattcaacctgatgaccccgggtcgtgaactggcggttgccggtgatgaatccgatggtcaggacgtgaatatcagcaccaatggtaaagatcaggacattaacggcctggcgcgtcagtacatcgcggcggtcggcggctctgccaacctgaccggtatcgatgcctgtatcacccgtctgcgtcttaacgtgaaagactcctcgcaggtcaacgaagcgctggcaaaacgcctcggcgcaaccggcgtgatccgtctgaacaaaaccagcgtgcagattatcgtcgggtttgtggcggaaaaaattgccaatgctatgaaaaccaccggcgatgttccggcagcgccggcaaccggtgccgctgccagcaccgcccctgctgctgccgcgccggttgccgcagcccaggccgtgccgaatgccgcgactatcgcgcagctggtatcgccggtaacgggtgaagtcgtggcgctggatcaggtgccggacgaagcctttgccagcaaagcggtgggcgacggtgtggcggtgaaaccaaccgataaactggtggtctctccggcggccggaaccattgtgaaaatcttcaacaccaaccatgcgttctgcctcgaaacggacaaaggcgctgagatcgtggtgcacatgggtattgataccgtggcgctgggcggtcagggctttacccgtctggtggaagagggcgcaacggtcacggctggtcagccggtgctggaaatggatctggactatctgaacgctaacgcgcgctccatgattagcccggtcgtgtgcagcaacatcgacgatttccgtggtctggtgatcaacgccgaaggtcatgtggtggcgggtcaaacgccgctgtttgaaatcaaaggctaatcacaccacgcagtgataaaggcggcgggatcatcccgccgcttttttttgcctgtcattcccgtaatcgcgctttttgtgcaacttaaaggttgtctcggcgtccggcttataagatcatatcccgttatacgttattgacgctttgaggaatccgcgatgagtgaggcagaagcccgcccgagtaactttatccgccagattattgatgaagatctggccagtggtaagcacagcaccgtgcacacccgttttccgccggagccgaacggttatctgcatatcggccacgcgaaatccatctgcctgaactttggcatcgcccaggattatcagggccagtgcaacctgcgtttcgatgacaccaacccggtaaaagaagacatcgaatacgtagactcgatcaaaaatgacgtgcagtggctcggttttcactggtccggcgacgtgcgctactcctctgattatttcgatcaactgcatcagtatgcggttgagctgatcaacaaaggccttgcctacgttgacgaactgacccccgatcagatccgcgaataccgcggcaccctgaccgcgccgggcaaaaacagcccgttccgcgatcgcagcgtggaagagaacctggcgctgttcgaaaaaatgcgtaccggcggcttcgcagaaggcaccgcctgcctgcgcgccaaaatcgacatggcctcgccgttcatcgtaatgcgcgatcccgtgctgtaccgtattaagtttgcggaacaccatcagaccggcaacaagtggtgcatctacccgatgtacgatttcacccactgcatcagcgatgcgctggaagggatcacccactcgctctgtacgctggagttccaggacaaccgccgtctgtacgactgggtgctggataacatcaccatcccggttcacccgcgtcagtacgagttctcgcgtctgaatctggaatacgccgtcatgtccaagcgtaagctgaacctgctggtcacggacaagcacgttgaaggctgggacgatccgcgtatgccgaccatctccggtctgcgtcgtcgcggctacaccgctgcggccattcgcgagttctgcaaacgtatcggcgtcaccaaacaggacaacaccattgaaatggcgtcgctggagtcctgcattcgtgaagatctgaacgaaaacgcgccgcgcgcgatggcggttatcgacccggttaaactggttatcgaaaactacccgcagaatgaaagcgaaatggtcactatgccgaaccatccgaacaaaccggaaatgggcagccgtgaggtgccgttcagcggtgaaatctggatcgatcgcgctgacttccgcgaagaagccaacaaacagtacaagcgcctggtgctgggtaaagaagtgcgtctgcgtaacgcctatgtgatcaaagccgagcgcgtggaaaaagacgcggaaggcaacatcaccaccatcttctgctcttacgatgcggagacgctgagtaaagatccggcggacggccgcaaggtgaaaggcgtgatccactgggtgagcgccgcccatgcgctgccggttgagatccgcctctacgatcgtctgttcagcgtgccgaacccgggcgcggccgaagatttcctcgccactctcaacccggaatcgctggtgatcaaacagggctttgcggagccaggtctgaaggccgcgcagccagaaaaagcgtaccagttcgagcgcgaaggctatttctgcctcgatggtcgccacagcaccgccgacaaaatggtgtttaaccgcaccgtaggtctgcgcgatacctgggcgaaagtcggcgagtaatcgcgtcaatctcaggctatcagaatgccggtcagtgaacgctgaccggcattttttatggccatgatcttctcactctcttccattcgcgctgcaaattaaactcagcgtttcctttccgagcgggcttattttccgtctgaacatcccccgtacagcgtaccgctcagccgcctgttgccagatgtaactttttatgtgcactgcgtcatagtctcatcttttccccggtaaattgtgttgataattcgcgacgcgaaaaataatctttatggcaccggaacggcgagtttatgactcataagcgacggttatatttaactttttttatttatcgcttctgcgcttgcaggcgaattttattatgtcaaagaggaaccattatgcgtacattcagtggcaaacgtagtacgctggcgctggctgttgccggcgtcaccgcaatgtcgggctgggggctatccgggcaggcgagcgccgccggatttattgacgactccacccttaccggcggcgtctattactggcagcgtgagcgcgaccggaaagacgttaacgaagacaaatacaaaaccaacctttcgcactccacctggaacgccaacctcgatttccagtcgggctatgccgccgatatgtttggtatcgacgttgcggcctttaccgccatcgaaatggcggaaaacggcgacagcggccacccgaacgaaatcgcgttctcctccagcaacaaagcctacgacgaagactggtccggcgataagagcggggtcagcctgtacaaagccgccgctaagtttaaatacggcccggtctgggcgcgggcgggctatattcagcccaccggacaaacgctgctggccccacactggagctttatgccgggcacctataaaggcgcggaagcgggcgctaacttcgactatggcgacgcgggcgcgctgagcttctcgtacatgtggaccaacgagtacaaagcgccctggcatctggagatggacgatttctaccagaacgatcagaaaaccaaagtggattatctgcactcgctgggcgcgaagtatgactttaaaaacgatctgctgctggaagccgccttcgggcaggctgaaggctatatcgatcagtatttcgcgaaagccagctacaagtttgatattgccggcagcccgctctccacctcataccagttctacggcacccgcgataaggtcagcgacggcagcgtcaacgatatctacgacagcaccgcctggctacaggcgctgaccttcggctataaaataggggatgtcgatctgcgtctcgaaggtacctgggtgaaagcggaagggcagcagggcttcttcctgcaacgtatgacgccaacctatgcttcatcgaatggtcgactggacgtgtggtgggataaccgttccgactttaacgccgacggtgaaaaagcggtgttcttcggtgcgatgtacgatctgaaaaacttcaatctgccgggctggcaggtgggcgcgtcttatgtttatgcctgggacgcgaaaccggcagagatggcgacgccggatgcatactacgatccgaattatcgcctgaaagagtcggcctacagcctggatgcggtttataccctgcaggacggtcgcgccaaaggcacgatgtttaagctgcacttcacccagtacgacaaccactccgacatccccagctacagcggtggctatggcaacattttccaggatgagcgtgacgtgaaatttatcgttatcgcgccattcaccattttctgaccccggcagttgccggatttcctcacccgctccgctgagcgggttttttttaaattttttttcccgccatttaatttttgctcccggtggtcgctttaccactacatctcgactgagacccataaaattcaaggagcaggaaaatgttatctattaataccaacgccgcctctatggccgctgtcaacgccatcaacaaaagcaatgcctctctgagccagtccatggaacgcctggccaccggtaaccgtatcaactcctctgcggatgatgcggcaggcaaacagattgctaaccgcctgactgcacagtctgacggcatggcggttgcccagcgcaacatcgccgatgcaactgcgatgctgcaaaccgctgacggcacctttgacgagatgaatgacattctgggtcgcatgaaagacctcgcaacacaagcagcgaacggaacctacagcgatgatgaccgtgcagccatgcagtccgagttcgacgaactgggtcaggaaatgtctgacatgatgcagaacaccacctacggcggcaccaacctgttcaacaaatccgccagcggtctgttcacccaggcatccggcgtgactttccaggtgggttctgaagccactgaccagatgaccgtcaacatctcttcccaggttgacgcgctgaccacgtccctgagcgccctgagcgcctcctttgcggatgacttcggtactgacggcgcaggcggcggcaccggcgtaagcggcactgaactgatgtcttctgcttctgcgaccgccgcgatcgacagcattcagaacgtgatgagcgcggttggcaaaatccagtccaccctgggtgcgtccatcaaccgtctgaacgacaccgcgaacaacctgcaaagcatgcaggacaacaccaacgtggcgatcggtaacatcatggataccgactacgcggcggaagcgtccaacatgtccaaagagcaggtgctgatgcagaccagcatcaccatgctgaaacagtccaacagcatgtccggcatggtttccagcctgctgcagtaatcggcctgacgtccagtcaaagcaccgccttcgggcggtgtttttttttgccgcccgctgccgcacagagggaaaaaaccttccgcgcgaagcggaaaacgcctttccgcctgtaattatcttattgattttaatgggtaaaattattggcatggcaattgctaattatgagccatgaaatctgaacggagcaaaaaatgattaacccgcagcagattgcgaaaaaattcgccctgatggatatctccaccaaggcatcgtcgctggcgcgccagcaaaacgacatcgatacccagaccagcgcgctggagagtctggacagcgccctgaccgccttccagagcgcggtggatgcgctgaacagcgagacgggcggcccggtggttaacaccgttaccgccaacaacgactcggcgaccattaccgccgactccaccgccgcggaaggctcttacaccttcttcgttgaccagctggccaccgcgcagcagtccacgctggcctttgccgacggcgatattccgaatagcggcactttcaccatcaccatgggtgacagtgaaatggacatcgatctcagcacggtcgattccagtggcgatggcagcgtatcggtggcagagctggcggatgccattaacgattcgccggacaatccgggcgtcaccgccaccatcgtcaacaccgatggcagcaccaccctgatgcttaccgccgatgaaaccggggcggaaaacgcctttaccgtctccgccagcggcgtcgatccggcgtcggcgttcgccaccgacatcagcaaccagaaagatctggcggtggcgcaggactcggtggtgtatctcggcagctcgccggaaaccggcgtgatgatcaccagcagcagcaacacctacaccgatcttattcccggcgtcagcatcaccttcgccgaagaatccgccgagggtgaacccctgactttcaacgtcaaaaacgattccggcgcctcgcaggaaaaggtgcagacctttgtcgatgcctataacacgctggtggataccctggacgcgctgaccaccaacggcggcggcaccggatcggccgggccgctggcgggggacgcggggatctcctcgctggagcgccagatcgaggacattacccacgccagctataacggcgtgtccatcgtcgactacggcatcacgctggatcctgacgggcacctgcaaatcgacagcgaaaaattcgacgaggcaatggaagaaaacccggacggtctgaccgcgctctttgtcggcccggacagcatgaccgcccagctcgacagcctgatggagacctggcttgacgacaccgacggcatcatctcgcagcggcagagcaacctcgacgacaaacaggaaaaagtcaccaacagcgtggatgacctgaagacccgttacaacacctcttacgaacgctatctggaggagttcacctccacgctggttgaaattgaaagcatgaaaatgagcatggcggcattcatgtaagtcgccgtccgaaaaggtcaaaacaacgatgtacgcttcagataatggttacacccaatacaaagagatggatctggccgcccgcaccgcgtcagcttcgccgctggatctggtgctggtgctctacgccgggctgatggacgagctggaacgggcaaagagccatatcgaaaacaaacgctacgagcgcaaagcgcaaagcatcaacaaatgcatcgacattctcaatgccctgaccagctcgctggagtttgaaaacggcggcgacctggtgctcaacctcgcgcggctttatgaccactgcgtctaccgcctgtatgaagccagcggccagatgtcgacggcgaaagtcgacgaagtggtgctgatcctttctaacctgcgcgaaggctgggaaggcctggcgcaaaaactgggctgatctatgacaagcaacgcactacgcctgcaaatagagagtctgctggacgcgatgaacgagagcctcgacaaacagcgctggcggcgcctgcccgcgctgcgccagcggctgatgatgctgtttgcgcagtaccgcgacgccgcgccttcccctgacgaactggcgcaggtgaaatcccgcctgcgcgacggcttcgcgcagataatcgcccgccgcgaggcgcgtgccgctcagcttgcggcgcggatggaaaagcaccgtcagcagcaggaggggcggctggcctattcgatggtcaatctggtggcggagcaaaaatcatgaaaaccctgtcattactttccgaagccatggggcaactgctttccgcgctccctgtgaagccgcaaggggagggcagcgcggcgggcttttcgctgcctgacgatcatcatcgcaagcacgctgaaaagccgcatccggcggagaaaatcattgccgatccgcgggaacagctggatctgctgctggcgcacttcctgacgccctctgccacagatcccaggcccgacgccgctgcgccgctgatgcagatggccgcccgcgcgggagagcagagcaaaaccgacgcgcagccgatgatcgatccgctcgccagtctgctgaccgactcgccaaaactccaggcggtgatggcgacgctgcttgctgcgcaaccgctcaccggcgacaccctgcagcagcaggccacgctggcgcgcagcgcggcggaaaatttgcaggctatcgcgccgcgccagacggctgcgccgcaggccgacgcgaagccccgcgtcatgcgcagcgctccccgcgtggagactgccgcgccgccgcgccacgacaagctcacgccgtccgtactggcgagcaccacctttacccgtgaaatgcgtccgccgcaggaattcgatgcgcggacgcagccgctgaacctgtcaaccgacagcgcggagtggggcgataagctcaccagcctgctgaaagatcgcatccactttcagatcggtcagcagcagcaaagctccaccattcgtctggatccgccgtcgctcggcaagattgagatcgccatacatatggaggcgggcaagctggtggtgcacatcggcgccagccaggcggatgtctgccgctcgctgcaacagctcagcgacaacctgcgccagcagctcaccgggcagaactttgtcggcgttgaggtgcacgtctcgcaggatgggcagtcgcaacagcagcaggaaagacagtcacagcagcagtcggcgcagatccgctctgccgtcgaactggaagaagaagatacccccacccgacagaatgattctgtcctgatcaaagtgtagaggcccatgaaaaaaacgcttatggtcggcatgtttgccgccactctcgcgatcctcgtcggcggcggcgctgccgtcggcgcgatttattatatgaaagaccaggccccccaggcgtcaggtgacgcggcggctgccagcgcaacgaaactgaaagcgaaaaaagagggtgatgacgtctttgtcaccctgccggaatcgctgatcacgctgcacgataatagcggcaacgatcgttatatgttgctggaagtggcgatggtggccgacgatgaaaaagcctcgaaaaaaatcctcgccgacgagccgttatatcagagcatcattgtgtccaccttatcggatatggaatacgacgaggtgcgtaaattaaaagtcagtgaaataaaacaaaccctgctcaccgccctgaaaacgcagttaaaagcccgggatatttccgcgccctacagcgatgtcttactgaaaaaagtcgtttatcagtgatcgccggaaaataacggaaataacaccatgacacttgcctgggaaatgcaggacttccagaccctgccttcattaacgcccgcggaggagagccactatttacaggcttacctgccgctggtgcgcaaagtggttcgccagctcgcgccgcaatgcagcgcggtgatggaccggcaggatatggaacagatcgcgctgatgggcctgctggaagcgatccggcgctacggcgcgccggatacgggatttggcggctacgcggtgcagcgcatacgcggcgcggtgctggatgaactgcgcagtctggactggcgtccgcgctcgctgcgacaaaaattccatcaggtcaatgacgccatccgcgcggtgcgtaaaaccctcgggcgcgaacctgaggcgcatgagctggcggctgaaggcatcacggcggaggattaccgggaatacctgagtctggaaggggcgggcagcctcgcaagcctggatgaattgctggatgccgatcagagcgccgtaccgctggaaagccgtcggctggaagagcaggtgatcacccagcatatgctcggtaaagcgctcggcagccttagcgaaaaagagcagcagatcctgtttctttattaccagcaggatatgaattttaaagagatcgccttagtgctcgggctgacggaagcgcgcatttgccagttgaataaaaagatcgcgcaaaaacttaaagattatttcgccacacattaattcttctttacgtaataagagcctgccgcgcaggttcgcagaggtgttatgcaaaagttatttggtttactcattgtcttaggttgcgtatttggcggttatttcgaagcgggcgggcagttaattgctatctggcagcccgcggaaatcgtcattattttaggggccggttttggcgccatgatcatcggtaatccgctgcacgtcttaaaagagatcgtccatcagattaagggcgtgatcagcaaaaaaaatatgggcgcggaatttcagcgccagctgctgatgtgcctgtatgaactgctggaagcggtacagaccggcggcctgcgcaccctcgatcagcatatcgaacagccggacgagagcactatttttcaaaaattcccgctggtgcttaagcaaaaacggctggtgatgtttatcgccgataacttccgcctgatggcgatgggtaaaatcgacgcccacgagctggaaaacattctcgaccaggaactggtgaccattgaaggcgagctgatggcgccgtcccgctccctgcaacgtaccgcagaggccatgccaggcttcggcatctgcgcggcggtactcggcattatcatcaccatgcagtccattgacggctccattgcgctgatcggcctgaaagtggcggcggcgctggtggggactttcctcggcgtgttcttctgctactgctttatggatccgctggcaaacgccatggagcagcaggcgcgcgccgaacactcgctgctggaatgcgtgcgtaccgtgctggtggcgcaggcgggcggcaaaccgaccctgctggcggtggatgccggccgtaaattgctgcacctggcgtcaaaaccgacgttcgccaatctggatgcgtgggtgaacgccatgctggagcaggaggagtaatgcgccctgccaaccgccgcaaccgtggcacgcaaaccaccatcatccgccgtcagatcaaaaagagtcacgccggacaccacggcggcgcatggaaagtggcctttgccgactttacgctggcgatgatggcgctgtttatgacgctgtggatcgtcaacagcgtcagccagaccgatcgcgaaaatatcgtcgccgcgctgcacggccactccatttttagcggcaatggtatttcgccgttaagcagcctggcgaagaaaatcaacagcaaacccattccgcatccgggcgagaacaaaaatgccgccattgataaagagagcgaagaaaaagcgcgggaaaccagcaaaaagatggcggagatgaagcaaaaatccgccagcgaactgggcgagctggcgaacagcatcaatgagatcgccctgaaggcgcacatggagagcaacctggagatggagatcgtcccccaggggctgcgcattctgatcaaggacaaccagaaccgcaatatgtttgagcgcggcagcgcgaagatcatgccgttcttccgcgtactgctcagcgagctgacgccggtgtttgactcgctggataacaaaatcattatcaccggccataccgacgccatgccctataaaggcgatgcccggcagtataacaactggaatctttccggcgatcgggcgctgtcggcacgacgggtgatggagcaggcgggtatgccctcaggtaaagtgatgcaggtcagcgccatggcggatcagatgctgcttaacgcggcagatcctgccggggccgataaccgccgcatcgaaatcatggtgctgacccactccgccgccgacaccctgtaccagttctttggctcgcagggggagaaggtggtgaaaccgctggcggcgaagcttgaccagcaactccccaaagatccctgagttatcaccttaaacgcttatgttcgcattcagagtaaaaaccctcgtgctgctgacgacgcttgtcgccagcggtaacgccttttccgcccctcacgcgccgccggtgaagaaaactctcagctatgccgcgcgccagcgccagcataaccgcgaactgttacgcacaaggcagcaactgaaaatcgcccataccacgccggtggtgcggggtaatgcgcaggcaaaagcggccctgcgcgcgcaaaaccgccgcaggctggagcagcatccggaatggtttaccccgatgcgcgcccatttgcaggacggcaccggactggtgagcaacagctacctgctgcacgtgaccgataccatcatcaaccgtctgcaacagcagctgggcaagccttatgtctggggcggcgagacgccggaggagggattcgactgtagcgggctggtctattacgcctataacagcatgctggcgaccagactgccgcgcaccgccgatcagatgtaccacttcccgcaggcgcgaaatatcgccgaccgggatttacaacgcggcgatttactctttttccgcattcacagcgatcataaagcggatcatatgggcgtctatctgggggacgggcgctttattgaatcgccgcgtaccggggagcggatccgcatcagcgatctcaataccgaatactggcagcggcattttctgggcgggcgtcgggtgattatgaataacaccgtgcgctgatcaattaaacgtcgacaaggggaagcagacagacgaagaacagtaagatgaggataatcaccaccacgtcgaccagacttaccacgccgcccgcggcggcctgcgccgcttcttccgcacgggctttttcccgcaggcgtttcacttcctgctcgcggacaaattcttccatcgatttatagtatcgatcggtcggaatgcggtgcgggtccttatttttctctgacattatcctcatccctggatgatattactgagatccttttccctggattgtctcagatttaccttcagggccatagcgatggcccgattaatgataacgaattgataattaattcaggtggccgaggatagtcagttccagctcatccggcacttcgttataggaaagcacatgcagtcccggcgcgaacagtcgggcgtagcgggccagcaacggtcgcagttgcggcgcgaccagcagcaccggctcttttccggcggctttcatctgctcctgcacctgcggcatattttcctggaactgggtgagcatattcggctcaacaggcacgctgtccagcatcaccttgccgccctgttgcgcctgattgaccacgttttgcagcagattttccagttcaccggcgagggtatagaccgccagcgccccattacgcaccaggttatgggtaatactgcgccgcagcgccagacgcacatcggccaccagtaaaatcggatctttcgacaccgcgccgctcgccaccagcacggtggcaatggtgacaatatcccgcagcgacacgcgctccatcagcaggctgcgatagaccttcagcaactggctgtaattcagcacgccgctgagatcttccgccagcttcggggcctgcgccgccagccggttatgcaactgggtgacatcgtcatagttaaacagatcgggaatatggctcagcagcactttattaaggtgggtggcgatcacgctggcgctgtcgattacctgataccccagattcagcgccttcgctttttgcgccggggtgatccaggtgaccggcataccgtaggccggatcgttacccagcacgccgtcgatttcgccataagtttcgccggagggcagggccatcaggcggtcggcgacaatatcgccgccgtcggctttaatatcgttaatgtaaatggcgtactgggtgggcttgaggcgaaagttttcacgcacgcggatctccggcagcagtatgccgttgctctcggagatcacctgccgcacgccgcgaatgcgctgcgtcagcgggctgcctttgcttttatccaccagcgacaccagcttatagccaaggctgatactcaccggctcaatggtggggatggtctcccagctcacctgctgctccggcgcttccgtcagggttttactgagcgtggtaaggctttgtacttcggcttctgaggctttgggctgcttgctctgacgccaggcggcgaaggccagcagcgctgaaaacgccaggaagggcaggtgcggcatccccggcacgatggcgagaataaacatcacgccgctggcagtgtaaatcaccgatggggtggccagcagctgctttttgatctcgcctgcgatctcgccgctgtcgctgacgcgggtgacgatgatcgccgccgccgtcgataacagcagcgacgggatctgtgccaccaggccgtcaccgatggtcatcagcacgtactgagagaaggccgcgtcagcgcttaaattgtatttaaagatgccgatgcacacgccaccgatcaggttgatggcgaggatcatcatcccggcaatggcgtcgccgcgcacaaacttcgaggccccgtccatcgcaccatagaaatccgcttcgctggtcacctctttacggcaggcctgcgcctgcgcctgattgataagaccagcgttcagatcggcatcaatcgccatctgtttaccgggcatggcgtcgagggtaaagcgcgcggacacttcagaaatacgctctgcgcctttggtgacgacgataaagttgatgatcatcagaataatgaacaccacaaaaccgaccacaaagttaccgccgatcaccacctgaccaaacgactcgatcaccttaccggctgcgcctatcccttcatgaccgaacagcagcaccacgcgggtggaggcgacgttcagcgtcaggcgcatcagggtggtgatcagcaataccgttgggaacaggctgaactccagcgggcgttttgtcgagacgctcaccagcagcaccagcaccgccagcacgatgttaaaggtgaaaagaatatccagcagcatcggcggcagcggcaaaatcaccatcgccagaatagacaacagcaccagcggcacgccgagatgcccggcccgcacggtcgtcagaagttgcttaatgtttttctgcatcctgtttcagaacctctttagggatggaaatatgtcggttaagttgcggcttgtcctgcattccggcgcgccaggatttaagttgcaggacataggtcagcacgtgggcgatggcgcggaaaagctgatgagggatctgctgattaagctgcgtggtgaagtacaccgagcgcgccagggtggggaattcgacgatctcaatcttgtgctcctgcgccacctcgcgaataaagcgcgcgatgtcgtcggtgcctttcgccaccacaaagggagcggcggcgcgggtggtgtcatatttcagcgccacggcgtaatgggtcgggttggtgatcaccacgtctgccgcgggcaccgtacggcggatctgccccatggcgatctggcgctgcatgcggcgcactttggctttgatctccggattcccttcctggtttttgtactcctctttcacttcctgtttggtcatcttcagcccgcgggtaaacaaatgtttcgccagcggaatatccagcaccgcaaagagcacgaacagcatcaccatgttctgcatcacgctggcgtataacgacagcccgtggtgcacggcgctggcaaaatgctgtgattgcagcgccataaaggcggcaaaattgtggcgcacgctgaaccacagcagcgccagcactaccaggcttttcagcaccatcttgccggtttcaatcaggtgatctttggaaaacagccgcccgacgcctttgatcgggttgatcttattgaggtccggtaagatctttttcggcacgaacagccagccgccgggcaccagcgacgccgccagcgccgccagcggcatcggcgtcagggtcagaatgaacttcatcaggatcagcaggttatgctgcaaaaactgccccagtacatccggattgttgatctcctgcgcgtactgatggacggtaataaagccttcgcgcacaaaatcgcagtaccagggaaagctgttcaacagcacgatgaacgccgccagcagactggccgccagccccatatctttggagcgcggcaactgcccgtcctgtcgcgccttacggcgtttctgcgccgagggcttttctgttttttcatcctgcgaggcgtcagccatggggcactctcagggcgtcaaactggcttaaaacaaaattcgccagatgcagatagtgatccggcagggtgtagagcagtgcggcaaagcacaccagtcccgccagcatgttgatgggaaaaccgagggagtacaggttcagcgccggggacacgcggttgagcaggccaaacccgccctgtactaccagcatgataaaggtggtcggcagcgccagcagggtggcggaggcaaacacccagcccaggcccagcgccacgctgcgcagggtctgcggcgtcagggcgttgccaatcggccagtagagaaagcctttataaagaatgctgaccagcagcagatgcccgtccatagcgaaaaacaggatcgcggcatagatatagataaactccgccagcacggtggtggacgcgccgctgttgggatcgttcatcaccgccatgctcatccccatattaaaggagaggatctgcccgccaagctgcagcgccagaaagacaaactgcatcatcaggccgaacagcaggccccagaggatctgctccaccgtcaggatcagcatcgacatcgtcagcaacccctccggcaccggatgcggcaccagcggggtgatcatcaccgccagcgccagggagatcacaatgcggatgcgcacgctgaaggctttgctgtcgaacaccgggccatagtggaaaaaggccataatgcgcacaaagggataccacagccccagtaccaggttcatcagttgcgtgatagtgagcgtggtcatctcagttcaccagcagcgcggcctgggcaaacaggtgggtacagagatcgcttaactgcacgatcatccatttaccgcagacgccgagtacgatcagcgtgacaatcaggcgcggcagaaagctcagcgtctgctcgttgatctgcgtgaccgcctggaaaatacttacgcacagcccgaccagcaggctcggcaccaccagcaccgaaaccagaacgatcaccaccttaataccgctggcgacgagatccgccgccacatcaacagttatcatgatcagcccagccccagtccgcgaatactgctggtgagcgtgcctacggtcagcgcccagccgtcaatcagcacaaacagcatcagcttaaagggcagggagacgatcagcggcgacagcatcatcatgcccatcgccatcagcacgctggcgacgatgagatcgatgaccaggaaggggatgtaaatcataaagccgatctggaaagcggttttcagctcgctcagcacgaaggcaggcaccacaatcgacagatcctgatccgccgcttcacccttcgcgccgccgatggtcatgatctgcgccatcgcctttttattggtctgcgccagcataaagcgcttgaggggcgaggcggcggtggagagcgcctgcggcagggtgatctggtcgttttcaaagggcaccaccgcatgatcgtaaatattcagccataccgggcgcatcaccagcagcgtcagggacagcgcgatgccgatgagaatacggttcggcggcgtctgttgcaggcccagcgcctggcgaagcagcgacagcacgataataaagcgcgtaaagcaggtcatcatcaacagcagggtcggcagcagcccgaccagcgtcatcaggatcagcacctgcatcttgacggtcatatcctgggtcgcgccgtgcgtcgccacctgcaacagcgtgatgtcgcccccctgcgcgaagacggccggagagagcagcagcacgctgccggaaagccagatcagtgagcgtttcatggcgtcagttcgttgatgtcccgggtattaaactccagcacccgcagaccatatttctcgttgaccaccaccacttccgcttttcccagcagaatattgttcactttgatgtccagcggctcgcccgccagcttgttcagctcaataacggtgtcatcatcaatgttcagtagatccgccagcatcacctcgacagaggacacttccagcgtcagggtgacggggatgcgtttcagcaggcccatggaatcggtgagcggcgcggcgggcgcggcaggggcggcaggggcggcttcaccggcgtcgtcagccagctcgaagccctgttcaagtaaatcgatctcgttagtcataggattttccggcgagggtttcgcgaatgtcagatagcagaagcttgtcgtgatcttcgacaatcagcgccttaaacagctctgactggccgatgaacacagggaatttgtcaggtaaagctaccgggaaaatatcgccggctttgatggtcgtcagatccgcgacgctgagggttaaatccgccacccgcacattcaggcacagcggcagggtatcgatcacctggcgcaccagcgctttttgcgccgcctgccgttcggcatgggtgtcggtgtgctgcggtttttcggttttgcgcagcatattgaggatgtaatcggtgtgcgcgttatccagcagcagataaaagttgcgcttgccgtcgtcgtccagctggaaggtgatttgccacgcccactggctgcaaatattgctgttatcggctttgatggccagcggcagcccgagggcgtcctcgctgaacagcatctggcagatatccagcgccagccggttgcgcaggcggatctccgttttggtcggcagccgctcgccgctggcggcgttttccagctgcgtctccaggccataaaaattattcagcagggtgagcagcagcgggcgatcgatatcaaaggccagattacccaccggcgaggccagcaggtccgcctgtttatttctgacatccattttgcagccgatttttttcaggctgacgctggagcggtgttttttcaggaaatagctaccgatacgcgactcaataatgtcaaagcggcgggtgaacatattcggcaggcgatgccagggacgaccgagacggtttccctccagcgtgaatattccacgggtttggctgtacttcaacattggtgttatatctcttggtgaataccggcgcacagaaaaactgtttatgagaacaagctcacattctgataattaaaacagtctgacctttaattttctctttatgattgtcgcctgtacttatcaggccgtacataaaagagaagtcgcatttaaccggaatgaggtaaaaatcacaatagcgcctgcggtcaatattattattaatctgttattaatcagggtggcttattattgctgcgcctttgttatgcctgttgctctgctgttttattaattaattggttgatttttaagcattaattattttttgatttattaatttccgctgtttccttccgcttaatgatattgttctctcgtgatttatattccacccgctatcacctttatacataactgtgagagaaaaaatgccgactcttattgctgaagcctccgccagcaggaaagctttttcattagcaaaacgcgttgccagttttaatatcccggtattaatccagggcgaaactggcgcaggtaaagagtgcgtggcgaaatatattcacgctcatgcctttggcgaagataaagacgcgccctttattggcattaactgcgccgccatcccggaaaccatgctcgaatcgacgttattcggctatgaaaaaggcgcttttaccggcgcggttaatgccgtgccgggcaaactggaaatggccaataacggcacgttgctgttagatgaaattggcgatatgccgctggcgttgcaggccaaactcttgcgcgtattacaggagcatcaggtggaacgcctgggcagcaatcgcgccatcaaactcaatttccggctgatcgcctgcaccaataaaagcctcgaagcggaagtggccgccgggcgttttcgcgaagatctgttttaccgcatttcggtggtgccgatcagcgtgcccgccttacgtgaacgggtgggcgacattctgccgctggcgcaggcctttatcgaaaaatattcccgcatggtgggcaaatccatccgcctgtccgaaggggcgaaaaccgccctcttgcagtaccgctggccgggtaacgtgcgccagctggaaaacaccattcagcgcgggatgattttaagccaggacggggtgatccacgccagcacgctgggcattccgctggcgcaggaccacgggcaggcgccggcgcgcaacctcagcgacgtcctttgcctgaatcaggacaacctgcaacagcatggccgtcacgcgcaatatcagtacatcgccgatctgatgcgccagtatcagggcaaccgcagcaaaatcgctgacttcctcggcattacccccagggcattgcgttaccggctggcctcaatgcgtaagcagggcatcgacctctgcttttaactgccgctatccatccctatttatcaacaagagtatgcaatgaatacgatcacccgcctcaccccgaacgccccgccgctccatatgatgcaggagatgaaccggatgcaggatcttgcgaatggcgttcccgttgccgcaggcgagatgcggccgggcagcgaagtttccttccatcagattttcagccaggccctatcccgcgtggacggcctgcaacaggacgccgaaatgcagcagaacgcggtggaaatgggcgacagcgacgatctggtcggcgcgatgatcgccagccagcaggcggcgctctctttttccgcgctggtgcaggtacgcaataaagtggcgagcggcgttaacgatctgatgaacatgtccgtataagcccatgaaactctcactctctgaacgcttttccgccccgttgtccgcccttacgacgctgatgggcggcaataaaaaatggccgctgcttggcggcgcggcggtactgctgaccgcggtgatcgtcggcagcctgtggcacagccaggcgggttataccgcgctgtacggcgcgcaggaacatctgccgctgtcgcagatcatcacggtgctcgacggcgaaaaagtggattaccgcattgatcccggttccggacaaattctggtgccggaaacccagctctctaagatccgcatgacgctggccgggaagggcgtgcaggcgctgagtcccaccggctatgagctgatggacaaagacgaagtgctgggcagcagccagtttgtacagaacatccgctacaagcgcagcctcgaaggggaaatggcgcagagcatcatgaccctcgacgcggtggaaaccgcccgcgtccatctggcgcttaacgaaagcagctcgttcgtggtcagcgccgaaccgcaaaatagcgcctcggtggtgctgcgtctgcattatggcagcacgctgacccctgagcaggtgaacgctattctgcatctggtgagcggcagcgtgccgggactgaaaacctcgcaggtgagcgtagtggatcaggcgggaaatctgctgtcggaagaggtcggcgaagactcgcgcaccggcgccatgacgcgcaaaaacaacgaactgctgaaaaatattcaggataaaacccacgccagcctcgccaatgtgctgacctcgctggtgggtaaagacaacttccgcatcagcgtgatgccggagctggacctgagcgccattgatgaaacccaggagcggctgggggatgcgccgaaagtcagccacgaacggctggaatccgacaagactatcgatccgcaggcggcgggtattcccggttcgctgagcaaccgcccgccgctggctgaaccccggaccgacagcgcaaaaaatgacagcgcccgttccgagcgcagcgaaagcgatcgcgattacggctgggatcgcaccatccagcacattcagcatccgggctttgccattaaacatctcaatgtggcggtggtgctcaaccagagcgccgccagcatcaaaagctggacgccggaacagatagcccaggtcaccaccatgctgaataacgccgccggtatcgatccggcgcgcggggacaaactctcgctgtcgatgctgagctttatcccccaggccgcgccggtcatcacgccggaaaaatggtggcagaacgacagcattctcggctgggcgaagctcggcggtctgatactgctcggcctgttactgctgctgatggtagtgcgcccgctggtgcgtcagaccatcgccagccagaaacgccgtgcggaactggcggcgcgcccggtcaacgaaccggacgacgccacgctgcccgcgatcgccgccaccggcgaagacgagcgcaaaagtatcgagctgccgacgtttagcggggatgacgccttaccggcgcagagttccggcctggaaattaagctggagttcctccagaaactggcgatcagcgataccgatcgcgttgccgaagtgatcagacaatggattaccagtaatgagcgaattgacaataaataagcccggcagcgcgggcagctatctggagcaggcggcgattttgctgctgtgcctcggtgaagaagccgccgccaccgtgatgcaaaaactcagccgcgaagaagtggtgcgtttaagtgaaaacatggcgcgtctgtccggcgtaaaaaccagccacgcccggcgggtgatcaacaactttttcgacgaattccgcgagcagagcggcatcaacggcgcgtcccgcagcctgttgcagggcattcttaataaagcgctggggggcgaaatcgccagcagcgtcattaacggtatttacggcgatgagatccgctcgcggatggcgcgcctgcaatgggtggagccgcgccagctggcggcgctgatcgccgaagaacatctgcaattgcaggcggtattcctcgcctttctgacgccggaaatcgccgccaccgtgctggcctttatgcctgacgcggtgcagaacgagatcctttaccgcatcgcccgcttaagcgacgtgaaccgtgacgtggtggacgagctggatcggctgatcgagcgcgggttgtcggtgctggcggagcacggctcgaaggtgaaaggcatcaagcaggccgccgacatcgtcaaccgtattcagggcaaccagcagcagatcctcgaacagcttcgcgatctggatgaggaggtgctggagcagttgcaggatgagatgtacgacttctttatcctcagtcgccagagcgaagaggtgcgccgtcgcctgctggatgagatcccgatggaagactgggcggtggcgctcaagggcaccgaagcggcgctgcggcgttcgattttcgccgtcatgcccaaacgccaggcgcagcagctggaaaccatcacctcccgcctcgggccggttccggtcagccgtatcgatcaggtacgccgtgagatcatggcggtggcgcgggaaatggaagaagcgggcgacattcagcttcagctgtttgccgaacagaccgcagaataggagacacgccaatggatacgcttcgcggccgctaccgggtataccgtttcccgccgcgccacaccatttctgccactgcgcccgccgccgcagggctttctgcggctgactttcagcgtcagttgatggacggctttcaggaagggctgcaaaaaggctttgcccagggcctcagcgaaggccaggcgcagggacatgcagaagggctgcaacagggtcaggaagaaggctatcgtcagggtttcgcggagggcagtctcgccggtcagcaggaagggcggagccagtttaatcaggccgccgcgccgctggaggcaattgccgcccgcctgaacgactatctggcgcactgcgaacgcaaacaacgggacgacctgctgcaactggtggaaaaagtcacccgccaggtgatccgctgtgaactggcgctgcaaccgacgcaactgctggcgctggtggaggaggcgatcaccgcgctgcccgccgtgccggagtcgctacaggtttatttaagcagcgaggagttcgcccgcattcagagcgtcgccccggcgaaagtgaaagagtgggggctggccccctccgccgatctccagccgggagagtgccgcgtggtgacgcccacctccgaactggacgtcggctgtgaacaccgcctcgaacagtgcatgagcgtgttaaccgacacgctggtgccggatgcgccggatgcgtgacgatccgctgtttgacagcgccctgcgctccattgaatccatttctttcgcccgcgtcgccggacggctggtgcgcatgaacggcctgctgctggagagcgttggctgcccgctggccaccgggcaactctgtcgggtggaaagcgctaatcgcgagctgatcgaggctcaggccgtcggctttaaccgcgatatcacctatctgatgccctttaaaacgccctccgggctgatggccggggcgcgcgttttccccgaagagaaagcgcaggagatcctgatcggcgaaagctggctcggcagggtggtgaatgggctgggcgagccgattgatggcaaaggcaaaaccggcggcagccatctgttagcgccgctcgcgcccgccatcaaccctctgacgcgccagccggtggcggaaccgctggatgtgggcgtgaaagccatcaacggtatgctgaccatcggcaaaggccagcgcgtcggcctgatggcaggcagcggcgtcggcaaaagcgtgctgctcggcatgatcacccgtcagacgcgggcgcagatcgtggtggtcgggcttatcggcgagcgtggacgcgaagttaacgagtttatcgaacactcgctgggcgacgagggcctggcaaaatccatcgtggtggcggcgcctgcggatgcctcgccgctgatgcgcctcaaggccaccgaactgtgccacgccatcgccgcgttttttcgcgaccagggttatgacgtgctgctgctggtggattcgctcacccgttacgccatggcgcagcgggaaattgccctctcgctcggcgagccccccgccaccaaaggctatccgccgtcggcttttggcattattccccgtctggtggagagcgcgggcaacagtgacagtcatggctcgatgacggcgatctacaccgtgctggcggaaggggatgaccagcaggatcccatcgtcgactgcgcccgcgcggtgctcgacgggcatattgtgctgacgcgcaaactggcggaagcggggcactatcccgccattgatatcagccagtccatcagccgctgtatgacgcagattattcccgctgcccatcagcgcgccgcccggctgcttaaacagcattacgccgcttatatggaaatcaaaccgctgatccccctcggcggctatgtcgccggggccgacgctaccgtggataaagcggtaaaactctttccggtcatcgagcggtttttgcgtcaggagatgcacgaggcggcgcctctcgacgccgtacaggcgcagctcagcgcgctctttcccgccgctaaacaggcagaggtgaaaaaatgaagccaatgatcgccacccttgcgcagcttcagcggctgcgcgaccgcagagtgaaagacatcaccgtacagctcgccgaacagcagcagctgtgcgcccgttacgacagcaatatcaaagcgctcggctacctgttcgataaaacgcagattaacggcagcgacgcgccatcggtggaagttctcaaaaacgtcaccggctacaaaggcagtctgcaacgggtgatcgcctggcaggagcaggaaaaaaccctcgcgaaaatcaaagccaaccgcatacagaaaaacctcgttcgcgccgcctgcgacgaaaaaatcgtcgcactgaccctcaacgaccagcgccgggcgctgaggcaggaacagcaaacccacgcccagaaatcgctcgatgagatcgccagccagtgctggctgcgccagcgtaagcggccggagtaaagtcatgcgcaccgtcattacttttggcaccttcgatgtctttcacatcggccacctgcatattcttaaccgggcaagaaagctcggggatcggctggtggtgggcgtgtcgtccgatcaactgaaccggcaaaaaaagtcgcgcgccccgctctatgatgagcaggcgcggctgcaaatcatcagcgcgttaaaatgcgtcgatgcggtctttcttgaacaggcgctggaattaaaacgcgcttacatccgccagcaccaggccagcgttctggtgatgggggatgactggcaggggcgctttgacgatctcagggatatgtgtcaggtaatttacctgccacgtaccccttcggtttccaccacgtccataatcgaactggccggacgcgttctcagccatccttaaaacagtttctgccgcaggctgtgcagcaggctgaaggcctgcggatcggctggcgtatccacggcggccatcaggcacgccgcggcgcgttgcccggcgttaccatcccggaaggcgtcacaataatgatggcgaatgtcagcaagcgccgcctcccgcgaggcccagtcagagtcagcggacagctgctggcgaagctggatcatatcgccggccaccggcagcagcgcgcggatcttttgctcggcgctgtgtggattgctgtaagtcacatcctgagccagcagatcgtccatccccgcccagtcgagcaaaataacccgtttcccggcgtggatggcatcgaaaataaatccgctgttatccgtcagcacatagtcggcgcacgccagcaacggcagggttaaatcatggcgggtgacgcattttttgaaatggcgtttgattaacgccaggtcatccgcctcttcgacgcggtgcagcgtgccgtggtgcagtttcaccaccaggttatattcacggctcagacgtgacaacgatcccgcccagtgcggtatagagcttaacgtgccgaaactgggggcatacagcagcgtcggtttttttgtatccagccgcaggcctgccagcgccgacagatccacgtcaccccgatgccatttatcgaagcgcggattgcccaccaccactgcattgccattgatgttcagcgcctgctggctgtagtggctgaagcagagaatatggtcataaaaggcgttccaccaggcatgattccaggattcttttgccagaccatacatcgcccgaacctgcacctttgccagcgatttcagcatcggcgtgtaataggggctgaccaggcaggcatactgctggcggcgattgatcgcctcgctaaggcggctgccgctgaggcgcggctcatccagcgccgccagcaactgctgcagttcatgacgcaatccctgcggcacctgatcgcttaccagcagatcgcagggataaccggccgcaagcagtggagcgatcatcggctgataaagctgataatgaaaggcggtttccagaaaaaaaccgatggttttccccagccggtttgccaccggcggctgttgcgctttacgtttttccgccaggtggttaccgcccattttgctgaaatagaaatggatatggtcagtatctttttgctcgatatcgctgaagccaggccgctgatagctgatgcacgggtagaaggaaagccactttccgcgcgcctgtaacggctgccagcgcgcttccagttggatggccggatcttcctgcagctgtttgagcagcgccgggtaataaggccggttgaccagatacgcgcagactttttcgctgtcgctggcgcgtaccatccccggcaggcttttcatcggctggccctttgtcacctgcgcgccgagcagcaccacttcccatgcaagatgcggcagcgccgccagcagcgcgttcagtccgctgatatgtttttcctgcctgagcagcagggcgtcatcctccagcaccagcacgctggcaaagccttcatcctgcgccatctgcaacgcctgctgatgcgagcgcgtgcggcccagcgctggctgcggatgctcgcaggcgctcacgcgccgcactttatctgccggaacctgaagcgccgccagtgtttgctgcatctgctgccagcggtcggtgcgggcatcgcggttgatgacaaggattttgtcgatacgcgaccactgcaccggctgcccgccggtggcattgtgcaggctctgataccaggcccgcagcagcggatccgtcaccacctcttccagcgtctggctgacgggctggctgctgccgaggataaaatctttatcgaaggtgttctggctgtgagagatgcacaaaatagtgcgctcgcacggcagctgtaaggggttgacggtgaaattatcggtaaaggcctgctcctcgccgaggttacagttatcgtcgtaacggtgttttttcaggtagttacggtgataagcgaaggtgccgttaagaatatgctgctcgccgaaggcgtgagttttaaagatgcgattaatatggctgtaccagatggggatccgatcggagccggaaatcagcgcgccatgacgctgcatcatactgacggtatacgacagcttatccgacggataaaaatcgtcgtcgtccatgcagacaatgtattccccgcgcgccagctcgttaagcatattgcgtttcttgcccagcgccagccgctcagggtgatggatatagcgaatattaaagcgcgccggatcgctgttcgtcagggcattaatagtgtcgatctggctggtgtcggagtcatccagaataatcagctcgcgccgatccgccggataatcctgatagcggaacatatacagcagataaggcagaaaggcggcgcggttccaggtgggcgtcaccacgctgacaaagggtagcgggcgagcgccgcgcggcgcggcgttgtccagcagcgtggcgatcagactgggttttggcgagagatgtgacatagcggtatcacctgaccagcagggagatcgccgtcagcagcggatccggttgatccgccagcagcgccgcgcgttcagcggtggctttttcatcaagacgccaggcttcgaaaacgctgaacaggctgatggcctgcgcatggctgatggtcgagccatccatcagccacaggctgaacagcgaacgcagcagaaaatagtcgctcaccaggtgcagatagcaggtcagcatgtcgtgatgatcctggcctggaaacgtctcatgatagaggcgatacaccagatagttggtccagatccacggcctgtccgcaaaggccttttggccttcacgcgcccacacgtccagcagctgttgctgcatcagggcttcgctgttggcatcagccagcgccagcaggctgagctgcaacggcaggctcattttgcgcgtgcagtccaccaggcgatcccagtcaaaaggcagacgcccaaggctgccgatcagctggcgctgcggtccggcaatcaccggcaactgcgcgaacatctccgccagcgtgccgcgggcggcgtaacccgccagcgtctgcggcagcgatttcagtgtttccagcgcatcatcactgtcggcaggcaatttttgtgcgtaagagagcatcacgccgagggcgtacaggcgcaggtcaatgctcagatcgggcagggtgacaatatccagcgccgcctgattcagcacctgtaaatgttgcggcagcgccgccacgcccggcaccggctcggtcattttgacctgcaaaacgaacgcctccggcgagccgagcaccgcctcgcagcagtcgggatcgtctaacagcaggctacaacgcgcttcatgctgccagttgatcaccagcggctggcggatggcagcgggatgctgcgcccggtagtggcggataaacgccggttcgtaacactcaatctggttcataggattctcatacgcgccgggactagccgcggtagataaaatcgggccccgtgccgaggaaggtttgcacaaattcgtactgcatggtcagcagttcgccgtttttttcgttacagctctgacaggacgccgcctggcgctccagctgttgccagctctgttgtgccgcgtgtttttgtgccgcaggcagccagctgaacacctgcgcgatgccgtcgcggtcagcgctgacgccaaggtttagcagcgtctcgcggcgggcgcgggcgctgtcgctcagacgctgatagcgctggtggatggcgtcgttgacggcgagcagggcgtcgctgtcgcggcggatcatgcacaggcgctgttcgtcgagctgcgcgcgcagctgacggtaatcttcttcatcctgacggatgccgcgcagcaggctttttacctgctcaagtcgggtggtcatgggcatgtctcttacgactggaaaaaggccagcatcgaggcggccagcgcgtcggtgtcgacggtaaaatcgtctgaagccagcagcgcctgcatttctgcgacgcgtgtcgtgtcgacgttttcgctgtcgtcgccgtcaaggctggactgcgcggtgtgcaacccctgctgggtgatgtcctctgcgcccggcagggtggcgatcgtttgcgccgccgcgtccgcagattttttttgcgacgaggtggtcgtcgggcgcgaggccagcggcagctgtctgattttaatacctgactcgttagtgatggccatggtgtttactcgttgattaagcagggtttgtcctggcggcgggcggtgatatgccctgtatgctggtgtaaagcggcgcggagcgaggaaaacttaaacggggggaggggatttttttctggggggagattgcgctctggtgactattgcgtttggtaccgggtaggttgcgctcttactgacttcttagtacggctttaacagtgggtgcacagagcgcgcagggggcggccagtcgccgccgccccctgcacccccgggctcccggcaggaaaatcgccgcttcgcggtgccctcggcttatcccttccggcttcgggtcgggcgcgatgcagcgtccctgcaagtcgcgccctcagcccgcatccatgcgggctgccccggccgtaagtgaacgcctcagcgattttcagccggactccccacacttccagattttttataaacccaatatcgcggttcctgtaagttcaaataaacttcaagccactcagtcgtaacaaaccgtcatcgtaattaacgcgaggggttgagtccccgctgaaaccggcgagccggaggccggatgacaagggctggacgccatggatggcggccagaggcgaaatgaggcaggatgccgaatcgagccgaccgcgggcagacggccgggaggtgagcgcagtgcgcagcaccggtttctgtgcggggccgcggggattgctaagggggccgcggtggcccccttagcacgttcaccgtcagcggcgtcacgcctgacacgaaacgcaaagtgaacggaacattccaccacacttaaccaccccgctcactgcgccaccgctgccaccaccacccctggcgcctccaccgtcgcactcaccacccgctggctgctcgcattctgtaccttaatcacctccccctgatgcccgcttttcagcgccaccccgctggtctgcgcggtgatctccccgttgcgcgacaccagcgtcaccgcctgatcccgcttcacccacagcggccgaaccacatcgttcgccttcaccggcgtattcacccgcagcgcatggcgggcggtcaggccgagcacctcttccatcttcatcaccagctcaccacgttgattgctgatattaaattttttcagcgtcagcgcgtcagcggtcagggtttcgccacgcgcgatctcccgcgcgggcatcactaccggcaggtaaatatccgctttcaccgtcacggtaaagcgccagcctgccgccccaggacagagcacgctgtagccgaggcgcggcagcgttttcgcgctggcggtaaagatcggcggttgcgggcagggggccgcgctggcgacggcggcgggcataaagacgttgaagcgggaatggtaatcgggccactgcttttgcgcggccaggttctttaccgtctgctcagcaagctggatcgcgccctggttaatttgctgtcgcgcgctgtcggttatcaccgcgcaggcggggaatgtcagcagcagcagggccgccgtcagggcttccgccagcggaaaaggaaggcggaaaaaggctttccgcggcgacggggtattcttcataaaaactttacctttcaataaattaaaaaattggcacgccaattgcttaaagggccagccagtcagaatttagtgaaggagagttgcagaagaatgggcatcagttttcagcaagcatttggtgtacatccgcaggcagtggcgttacgtcttgagaggaccgagctaatcaccgccaacctggcaaacgtggatacgccaaatttcaaggctaaagatattgattttgccgccgagatgcaacgggcaaattttcaccagcctgcggcaaaggcggtggcgatgtaccgcgtgcccctgcaaccgagtcaggacggtaataccgtcgatctggacgcggagcaggcgcggttttcgcaaaacagtatggattatcagagcagcctgacgtttttaaatctgcaaatcagcggcctgcgcgccgctattgaagggaagtaaccatgtcttttgctgacatttatcagatttcgggttcggcgatgagcgcccagacggtgcgtctgaataccgtcgccagcaatatcgccaacgccgattcgcctgccgccagcgaggccgccacctacaaagcccgcagcccggtgtttgcggcggagtaccacagcagcctggcggcggcggggcatcatgagatgaccggcgccagcgtgcggctggaggatgtggtggaaaccggcaccgccgtgcgtcgctacgagccgcatcatccgatggcggatgagaacggctacgtctggtatccggacgtgaacgtcgtcgaacagatggccgacatgatgtccgcgtcgcgggatttcgaaaccaacgtcgatgtgctcaataacgtgaaaagtatgcagcaaagcctgctgcggctgggagaaaacgcatgagcgccacggcagtaaacagcacccagccgggcgcaacgacgcaggaaagtgctgcaacggtgagcagtaaccctggtgaccagaccaccacctccaccagcagctcgatggcggacacctttctgaccctgctggtggcggagatccagaaccaggatccgaccaatccgaccgacccgacggaatacatcacccagctgtcgtcgatggcgcaggtggcgatggcggaggagatgtcggtgcagatgaatactaacgcggtgctgatgagcaacatccaggtgatggccctcggcaatctggtgggcgatccgatcatggtgcagacctccacgctgagcgttgacgacagcgccattcacggtcgcgtaaccattgatgatgcctgtaccaccgtcgatctccacttcaccgacgaagccggtaacgactacgtggtgccgctgggcacgcagtcgccgggccaggtgagcttcgatatcgatccggcggattacggcattccccccggtgattacgaagtgtcggtggtgaccaacaccggggaagaagaagtaccggttgaggtggcgggcgtggtcaacgacgtgcgcattccgctggacggcagcacgccggtgctcaacgtcagcggcatcggcgaggtgcctttcaccatgatcagccagttcggcgtgccggatgatgtcgcgcctgccgatgacgttttggtttaacccttacaaggaacacaggattattttatgagttatgaaattgcagcaaccgggctgaacgcagttaacgaacagctggacggcatcagtaacaatatcgccaacgccgggacggtgggctacaaatccatgaccaccgagttctcggcgatgtatgccggcagccaggcgatgggcgtcagcgtcagcggcacggcgcagagcatctcccgcggcggttcaatggtctccaccggcaatgcgctggatctggcgattaacaacgacggctttttcgtcacctgcgacagcgcgggcaacgtctgttacacccgctccggttcatttaccaccgataaagacggctatatcgtcaacacctccggcgactatttgcagggctatccggtggatgacagcggtacgctgcaaaccggtacggtaaccgatctgcaaatccagaccggcaatattccggcgaaagctaccgacagcgtgagcttcggcgccaacttcgacgccagcgacgaggccatcgacaccgccgcggtgccctttgatgccaccaatgccgcgtcttacaacgacacctacaccaccacggtttacgactcgctgggcaacgagcacaccgtcagccagtacttcaccaaaacggcggataacacctggcaggtgcattacagctttgatggcgaaacgcaaagcaccaccaccgaactggtcttcgacagcgccggtaagctcaccagcccgaccacgcctgtggcactgagctttgacgtgccgggagcggatccgctgaccctgaccatggattacggcacctgcacccagttcggttcggaattcgctgtcagtaccaacagcgccaacggttacgcctcggcggagcagaacggcgtgcaggtggacagcgacggcaaagtttatgccacctacagcaacggcgagcgcatgttgcaggggcaggtggtgctggcgaccttcccgaacgaaaacggccttgaagcggtgagcggtacctcatgggtacagaccggcgaatccggcaccccgctgctgggcgtgcccggatccggggcctgcggcacgctgagcaccggcatgctggaaggctcgaacgtcgatattaccggcgagctggtggcgctgatgtcggcgcagcgtaattatcaggccaacaccaaagtgatctccaccagcacccagctggatcaggcgctgttccaggcgatgtaagacatggaccgtttactttttaccgccatgagcggagcgacccatgcgttgcaggggcaggcgatcagcgccaataacctggcgaacgccagtaccacaggttttcgcgccgatctggcgctgtcgcaaagcctgccggtgaacggcaacggtttcgccactcgcgtgatgagccaacagacgcccggcggggtgaacagcgccactgccgatgctcaggaaaccgggcggccgctggacgtggccattcagggcgatggttacatcgccgtgctggatgacgacggccaggaggtctacacccgcaacggcaatatccagcagaacgaccagggcgagctgaccatcgacggacatccggtgctcggcgacggcggccccattgtgctgccgccgaacgccatcgcctcctttggcagcgacggcaccctgtccatcactccggacgacggcgatgttaccgccaccatggatatcgaccgcctgaagctggtgaccattgcgcaaaacaacctcagcaaaaatgagcgcggcatgatgatcacccgcgacggccagcccgcgcagcccgatgaaaacgtcagggtcagcggcggctttctggagggcagcaacgtctccgccgtcgcggaaatgctggcctccatttccttaaaccgccagttcgaagcgcagatcaaaatgatgaaggcggcggaagaactgagcgaatccggtaaccgtttacttcgtggctcctgaggggccgcgtgatcaggataaaaaatgaacgcagctttatggatcagtaaaaccggtctggcggcggaagactccgaaatgagcgctatcgccaacaacatcgccaacgtcaacaccaacggcttcaagcgtgaccgggtgatgtttcaggatctgttttatcagaatcagcgtgcgccgggggcaatgctcgatcagaacaacattgcgcccaccggcattcagtacggcaccggcgtgcgcgtggtcggcacgcagaaaaccttcaccgaaggcaatatccagaccaccgagaacccgctggacgtcgccattatggggcagggcttttttcaggtgcagaaagccaacggcgacagcgcctacagtcgcgacggcaatttgcaggttaacgccgacggcgttctgaccaacgcccaggggttgcccatccagccggaaatcgacgtgcccgccaacgccactgacatcaccatcgctgaagacggcacggtgatggcgatgatgccgggcgaagccgagccgactgaactggggcagatcacgctggtgaactttaccaacccggcggggctgatggcggaaggggacaacctttatctggaaaccgccgccagcggccagccgacggaaggcacgccgggcgaggacgcgctgggcaccctgaaggccggggcgctggaaggctctaacgtcgacatcgttaacgaaatggtggcgatgatcaccgtccagcgggcctatgagatgaacgccaaaatggtctccgccgccgacgagatgttgcagtacatcaatcagaacatgtagggctaagggccgcctgcgcgcggcccgtctgaagtaacaggaacgaaagtgaaaaaatatttgtggttaatcatggcattgccgctgttaagcggctgcgagtcgcaggcgatgctggtcagcaaagacgacgccgcctttgcgccgcctgacgcggcggtagcgccgacgccggaagggcgcgcgggcggggtctttcaggcgggctataactggtcgcttaccgcggatcgccgtgcctatcgcgtgggcgatattctgacggtgatcctcgatgaatccacccagtccagcaaacaggcgaaaaccaatttcgacaagagcagcagtctggatatcgccgcccccacgatttttggcaaaaccaaagacaaactggaaagctctgctgacgctgaccgcagctttgatggcggggccagctcacagcagcaaaacagtcttcacggctcgattaccgtgtcggttcatcaggttttgccaaatggcgtgatggagatccgcggcgagaagtggctgacccttaatcagggggatgaatatatccgcctgagcgggctggtgcgtgccgacgatgtgcagaacgacaataccgtttcctcgcagcggatcggcaatgcgcgtatttcctacgccgggcgcggggcgctcagcgacgccaatgccgcaggctggctgacgcggctgttcaaccatcctctgttcccgctgtaacccggagttgtttatgaagtgttttacatgtccacaggggcgctggctgctgctcattaccctgatgctgacgctgtttaccgtccatgctcagtcgctggagtcgctggtggatattcagggcgtgcgcggcaaccagctcatcggctacagcctggtggtcggtcttgacggcaccggcgataaaaatcaggtgaagttcaccaaccagaccatcaccaatatgctgcgtcagttcggcgtgcagctgccatcgaaaatcgatccgaaggtgaaaaacgtcgccgccgtggcggtgagcgccacgctgccgccgatgtacgcccgcggacagaatattgatgtgacggtgtcgtccattggcgatgcaaaaagcctgcgcggcggcacgctgctgctgacgcagttgcacggcgcggatggcgaagtttacgcgctggcgcagggtaacgtggtggtcggcggcatgaacgccagcggggccagcggctccagcgtcacggtcaacacgcccaccagcgggcgcatccctaacggcgcgtcggtggagcgggaaattcccagcgacttcggcatgagcaatgcggtgatgcttaacctcaagcgtccgagctttaaggatgccaataacattgcggcggccatcaaccgcgcctttggcggtggcctggcgacggcgaaaagttccactaacgtcgaagtgatcgcccccaccgacgccggtgcgcgcgtggcctttatgtcgcagctggaggatgtgcaggtgcaggcggagcgggtacgggcgaaagtggtgtttaacgcccgtaccggcacggtggtgatgggtgacggcgtggcgctgcatgcggcggcggtgtctcatggcaatctgacggtgtcgatctccgaaaccacccgcgtcagccagccgaacgccatgtcccgtggccgcaccgtggcgtcgccggacagcaacgtcaacgtcgatcatgcgcgtccgcaaatggtggcgctgccggagtccaccagcctgaaaaccctggtcagcgtgctgaacggtctgggcgcctcgccggacgatgtgatgtcgattttgcaggcgctgcatgaggcgggcgcgctggatgccgatctggaggtgatttaaatggaaaaccttaacgccattacccacgccctgcgcgcccctgacagccccgacgcggcggcggtgcgtgaccatgacataaaagaagcatcagcccagtttgaagcgattttcatgcgcagcctgatgaaagagatgcgcaaggttaatgcgctgttcgactcgaaagacaacccgtttaacagcgatgcggtgcgcaccatgcagggtttttacgacgacgccctgtgcgacgaactggctaaacaccaggggatcggcatcgcggagatgctggtaaagcagctgtctgcacagcgtcacgattaaggtttaagaacgggcgcggtccggtcgctttaggtagcaaacgcgaatttttagccgggcctggcccgacgaggagtaccagatggacatgataaatatcggttacagcggggcatccgccgctcaggtgcagctgaacgtcacggcgcagaacaccgccaacgccatgacgccgggctatacccggcaggtggcgatgaccagcaccattggcgcaagcggcggcgcggtaaacagcgcgggcaatggcgtgcaggtggacagcatctgccgcgtgtcgaatcagtatctggtcaatcaggtctggtatgccgccagcgacaacggcttttacagcacccagcagcagtacctgacgcagctggaaaccgtgttaagcgatccgaacagcagcctgagcgccggattcgataacttttttgccgcgcttaatgaggcgtccgccaacccggacgactccgccctgcgtcagcaggtgatcagcgaagcgaacgcgctggcgctgcgctttaacaatacctgcgactacattcagtcccagagcgatgaactgctcagtcaggagcaggcgaccatcgcgcagatcaacagcctgacctccggcatcgcgggctataaccagcagatcgccgaagcagaagctaatggcgataacgcctccgcgctctatgacgcccgtgaccagatggtgcagcagttgagcggcctggtggacgtgcaggtgcagatagacgatcgcggtaattacaacatctctctgccgaacggccagccgctggtcagcggccaggactgctcgaccattgcgatgagcagcaacgcagacggcacaccgtgcatggaactgaccttcgccgggacgacctacagcatgacggaagacaccggcggctcgctgggggcgctttttacctaccagagcgacgtgctggatccgctgaccgccaccatcaacagcatcgccgaacagtttaccagcgcggtcaacagccagctggcggcgggttacgatctgaatggcaatcccggcgcgccgctgtttatttacgatcccaccgatccggacggcccgctgctggttaacccggacatcagcgaagacgaactggcgttttccagttcaccggatgaatccggcaacagcgacaacttacaggcgctgattaacatctccaccgagcctatggagattgagggtctcggcaacgttaccgtcggcaacgcctgctcgacgctgatcagcaatatcggtatttacagccgccagaaccagacggaggcgcagtctgccggcaacgtttacaacgaagcgcagaaccagcagatgagcgtcagcggcgtcagcatggatgaggaggccgttaacctcatcacctatacccagatttatcaggccaacctgaaagtgatttctaccggtgcggagatttttgattccgtacttgagatgttctgagcaaccggaaacgacagactatgcgcgtaagcactcaacaatcctacagcaccatgaccacccgcttcactaacctgtcggcgcagctggagcatgtggtgacgcagatggccaccgggcaacgcattatattgccgtcagatgaccccattgccgcagcaaggatcacccagctcgatcgccagcaggcggccatcgaacagtatcagagcaatatcaacagcgtctcagccagtatgagccagcaggagagcgtgctggacggcgtcaacaacagcctgctggcgatccgcgatgacttgctggcagcggccaacggcaccaataccgccgaatccctggcgggttacggccaggagatccagtcgctgaccgaatctatggtggcggcgctcaactatcaggatgaagacggtcactatatttttggcggcacggtgaacgacaccccgcccatcacctatgacgataccgatggcgacggggaaggggatgaatacgtctatcacggcaatatgaatcaccgcaccgccaccgtctcgaacggcgtggtgatggacactaacgtctcggtgggggagatttttggtcaggggctggcgcttttcaacacccttgatgacctcgcgaaggagatgcaggatcccacggtcgatcccgtggcgatgcaggatgatatttcccatgctatcaacgtgattgatgaaagcgccgactcgctgaacaccgccatcgccagcctcggcgagcggcagaacactatgagtatgctgagcgacgcccagaccggcatttccgatgccaatgccgatttgattggtcagcttggcgatctggattacggcccggccagcatcacctttaccggactggaaatggccatggaagccaccatgaagacttactcgaaagtgagtgagctgaacctttttagcgttatttaacgacttccacgcccaggatcatcatgcaggttggtttacaaacttcaacgcatacccgtaccggcggactgacgtctgccgttcgtcagccgggcgtcgtgcgcaccgcgcccgtcagcgataaagcgccgtctggcgactacccggcgtcgccgctcatcgccacccgtccgcagcgctacagcgtacagcttaacgatcagctcaccacgttacagcaggcggatcactggctggggcaactggagcgcgcgctggtggattatcgccacggcgggcagcgggatccggcgaccgtgcagtcgctgctcgacggtcgtctggcgctgaccggcggcgcggtggaccgggaactgcaaccggtgctacaggggcaggcgcaggtgcgctttcatgcgccgcagctgagccaggcgctggcggcggatggcccgcagaaactgctgttcagcgtacagcacgggcggaaaaccctgctgtccgggctaaatattaacggcgacggcgatgccgggcagcgggcgacgaaaatcagcaccgcattacgccgcgtcggcgtgcagcccctgaaaggacaggagggctttactgccagtgagcagcactgggcgcagctgcaaaacagcttcgccgtgcagcgggaaggggcggggcagaaaatcgccattgcggtggcggcgcatccggcgcagacggaaacccttgccgccgcgctccccagcgggcagcaggcgcagcgcgtggtgcaggagacgctcagtcaggtaagcgcacagcgtcagcagctggcgctccagcaggagaaagtccgccagcgtattgatgatatgtcgcgttttgcgcagtcgcagagtgcggtggaggcctccgcgcggctggcgggaaccctggatgcggccagccataattatgaggtgctggcgcaggcgattaacggccaggcgaatctgtcgaagctgacggtgcgcagcctgctggattaacgtttcgggcagggctgcccgtcaggttgcagcaggcctttttcggtgatcaacatggtggcgctgtcctgattaaacagcagctggcgagcgtcgcccagcggcacgctcacactttgcagatcgttatcattgataaagcccagcaccgggaacagcgtggcgtccgtgccggtgacatgagcattctgcagacgtaaaaacgattcgccgctctgctcgccgccgggggcggtacaggcgatcagctgcatctgcagggcaaaagcctcatcccctggccgggtcaggaccaggcgcgctccccgctccgcgggggcggtggtcaggttataaaccgcgtgttcagccgttgccagatcgtaaatcccgacctgggtgcgggcaataacgggcgcggcctgaaggctaccggcgagaccggcgagcagcagacccgcgataacattacgaacaggcaggcatttcattaagcgtgcgctccgtttccttgtgaattaattgacccagttttttaacatcctgttgccagctgcgaatttccattaacaactgatattctttaccgcactgattttgcaccagcaggatcaccgacattttttgtaccgccccgtaataataaatcgtcagcgttgccttatgcgccgtaagcagcatattgatgccttccagcgactccgcaatatgcgacgacaataccgcgcctgatgtattcacccccgtgcggtgcagtcgaaataatttaattttgtcattttgcggcgacagctcttctttaatcgacagacgggaagtggcaagcggcgcagaattctgccccccgggataaatcagccagataagcccgcagccaagcagcagcaacagcgccgccagggcgatcaggcggggtttattgcgcggcgcaggcgcgctggcgggcggggcatccgtcacgtcggcaaccggttcaggattgggctgagtcaggggctggggcgcagggagcggctcatccggtaacaggacgataaagtctttgttcagcagatagccttttttcgggatggttttgatgatctcctgtacccggccatcgtcccccagcgccacccgcagagcatagacagcggtcagcaggctgttatttccgacgacgcggtttttccatacctcgctcatcagaaaatcacgcgacaccacctccccggcatgattaaccagcgtttcgagcataataaaatggaattcgccgaggcggcggatctcccccgtttcccggtgtaccagaccgtttaacgacggttcaactttccagttattaacaatgatctgcatagtaatctgttaataaattggtgagtaataatttatttttcacaacgtaagattccacttagccgcagggagggtaaatgtatcggatgattatcaccccatcaatctaagaatagtcttaactcataaattaataattaattaatttctaagctaacggattgataaagcttgccgtcagcgcctgggggtattaacgtcgctggtaattgtagacgatcggcccgcaaaggccgtcgcgactggcaagtttgattaatgtaatgaggtcatcatgtttaaagccattcagatcgataaagcggaaggacagtattcggcatccctggtggagctggacgagcaggcgttgccggacggggacgtcaccgtcgcggtggaatactcctccattaactataaagatgcgctggctattaccggtcgcggcccgattgtgcgccagttccctatggtgccgggtattgatttcgccggtaccgtaatcgccagcgacagcgcggcgtttgccgtgggcgaccgcgtgctgctgaccggctggggcgtgggcgagcgtcactggggcggactggcaggcaaggcgcgggtcaaaagcgaatggctgacgaaaatgccgtccggcgcggatgcaaaacaggtgatggctatcggtacggcgggctttaccgccatgctgtgcgtgcaggcggtactggatcacggcgtgaagccggaagacggcccggtgctggtgaccggcgcgggcggcggcgtgggcagctgcgcggtgatcattctgtctgccatgggctatcaggtggtggcgtcgaccgggcgtccgcaggaagccggatggatgcgcgaacagctgggggccagcgacattattaaccgtgatgagctgagcgcgccgggtaaacccctgcagaaagagcgctgggcggcggcgattgataccgtcggcagccatacgctgagcaacgtctgcgccagcgtccgttatgacggcatagtcgcggcgtgcggcatggcgcagggcatggatctcccggcgacagtggcgcctttcatcctgcgcggcgtcacgctgcgcggtatcgacagcgtgatggtgagcagcgaaaaacgtccggcgatctgggagaaagcctgtcagtatttaacgcctgcggcgctggaaaaactgagcgctacttatccgctgagcgatgccattgacgtggcggaaaaactgctgaacgggcagatccgtggccgtgcggtgattgagatttaattctggcggggttgccgggtggcgctgacgcttacccggcctacagtataacgtaggcccggcaagcttgcgccgccgggcaatttgcagcaacgttatttgcgaatatcgtgcgcggtgtcgttttcgcggcaatcgccttcggcgcagtggccgtagaggtaaaggctgtggttggtcaggcggatcccgtgctgagcggcgatttcacgctgacgtaattcaatggagtcatcgctgaactcaataaccttgccgcagtcgaggcagatcaggtgatcgtggtgatgctgctgcgtcagttcaaaaacagatttaccgccttcgaaattatgacgggtcacaataccggcgtcatcgaactggttaagtacacggtagaccgtcgccaggccaatctcttcgcccatgtcgatcagtcgtttgtataaatcttccgcactgacatggtggttgtcaggtccctggagtacctcaaggatctttaaccgaggaagcgtgactttcaggccagccttctttagtgcggtgttattgtcagtcatgcggaatctgtcctgtagctaaacgattcacttccaaatggaagttaatgagaatgacgttgagttaatgcgtctcattatagaactgccatgtctaaatgaaaactgcaagtcctcaagcaaagtatgcgtataaaacgtggtgtcactaacaaacccgtaagcaatcacgttcaatcaggggatattgtacaggtatgcgtgcgaaagttaaaaaattgtagcaattattttgattggttatatctattaatgcggcgcagccaacaggttacgccgcacaaaaatcaggcgttgatgatctcatctaaatgaagttcttcagaaatctgcttcacccatttttccacgcgctcagcggtcagttccggctggcggtcttcatcaatggccagaccgacgaagtggtcgtcgtccgccagacctttggaggcttcgaaatggtagcccgcggtcggccagtgaccgacgatagtcgcgccgcgcggctcgatgatgtcgcggatggtgcccagcgcatcgcagaaatattccgcgtagtcttcctggtcgccacagccgaacagggcgactaatttgccgttgaaatcgacctcttccagcgtcgggaagaaatcgtcccagtcgcactgcgcttcaccatagtaccaggtcgggatgcccagcagcagaatatcgtaaccttcgagatcttctttgctgcttttggcgatgtcatgcacgtccgcaacatctttaccaagctgcttttggatcattttcgcgatattttcggtattacccgtgtcgctgccgaaaaaaatgcctgtgattgccatgagtaaaataacctcttgaaacttaatgatatggtggtggcgcaatgcccacggataagggcaatcatagcagaacagagaaggacgcggaaactgcaaacgcctcagactgcactctgtgctacatgaaagtgatatttagcgggattttcagactatcccctggccgcgcagcagcgcgagctgagccattaaaagctcctcaatcagttcgctacggctgatgtcacgatcctcggccagttcatttaaggcttcgacggcgtccgcgtttagttttagctcgacgcgtttgaggccacgaaccttatcgcgtttcagctgattccgcttattaatgcgcaactgttcgtcacgcgaatgcggattcgttttcggtcgtcctgggcgacgatcattcgcgaacagatcgagtgtcgtgcggtccgtttgttctttagccatgattttgagtgacgtcgggggaaaaacaagctgcctggtggaggccctgcgcaattagcgcgccatcatacatcagggagaggggcacgccaacgaccgggcgcgtcgcggcgctcggtcgccgggtttttaatcaactggcattatcagcaagatagcgacggatcgcccgcagtacggcatcgggtttttccgcatgcacccagtgcccggcaccggcgaccacatgcgcccgcgcctgcgggaattgcgccagcagcgcatcacggtacgcatcggtcacgtaaggggagttgccgccgcgaataaacagggccggtttatcgaaggcggggacggttttccagccgatgatgttctcatactgatcccagagtaccggcacgttaaagcgccacccgccgtcggcccaggatttaagcagaaactggatcacgccttcttcgtccagatgctcgcgcatcacggcggcggcctgctggcgggtgctcaccccggcatcggtaacggcattgatggcggtaaaaatctcgtcgtggcggcgcaccggataagcgaccggcgccatatcaatcgccaccagcctgtcgatgcgttcgggggccagcgcggtcagcgccatcaccgctttaccgcccatggagtgaccaataaaggtggctttttcgatccctgattcgtcaagggtatccagcagatcctgcgccatcgccgggtaggtcatttcaggcgaacgcggggaaagaccgtggttgcgcatatccacctgtaccacatcgtggtcgttaatcaggtcgcgggctaagatcccgaggttgtccaggctgccaaacagaccgtgaacaaggacgatgggagaattgttgtgcgattgttgtgcagtttgcgcgcgggtattcaatttcatggcaaagttctttttttcgctctctcaggttagggtatcatgttgaccattctgccgcccggctgcaagggatcatctttatctgacttttgcgtcagaaaagcctggccgctatccgctgttgagatttgcccctataatctcaatgacttgtattcagaaaagtgacctcactggattaagatgaaaacgatcgaagttgatgatgaactctacacctacattgccagccacacgaaacacattggcgagagtgcatccgacattttaaggcgcatgctgaagttttctgccgccgcgcagtctgcggcccctgtgaccaaagccgcgccggctgccgctgtcagccctgcccctgatgtcgtatccaacccggtaaaagataaagtccgcgccatgcgtgaactgctgctgtctgacgaatatgccgatcagaagcgcgcggttaatcgttttatgctggtgctgtctacactgtattcactggatgcaaaaggtttcgccgacgccaccgagtcattacatggccgtacgcgcgtctactttgccgcagatgcgaaaacactgctgcaaagcggaaaccagaccaaacccaaagaagtgccaggcacaccttactgggtgatcaccaacactaatacgggccgtaaatgcggcatgatcgaacacatcatgcagtcgatgcagttcccggcggaattgatcgaaaaggtttgcggcacaatttaatccttgcataagaaggaccaggcaatggctaaccacccccgtgcaggacaacctgcacagcagagcgatctgattaacgtcgcccaacttacctctcagtactatgtgctgaaaccggaagtgggtcatgcagaacatgcggtcaaattcggcacatcaggccaccgtggcagcgctgcccgtcacagctttaacgagccgcacattctggctatcgcccaggcgattgcggaaaaccgcgcgaaaaacggcattaccggtccctgctatgtgggtaaagatacccacgcgctgtcagagcctgcgtttaactccgtgctggaagtgctggcagccaacggcgtggacgtggtggtgcaggaaaataacggctatacgccgacgcctgccgtatccaatgcgatcctggagcataacaaaaagggtggcgctcaggccgacggcatcgtcatcaccccgtcgcacaacccgccggaagatggcggcatcaaatacaatccgcctaacggtggcccggccgataccaacgtcaccaaagtggtggaagatcgcgccaaccagctgctggccgatggcctgaaagacgtgaagcgcctgtcgctggatgccgcgatggcgtccggtcatattaaagaacaggatctggtgcagccgtttatcgaagggctggcggagatcgtggatatggcggcgatccagaaagcgggcctgacgctgggcgtcgatccgctgggcggctccggtatcgaatactggaaacgcatcgccagccactacaatctgaacctgaccatcgtgaacgatcaggtcgatcagaccttccgctttatgcaccttgataaagacggcgcgatccgtatggactgctcctctgagtgcgcgatggcgggcttgctggccctgcgcgataagttcgatctggcgtttgccaatgacccggactatgaccgtcacggtatcgtcacgccagccggcctgatgaatccgaaccactatctggcggtcgccatcaactatctgttccagcaccgtccgcagtggggccaggatgtcgcagtgggtaaaaccctggtgtcctcggcgatgatcgaccgcgtggtgaacgcgctgggccgtaagctggtggaagtgccggtgggctttaagtggttcgtggatggtctgtacgacggcagcttcggcttcggcggcgaagagagcgcgggcgcgtccttcctgcgtttcgacggcaccccgtggtccaccgataaagacggcatcatcatgtgcctgctggcggcggaaatcaccgcggtaacgggtaaaaacccgcagcagcattatgacgagctggccgcgcgctttggtgcgccgagctacaaccgtttacaggcgtctgcctcttcagcgcaaaaagcggcgctgtcgaagctgtcgccggaaatggtcagcgccgacaccctggcaggcgatccgatcaccgcacgtctgacggcggcgccgggtaacggcgcgtccatcggcgggctgaaagtgatgaccgaaaacggctggtttgcggcgcgtccgtccggtacggaagatgcgtacaagatttactgcgaaagcttcctcggtgaagagcaccgtaagctgatcgagaaagaagcggtagagattgtcagcgaagttctgaaaaacgcgtgatcctgttgccgggtggcgctgcgcttacccggcctacatggctgaaaaacgcgtgatcttgttgccgggtggcggcttcgccttacccggcctacatgacctgtaggcccggcaagcctgcgccgccgggcgaaaaacaccaaagcctccctttaccgggaggctttttttcagccgtgcttatctttgagctcaaagcgcggcgacaccagcccgtacagcgtccagcccatgaaggtcacgatcgcgccatacagcatggcttccggcccggaggagtagagcgcatagaagctgtagagcgcgcccatcagcgccaccacgttagccgccttcgctttacgcggttccaccttcgcgaccttctgaatgatcaccagcgccgccatcgatagaatatacggaatgatgttggtcaccaccgccagattcaccagcacgttgaactgtttgttcagcgacgggctgatggtcatcagcgacagtccactctgaataatgacaatggtcagcattccttttaccggcgcatccgctttactcaccttcgagaagattttcgggaagtagccttcatcagcggaagatttgaacacctgcgcgatagtgaactgccagccaagcagcgaaccgcagcaggacatcaccatcagccccatgatcactttcccgacgccgggcgtgaacatctgcgaaaaagccagcccgaacggggcagtggagtttgccagatccatattcggcacaattcccgcgataacgttggtggagacgacataaatcaccgccgcccccagggtgccgcccatcaccgcgatgggcacgttgcgctccggattttccaccacctcggtattggcgcaggcggattccagccccagaaaagcccacagcgtcatggcaatggacgaccccacagcatcaaagaacggcacctgatgcgggttccaggactgagcgtacatctccgggctgaaccagaaccagccgatcaccgacaggccgatcaccggaatgatcactccccagatggtgatactgctgagctgcccggtaatgcgcgcgccgccaaagttcgccaccgtgcagatccacagcacgcaaatagtggcgataccgatctgcaccgggctgagcgtggcgccgagcagttcgctgccgtagccgacggcggaaatggcaatggcgacgttagcaatcagcagcgatacgccataggtgtagttcgccataaagttgccggacttaccgaaagcgtactccgcgtaaccgcccatccccccggacttgcggctgaacatcccgcatttggcgaacgcccacgccagcgccgtggagccgaccgccgtcaccagccaggagataatcgagatggtgcccacttccgcaagcttggtgggcagcataataatgccggagcccatcatattgaccatcgtcagaatggtgagcggcacaacgcccatcttgttggatttgctcataatgtttcccctttcaacagcgccggttcagcggtttgcggcttaatgacgtagcaccacacctgtttacgtccgtcgatctctttgatgtagacaccctgcagttcaggcgcaaagcccggcagcaaattgatgccttcttccagcgcggcgaagtaacgcagcaccgcgccgccccagatctcgccaggcaccacgcacagcacccccggcgggtaggggagcgccccttccgcggcgatccgcccctcggcatcgcgcagcgtcaccagctccacttcgccacggatgtaggcatagttcgccgcctgcggattcatcttcaccggcgggaagtgatctttacggaacatctctttttgcagctgtttgacgttgttacgcgcatagagatcgtgcatctcctggcacagctggcgcagcgtgtagccttcataacgctgctgatgctggcgatagagcgacggcagcacctcctgcatcggcgcatcgttttccagcagtttctcgaactgcaccagttgcgataccagttgctgaagtttgcccatgccttccgccggggtgagcaggaagaggatcgagttcagatcgcacttctccggcacaatggcgttctcacgcagatagttcgccagaatggtggccgggacgccaaagcggtcgtactcgccggtgcgggcattgatgcccggcgtggtaagcagcagtttgcagggatcgacaaaatactggtgcggcgcgtagccttcgaaggcgtgccagttttcccccggcacgaaatggaagaagcgcagatcgcggcaaatgtcgtgcgtctcgaaggtttcccacggacggccatcgacggtggcgggcacaaaggggcggatgaacttgcagttttgcaggatcattttgcgtgcttccacgccctgttcgacgcagcgcatccacattcgtttcccgctttcgccttcatgcatccgggcgttaacgtccagcgcggcaaacagcggataaaacgggctggtggaggcgtgcatcataaaggcgttattgaggcgcttatggggcacatagcgcggctggcctttgatatggctgtcttttttatggatctgcgaggtctgggaaaatccggcctgctgtttatgcaccgactgggtgaccagaatgcccggatccttttcattcagttccagcagcagcggcgagcagtcggccatcatcgggataaactgctcgtagccgacccaggccgaatcaaacaggatgtaatcgcacagatgcccgatcttatccaccacctgacgcgcgttataaatggtgccgtcataagtgccaagctggatcaccgccatgcggaacgggcggggcgtattcctgtgttgcggggcaacttccgcaatctgctcgcgcagatagttttctgcaaaacagtgcgcgtctatgccgccgataaagccgtaggggttacgcgccgtttccagatacaccggcgtcgccccggcctgcaacagcgcgccgtggtggttggatttgtgattattacggtcgaacagcaccagatcccccggcgtcagcaacgcattgagcaccactttgttcgccgatgaggtgccgttcagcacgaaataagttttatcggcattaaaaacttttgccgcatgctgctgggcaatacagggcgcgccttcgtggatcagtaaatcgcccatcgccacgtcggcattacagagatccgcgcggaacagcgtctcgccaaagaaatcgacaaactgattaccggcaggatggcggcgaaagaattgtccgccctgatggccggggcaatcaaaggcgctgtttccctgttttacgtaatccactaacgcactgaaaaacggcggacgtaaggcgcgctcatatttttgcgcggcggcttcgagctggcggccataataatcatggcaggcatcctgatattcaaataccccttgaatgcgcgccagatactccgacggcacaaattccccttcgtggctgacgacaaaaagcggaatgccaaaaccggtttcttctatttcttcgacgatccctttataaatatcgttaatggataatacgaccgcggcgacatccatataatcggtgtcgttaacatttactatttcacgctgggtggtaaaacagtccggacaggcgcggctgaccgcaatttttaagcgttgcataatctttccttgtttaaagggacagggcgtcccgcaactcccgtaaggggaattgatatgatttttaaataagcgtcagcgccggaaaataaactccggggaaaacgttatttttatttatgttgggcgtgcacgaaaccagacgtcagctaactcgctgaaatcaggaaaagaaggcagacccgaaaccggaacggttatcgggcgttaaagaaatgaaagtcgaagctgttacggtgggcaaacatcataatatgggtggtgcgtcttatatggggcatcagcctgctgttattttccataataaaatccttttgctgtttgaaagcgcggtcattttatcctggaaatacgggtagtctgtgagggcgatcaacaaaaacagcgcagatcagaaatatttagtcggtaaaagtgaataatgccgtacggatcgcctggtggcgtgaaaaggttaattagatgttataaagctgcttttaatatatttttgctgttttattcacctggtggaaataaatggcctccaggcctcaaataaatgaataaagcgggcaggattgcgtgtttttattcaaacgcaagagaagacgtgttaacagggacgcttacagcataaaacgatagccgatgccggtttccgttaacagatgacgcgggcgcgccggatcgctttccagcttctggcgcaggtggcccatatagatgcgcagatagtggctgtgctcaacagcattcggcccccacacctggcttagcagctggcgctgggtcagcactttgccgtgattatttaacagcaccgccagcaggcgaaactcaatgggcgtgaggtggatctcttcgtcattacgggtaatgcgccgcgccgccagatcgacctgaatatcggaaaaactgaccagcggatcgctttgccgcgccccggcatgacggcgcagcgccacccgaaggcgcgcctgtaactcgccaatgccgaacggcttgctgagataatcgtcggcaccggcatcgagggcggcgatcttgtcgctctcctcaatgcgcgccgacagcaccagtaccggcacctggctccactggcgcagatcgcgaataaaatcaatgccgtcgccgtccggcaggccgaggtcaaggatcaccaggtcgggcttgcgcgtgacggcttcgagcagaccgcgctgtaaggttccggcgtcgtaaacgcgcaggccatcggcctccagcgcggtgcgcagaaagcggacaatggcctgttcatcttcaacaatgagtacgcttatcacagatcctcggggagttcagtcagggccgggggggatccctgcggcagtgtaacacagaaacaggccccgccttccgggcggttagcggcggtaatagtgccgccgtgcacgctgacaatcgcctggcaaatggccagccccagcccgacgccgggaatagccgactctttatgaccacgggcaaatttatcaaaaatactcgcctgttgcccctccggaatgccggggccgttatcccataccgccagccggaattcctctttttcgacacgggcggaaatgccgatctgcgccgtcggcccggcgtatttcagggcgttttccagcagattgatcagcacccgctcgaacaacggcccgtcgatatgcaccagcatcagcggatccggcatctcaagggcgatctgccggctgccgggcagcgcctccatggtgcgcagcgcgctgccgatcacttcttccagcgtcagccactcctttttaagattaaatccgccggactgaatacgcgccatatccagcagattattcaccagccgcgtggtgttcagcacatgctgacggatttcactggcctgggtggcgtggggcgagccttcgctggccagatccagcgtcaggatctccgcctggccgaacagcaccgtcagcggcgtacgcaggtcatgggacagcgccgccagcagcgcattgcgcacgctttcccgctcgctcgccagccgcgattgctgttcgctggcggtgagcgccagacgctccagggcgttcgccaccagcagggtaaaggtttccagcaaccgctgctgttcagggatcatcagctggcgcaggctggtgggctccaccaccaccaggccgcgggttttatcggcgctgttcagcggcaaaatttgatagggcacgccgggcagcgtatcggtgcccgcgcccgcaggctggcctttggtaaagctccactgggcgatggcgtcatcccagggcgtcagccccggctggcgggtgagggcggtcagcgtgccgtccggtccggcgatcagcaactggctttgcgcgtgaaaggtggagcggataaaggcttcgctggtggcggcgatgtcgcgctcgttacgcccggcggccagcgctttcgacagctcatacagatgccgggtacgctgctcgcggtaacgcgccacccgcgcctgatagcgcacgccagcggtgagattaccgatcaccagcccgacggtgagcatgacgccgaaggtcagcagatactgcacgtccgacaccgccagggtaccgcgcggggcgatgaaaaacagatcgaagctgaccacgttaatcaccgtcgccagcaccgacggccagcggccataaaacagcgcgactatcaccacgcccagcaggtagagcatcaccaggttggcggcgtcaaaggccatcagccactggctggcgatcagggtgatcagcgcgcacagcccgacggccaccagcgtaccggtgagctgcacgcgccagcgatccagccacggccgggtgtccgtcgtacgggcggcggcaggggcgggtttatcttccagggcgacgatcatcaaatccagatcgggagccagccgcgccagcctttcggcaaaggtttcatgctgccagaaacggcgcgatgtacggcggccggtgataattttgccgagattatgctcacgggcgtagcggacaatcgccttttcctgctgtggatccgcaagggtggcggtttccgcgcccagttcctgagctaagcgtaacgcgctgagaatggcgcggcgctgcgcttccggcagtttgtgcagagtgggggtttccacgtacaccgcatgccattcgctgccgagtttggccgccagacgcgcggcagtacgcaccagtttttcattaccggtgccgtgaccgatgcacagcaaaatggcgtcccgcgtatgccagactttctcctcgccggggcgaccgcgaaaggcgcgcatctgcgaatccacccggtcggcggtgcggcgcagcgccagctcgcgcagggcgatcagattgcctttacggaaaaagtgttcgatggcgcgctcggcttggccgccgaagtagactttgccatcgtgcaggcgctggcgcagatcgtccggcggcagatccaccagcaccacttcgtcggcggcatcaaaaaagggatccggcacggtttcccgcacctggatcccggtgacgccgctgaccacatcgttgaggctttccagatgctgcacattaacggtggtgaacacatcaatgcctgcttccagtaactcttctacatcctgccagcgttttggatggcgtgagccgggcgcattggtgtgcgccagctcatccattaagatcagcgccggacgccgcgccagggcggcatccaggtcaaactcatccagctcccgccgccggtgagcgatacggcggggcggcagcgtcgccagccccgtcagcatcgccgcggtttccgggcggccatgggtttccaccacgccgattaaaatatccagcccctgcgcccgcaggcgctgcgcttccgccagcatggcgaaggttttgccgaccccggcgcaggcaccaaaaaacaccttcagcttgccgcgatggggggcagcggcctgctccagcaggcggtcaggatccgggcgcaacggctcgtctgtcattcaggattatccttaagcgcgtccagcgcgaggtttaactcaacgatattcaccaccggctcgccgctaaacgcgatgagcggctgctgcgtatggcgttcgaccagctgcgacagcacctctgccgacagcccacgggcctgcgccacgcgcgggatctgccagcgcaccgccgcagggctgaggccataatccagcccgctcgacgaggcggtgaccagctctaccggcacgcgctgatccgcctgggggttggccgcccgcagcgcggcgacgcgctcacggatcgccgtatccagcgccggattgctggccgccagattactgccgccggacgccagcggattataaggcgaatctgaagttacagaagggcgaccgtgaaaatatcccggcgcgctaaagttttgcccgatcagccgcgagccacgaacctcatcttccacgcggatcagcgagccgttcgcctggtcgcggaaccaccactggcccagcacggtagtgaccagcgggtacagcccgccggtgatcaaggttaagaataacaacagcagaacagcaggacgtaaaacagccattttcaggatccttacaccagaccggtgagcgacaacagcaggtcaatcagcttgatgccgataaagggcaccaccaggccgccgagaccgtaaatccacaggttacggcgcagcatggcggaggcgctcaggggcttatagctcacgcctttcagcgccagcggaatgagaaacacgatgatcagcgcgttaaagatcaccgcgcttaaaatcgccgacgccggggagtgcaggtgcatcacgttcagtgcgttcagctgcggataagtcaccgcgaacgccgccgggataatggcgaaatacttcgccacatcgttggcgatactgaaagtggtgagcgagccgcgtgtcatcagcatctgtttaccgatatgcaccacttcgatgagcttggtggggtttgagtccagatccaccatgttacccgcctctttcgcggcctgggtaccggagttcatcgccactgccacatctgcctgcgccagcgctggcgcatcgttggtgccgtcgccggtcattgccaccagacggccatcggactgatactggcggatcagcgccagtttcgcttccggcgtcgcttccgcgaggaaatcatcgacgcccgcttcggcggcaatagccgcagcggtcaggcggttatcgccggtgatcatcacggttttgatacccatggcgcgcaactgggcgaaacgcgccttgatgccgcctttgacgatatctttcagggcgatgacgccgagcaccgttgcgccgtccgccaccaccagcggcgtggagccctgacgggcgacggtttccaccagcgcgtcgacatccggcgggaagtgcccgccgttggcctcgatatggcggcgcagcgcatccaccgagcctttacggatcagacgatcctgaatattgatgccgctcatgcgcgtctgggcggtgaagggcacgaaagtcgcattcaggctctgaatatcccgctcgcgcagattaaagcgctgacgggcgaggatcacgatgctgcggccttccggcgtttcatccgccagcgaggagagctgcgcggcgtctgccagcgcccgttcttccaccccttttaccggcaggaaggcggaggcctgacggttgccgagggtgatggtgccggttttatccagcagcagcacatcgacatcgcctgccgcttccaccgcgcgtccgctggtggcgatcacgtttgcccccagcatacggctcatccccgccacgccgatggcggataacagcccgccgatggtggtcgggatcagacagaccagcagcgccaccagcaccgtcacgctgaccgccgtgccgccgtaagccgagaacggccacagggtcgccgtcgccagcaggaaaacgatggtcagcgccaccagcagaatggtcagcgcgatttcgttcggcgttttgcggcgttgcgcgccttccaccatggcgatcatgcgatcaaggaaggtttcgccagggttaacgctgcactggatcaccagccagtcagaaagaatgcgtgtgccgccggtcaccgaggcaaaatcgccgccggattcgcggatcaccggcgcggattcaccggtaatggcgctttcatccaccgacgcgccgccttcgatcacttcgccgtcgcaggggataatgtcaccggcttccaccagcacaatatcgcccttgcgcagatcggcagcgggcacctgatcctgctgcgcatcgtgacgcggggcgcgcagcttgcgggcaaacgccgttttctgtacccctttcaggctgttggcctgggctttactgcggccctccgccagcgcttcggcaaagttggcgaacaatacggtaaaccacagccagaggctgatggtgccggtaaatccggcgctgcccgacatctgcccggtggccatcgccacgcacagcagggtggtgagcaggctgcccagccagaccataaacatcaccgggttgcgccactgcgcacgcgggcttaatttgcggaaagaatctaaaagtgcctgacgaaccagcgcgggttcgagcagggcaagttgcttgcggctcattgtgtgcgccttaacgtaaggaaagatgttctgcgaccgggcctaaggccagcgcgggaataaaggtcagcgcacccaccagcagcacggtgccgatcagcagaccgacaaacaatgcgccgtgcgtgggcagggtgccgttaccggcgggctggcgttttttcatcaccagcgacccggcgatagccatgaccgggatgatcaccccgaagcgcccggcgaacatgcagaccgccagcagacagttccagaacggcgtgttggcgctcagtccggcaaaggcgctgccgttgttgttcgcggcagacgacaccgcatacagcacttcgctgaagccgtgggtgccggggtttaacatgcctgcgcgtccggcctcggtcatcatcgccagcgcggtgccgagcagcaccagcagcggggtgacgaggatcgccagcgcggtcattttcatctcgcggacgtcgatttttttgccgaggtattccggcgtgcggccaatcatcagcccggcgataaagactgccagcaggacgaacagcaacatgccgtacagaccggatccgacgccgccgaacaccacttcgccgatctgcatcagccacagcgggatcatgccgcccagcgcggtgaaagagtcgtgcatggcgttcaccgcaccgcaggaggccgccgtggtgaccactgcatacaggctgctcgccagaatgccgaagcgactctctttgccttccatattgatgtggctgtctgcgccaaacgccgtgaggttagcgttgccgtgcagctcgccccacattaccagcgcaacgcagaccacgaagatgatggacatcgcccagaggatcatgtgaccctggcgtttatcgccgaccgcgtcgccaaaggcgaagcagagcgcggcggggatgataaagatcgccagcatctgcaccaggttggtcagcgcggtggggttttcaaacggatgcgaggagttggcgttaaagaaaccgccgccgttggtgcccagcagtttaatggcttcctgcgaggccaccggtcccatcggcagcaccgacttcgccccttccagcgaagtaaagggctgataggcatcgatgttttgcagtacgccctgttgcataaagaacagcgccagcagcagcgagagcggcagcaggatccacagggtaatgcgcgtcagatcgacccaggcgttacccagcgtattaacgctttgtcgggcgaacgcgcggatcagcgcaaagagcaccgcaatgccggtagcggcagagaggaagttctgtaccgtcagcccgaccatctggctgaaatagctgagcgtgctttcaccggcatacgactgccagttggtgttagcgacaaaactcaccgcagtattcagcgccagatgccatgacaggccaggcagttgctgcgggttcagcggcagatgatcctgcaccatcagcatcgcgaacagcagcaccagcccgcaaatattgatcgcaagaatggcgaacagatattgccgccagttcatcggcgacggattaatgcccagcccgcgccacagcaggttttcaacgccccccgtgcctgcaaggggcgcaccgcgcaccatttttgccagtacgccgcccagcggtcgtgccagcaccatcagcaccagcataaagctggcgatcagtaaaaacgcctgagccgccatcagaaggcctccgcgtttatcagggcgtaaaccagatagcccaacaacaggaaaaccagtaccacaccggttattacgcctgcactcacaatccacctccaggtgtcttttgttaacgtagtgaaggtaggattttcggtgcaaagatttcgcaaaaatcaggcgggcgggtgtaaaaaaagtataaaaatgaaaaatggcacaatttaactaaggtttagtatttatttaactattttgtaacttaattacggtgggttgtgtaaatattggctaaacaggtgaaaaatagtggtcggatgagtagtaaaattacaaacaaaacggtactattttaaccagttcagcagattcatttttacggtgaatgttaccgaccaacaaaagggggaagcttatgtctttatatcgggaatatcctgcacacgtcattttcgtacgccgcgctttcgccgttgcggcaggcatcatcgcattaccggtgatgttattctggaaagatcgtgcacgtttttacagctatctgcatcgggtctgggcgaaaaccagcgataagccggtgtggatggatcaggccgagaaagtcgcctgcgatttctactaagaagcaaagcgcacacagcaaactacaagcccatgcggcaaaaaaagaaaaaccgccaaatctgatttggcggtttttttatgcctgtagatccgctattcattgtgaaacgtgttcggttgctgcttttaccagcagtcagctgttcatcacgtgttccacgcaaaccggcgcggtattttttgatgttctcaggctacactcattttacgggctaaaaggagtcgttatgagtgagaaaatccctgttggcatcagcgcctgtctgttaggggaacaggtgcgttttgatggcggccataagcgtctggcgtttgcggttgaagagttatcgccgctgatgaaatttgagccggtatgcccggaaatggcgattggcctgccggtgccgcgtccggcgctgcggctggtaaaaaaggatacgggtgacctctcgctgcgcttcagcgacgggcgcgaaggcgacctgacgcaggacatgatcgactttgcggaaaaacgcatcagtcagtttgaccgcctgtgcggttatatcgtctgcgccaaatcccccagttgcggcatggagcgggtgcgcgtctacgaactggaaaacaataataaccgtaaagccgggcgcggcatctataccgacgtgctgatgaaaactttcccctggctgccggtggaagaagacgggcggctgcacgatcccatgatccgcgaaaacttcgttgagcgcgtctatgccctgcatgaactgaacagcgtgcgcgagcgcggcctgacccgcggcgagcttatcgcctatcacagccgctacaaactcctgctgctggctcattcacagcccaaataccgcgaactgggacgcttcgtggcggccatacatgaatggtcatcgctggaggagtggtttgtcgaatatcgtctgcggctgatggatctgctttcccatcaggccacgcgccgcaaccatacaaacgtgctgatgcacgtgcagggctatttccgcaaacagcttaacgcgcgccagcgcgaagagctctcctcgcttattgaccgctaccgtcagggcacgcagccgctgctcgccccggtcaccttacttaaacactatatggccgaattcccggacgcttatctgtcgggacagcgctattttgatccctggccggaaacgcttcgtcttcgctacggacattaattcaggagagttatgaccacgcatctggtctggtttcgcgcggatctccgcgtgaacgataattttgcgctcgcggcggcctgccgcaatccccatgcccgcgtactggcactctttatcgccacgccacagcagtgggaaaatcacctgatggcgccccgtcaggcagcctgtatgcaggcgcagttaaacgatcttcaacagtcgctggcggagcgcggcattccgctgatttttaaagaagtggatgactttgctgccagccagcaggtagtaaaagaactctgcgaggcgcagcaggtcacgcatcttttttataattatcagtatgaaatcaacgagcaccagcgcgaccgcgcggtggaaaaactgctgccggaggtggtgtttcagggcttcgatgacagtgtgctgcttgctccgggcagcgtcgtcaccggcaatcatcagatgtacaaagtcttcacgccctttaagaacgcctttttacggcggctgcgtgaggatctccccgaatgcgtccccgcgccaaaagtacgtgaaggcggcgcactcagcgaccctctcacgcccatcgggctgaactatccgcagcaggattttgatcgtgagctgttcccgtgcagcgaaaaagccgccatcgcccgtttgcgggaattctgccagcagggggcaggggaatatgaggcgcggcgggattttccggctatcgacggcaccagccgcttatccgtttgtctggcgattggctcgttatcgccgcgccagtgtctgcatcgcctgctgaaagagcagcccgatgcgctgggcggcggcgcaggggcggtatggctcagcgagctgatctggcgcgagttttaccgccatctgatgacctttcacccggagttgtgcaagcaccagccctttatcgactggacgcgtcgcgtgcagtggcaggataacgacgcgcatttccgggcgtggcaggagggtaacaccggttacccgattgtcgatgccgccatgcgtcagatgaatgaaaccggctggatgcacaaccggctgcgcatgatcaccgccagtttcctggtcaaagacttacttatcgactggcgcgccggagagcggtactttatgtctcagttgattgacggcgatctggcggccaataacggcggctggcagtgggcggcctccaccggcaatgattccgcgccgtactttcgtatttttaaccccacgacgcagggcgagcgattcgataaagacggtgaatttattcgccgctatattccggcgctggcgaaggtgcccgccaccgcgctgcatgagccgtggaactgggccgataaacagggcgtgaccctcgattatcctcgccccattgtcgatcataaaaaggcccgcgttgccacgctggcggcgtacgaagccgcgcgaaaatcgtaaaggagaggcacgatgaaaaatagcgatctggaaaaactgatcaacgacaaactcaacagtggcgcgttcagcgattacggcccgaacggactccaggttgaagggcgcgacagcgtacaaaaaattattaccggcgtcaccgccagccaggcgctgctggatgaagccgtgcgcctgggcgcggacgcggtgatcgtccatcacggctatttctggaaaaacgaagcgccgatcattcgcggcatgaagcgtaaccgcctgaaaaccctgctggccaacgacatcaacctctacggctggcacctgccgctggacgcgcacccggagctgggcaacaacgtgcagctggcgaagctgctcggcatcacggtgatgggccaggtggacgatctggtgccctggggcgagctggcgatcccggtgcccggcccggagctggcttcgtggatcgaagcgcgtctggggcgcaggccgctgtggtgtggcgacaccgggccggaggagatccggcgtgtcgcatggtgcaccggcggcggtcagggctttatcgacagcgccgcgcgttttggcgtggatgcctttatcaccggcgaagtttcggagcagaccattcactccgcccgtgagcagggcctgcatttctatgcggcgggtcatcacgccaccgagcgcggcggtattcgcgccctgagcgaatggctgacggaaaataccgatctggacgtcacctttattgatattcctaatccagcctgatgcgaggagcgaaagtgcagcgagcgcgttgttatctgttaggtgaaacggctgtcgtgcttgaacttgagccgccggtcacgctggccagccagaagcggatctggcgactggttcagcgggcgatgaccatccccgatgtggtggatgtcattcccggtatgaataatgtcaccgtggtattgcgcgatccccagggaaacgcgctggatgccattgagcgtttacagcgctggtgggaggagagcgaggcgctggagccggatccgcgcttgattgaaatcccggtgatctacggcaaagaggacggccccgatctgccgcacgtcgccagccactgcggcctgagcgaaaaacaggtggtggagctgcacgcgtcggtggattaccaggtctggtttctcggttttcagccgggctttccctatcttggcagcctgcccgcacagttagcgaccccgcgccatgcggagccgcgccttagcgtgcctgccggatcggtgggcatcggcggcgagcagaccggcatctatccgctgccgacgcccggcggctggcagctgattggccgcacgccgctggcgctctttgatccgcacagcgctgaacctgttctgctgcgccccggcgacaccgtgcgttttgtgccgcaaaaggagggcatatgctgaagattattcgcgcggggatgtatacctccgtacaggccggaaaacgcaaagggctgcgccagtccggcatcagctatagcggcgcgatggacggcccggcgctggaaatcgccaatgcgctggtgggcaacgaggccgacgccgccgcgctggaaattacgctcggccagtgcgaaatcgaattcacccacgacggctggtttgcgctgaccggcgcaggctgcgacgcgcagcttgacggcaaagcggtgtggaccggctggcgtcaggcgatgagcgcagggcagcgtttgaccctgaaaagcccgcagcgtggtatgcgcagttatctggccgtggcgggcgggatcgatgttccggaagtgatgggctcgcgcagtaccgatttaaaaaccggcaccggcggctttaagggccggttgctgaaagagggcgacgtgctgccggtgctgcccgcgtcgcggcagttcagcggtccgcagggcgtcaaacagttactctggggcaaccgcatccgcgtgctgccggggccggaatatcactccttcgataaaaactcccttgaggcgttctggcgcttaccctggcagttaagcccgcagagtaaccgcatggggtatcgtttacagggggcgcagctgacccgcaccgacacccgcgagctgctgtcccacgggctgatccccggcgtcattcaggtgccgcacaacggtcagccgattgtgctgatgaacgacgcccagaccaccggcggctatccgcgtatcggctgtgtgatcgaagcggatatgtatcatcttgcgcagatccgcctcggcgatccgatccattttgtgccctgcacgttagaagaagcgctgaaggcgcgacgcgagcagcggctgttccttgaccagctggcttacggagtgcgcggtgatcgttgatcttaatgccgatctgggggagggcgcgggctgtgacgccgcgctgctgcaactggtttcttctgccaacatcgcctgcggttttcacgccggtgacgcgcagatgatgcaggacgcggtacgcgaagcgctgaaaaacggcgtcgccattggcgcgcacccctccttcccggatcgggaaaactttggccgcacggcgatgacgctgcctgcggacaccgtttatgcgcagatgctgtatcagatcggcgcgctggcggccattgccagggcgcagggcgggcaggtgcagcacgtcaaaccccacggcatgctctataaccaggcggcgcaggacgcggtgctggcggatgccatcgcccgcgcggtgcacgatctggatccgacgctcattctggtggggctggcgggtagcaagctcatcgacgcgggcaggcactatggcctgccaacgcgcgaagaagtctttgccgaccggggatatcaggacgacggcactctggtgccgcgctcgcagcccggcgcgctcatcagcgatgaagagcaggcgctggcgcagacgctgaccatgatccagcagggccgggtgaaaagcattcacgacaattgggtgaaggtgaacgcgcaaaccgtctgtctgcatggcgacggcgatcatgcgctggcctttgcgcgccgcctgcgacaggcgtttgaggcacataacattaccatttcggcggtgcagcatgcctgaaggcccggagatccgccgggcggcggatacccttgaagcggctatcggcgggcaaccgctgaccgacgcctggttcgcctttgaccgtctgcaaccctacgccgctgatcttatcggccagcatgtgacccatatggagacgcgcggtaaagcgctgctgacgcatttttccggcggcctgacgctgtacagtcataatcagctgtatggcgtctggcgcgtggtaaaagcgggggaaacgccgcagacgacgcgtattctgcgggtgaagttgcagaccgccgaacgcgcaatactgctctacagcgcctcggacattgagatgctgacaccggagcagctggcaagccatccgttcttacagcgcgtcggccctgacgtgctggacatgagcctgacggtggaggaggtgaaagcgcggctgtgctcgccaaaattctgccgccgacagttttccggtctgctgctggaccaggcgtttcttgccgggctgggcaattatctgcgggtggagatcctctggcacagcgggcttgcgccaacgcataaagcggcgcaattaagtgacgcgcagatcgaggtgctggcgcaggcgctgctggatattcccaggctctcgtaccagacgcgcggcaaggcaaaagagaacaaacatcacggggcgctgtttcgctttaaggtgtttcaccgggcagggaagaaatgtgagcggtgcggggggatcattgagaaaaccacgctgtcgtcgcggccgttttactggtgtccggggtgtcagatttgatgtgaaaagccgggtggcgctgacgcttacccggcctgtggttactggctgaattcgtaggcccggcaagcgaagcgccgccgggcgccacaaaccttagcggttcgtcagttccgatttgaaatcacgctgctcgtaaccggtgtacagctggcgcggacgggcgatcttgatgccgtcgtcgtgcatttcgttccagtgcgcgatccagccaacggtacgggccatcgcgaagatcaccgtaaacatggaagacggaatacccatcgctttcaggatgataccggagtagaagtccacgttcggatagagcttacgctcgatgaagtacgggtcgttcagcgcgatgtgttccagctccatcgccacttccagcagatcatctttggtgcccagctctttcagcacttcgtggcaggtttcacgcattacggtggcgcgcggatcgtagtttttgtaaacacgatgcccgaagcccatcagacggaacgaatcgttcttgtctttggcgcgacgcacgaattccggaatgtgctcaacggtgctgatctcttccagcattttcagcgcagcttcgttcgcgccgccgtgtgccggtccccacagggaagcgatacctgccgcgatacaggcaaacgggttcgcgccggaggagcctgcggtacgcacggtagaagtagaggcgttctgctcatgatccgcgtgcagcacgaggatacgatccatcgcgcgttccagcaccgggttcacttcgtacggctcgcacggcgtggagaacatcatatgcaggaagttaccggcataggagagatcgttacgcggataaacaaacggctggccgatagaatatttgtaacacatggcggcgaccgtcggcattttggacagcagacggaatgcagcgatgtcacggtggcgcggattgttgacgtccagcgagtcatgatagaaagccgccagcgcgccggtcacgccgcacagcacagccatcgggtgtgaatcgcgacggaaaccgtggaacagacgggtgatctgctcgtggatcatggtgtgacgggtgacgatggtgcggaaatcgtcatactcttcctggctcggtttttcaccgtacagcaggatgtagcacacttccagatagttggattcagtggctaactgatcaatcgggaaaccgcgatggagcaggataccttcgtcaccgtcgataaaggtgattttggattcgcaagatgcggtagaggtgaaaccagggtcaaaagtaaatacccctttcgaacccagactacgaatatcaataacatcctgaccgagcgtgccttttagcacatccagttcaatagcatcttcactattgtaagtgatggttgctttcttatcagccatttacggtctccttagcgccttatgcttaagactgcacagaagccggatttgcattcatagcgaaaatcaatgttaccaatttgttatttggcacgacactctgcagagaggtggtaccagggtacagagcgatgggcgctggcaggcaaacattgaaaaaccagtgaaacaacagcaaatcagggtcttagcagtccgaatttgtcaaatctgtctatcactaataactgtactgataacgtcggtcaatccttctcactcttacataactaaatctcaggtgaaagagagaccccataacttttacgaattatatgccttttcggctgtcgtttgtaacaataatgtttaactattgtcaaatcccatggttaaaaattaaaaatatgttgttatcgtgatgacggtcactgttccgcataaaacccgacaaactatatgtaggttaattgtaatgattttgtgaacatcctatactgccgccaggtctccggaatcctctgccgtcccgagccacccagcgttgtaacgtgtcgttgagcatctggaagcgatgttatttgcataacgtgcggttattgaaaggacgctgtctgacccgcctgcagaccggaggaaaggaactataagaacagcatgtgggcgttattcatgataaaaaatgtcaaaaaacaaagacctgtcaatctggatctgacaacgatccggtttcctgttacggctatagcgtccattctgcaccgtgtttctggcgtcatcacttttgtggcggtcgggatcctgctgtggttgctgggcctgtcgctctcctctcaagaaggcttccagtcagccgccgccatcatggacggcttcttcgctaaattcatcatgtggggcattctcaccgcgctggcatatcacgccgtcggtggtattcgtcatgcattgatggatgtgggctatcttgaagagaccttcgaagccgggaaacgctctgcctgggtcgctattggtattactgtcgtgctttcaattctcgcaggagtcctcgtatggtaagcaacgcctccgcattcggacgcaacggcgtacatgacttcattcttgttcgtgctaccgccctcgttctgacgctttacatcatctatatggtcggttttttcgccatttccggcgagatcacttatgacgtctggacgggtttcttctcatccgcctttaccaaagtcttcaccctgctggcgctgttctccacgttaattcatgcctggattggcatgtggcaggtgctgaccgactacgttaaatcaacgggcctgcgtcttggtctgcaactcgccattgtggttgcgctgctggtttacgttatttatggatttgttgtggtgtggggtgtgtgatgaatttaccagtcagagagtttgatgcagtcgtcattggtgccggcggcgcaggtatgcgcgcggcgctacaaatttcccagagcggccagacctgtgcgctgctctccaaagtattcccgacccgttcccacaccgtatctgcgcagggcggtattaccgttgcgctgggtaacacccacgaagataactgggaatggcacatgtatgacacggtgaaaggttccgactatatcggtgaccaggacgccattgaatatatgtgtaaaaccggcccggaagcgattctggaactggaacatatgggtctgccgttctcccgtctggaaaacggctctatctatcagcgtccgtttggcggccagtcgaaaaacttcggcggcgagcaggcggcacgtaccgccgcagcggctgaccgtaccggccacgcgctgttgcataccctttatcagcagaacctgaaaaatcacaccaccattttttccgaatggtatgcccttgacctggtaaaaaaccaggatggcgcggtggtaggttgtactgcgctgtgcattgaaaccggcgaagtggtgtacttcaaagcccgcgctaccgtgctggcgacaggcggcgcaggccgtatttaccagtccaccactaacgcccacatcaataccggcgacggtgttggcatggcgctgcgcgctggcgtgccggtgcaggatatggaaatgtggcagttccacccgaccggcatcgccggtgcaggcgttctggtgacagaaggctgccgtggtgaaggtggttatctgctgaacaaacacggcgagcgctttatggagcgttatgcgccgaacgccaaagacctggcgggtcgtgacgtggtggcgcgttccattatgatcgaaatccgtgaaggtcgcggctgcgacggtccgtggggtccgcacgcgaaactgaagctcgaccacctgggtaaagaagtgctggaatcccgtctgccgggcattctggaactttcccgcacctttgcgcacgtcgatccggtgaaagagccgatcccggtgatcccgacctgtcactatatgatgggcggtattccgaccaaagtgaccggccaggcgctgaccgttaacgcccagggcgaagacgtggtgatcccgggcctgttcgcggtaggcgaaatcgcctgcgtatcggtacacggcgctaaccgcctgggcggcaactcactgctggatctggtggtatttggtcgcgcggctggtctgcacttgcaggaatctatcgccgagcagggcgcactgcgcgatgccagcgaatccgatatcgaagcttccctgacccgcgtgaatcgctggaacaacacccgtagcggtgaagatccggtgaccattcgtaaagcgttgcaggaatgtatgcagcataacttctcagtattccgtgaaggggatgcgatggcgaaaggactggagcagctgaaagagatccgcgagcgtctgaaaaccgcgcgtctggacgatacctccagcgacttcaacacccagcgcgtcgaatgccttgaactggataacctgatggaaacggcttacgccacggcagtatcggcgaacttccgtactgaaagccgtggagcgcacagccgctttgacttcccggatcgtgacgacgaaaactggctgtgccactccctgtatctgcctgaatcggaatccatgacgcgccgtagcgtcaatatggaaccgaaactgcgtccggcattcccgccgaagattcgtacctattaatgcggagacaggataaatgaaactcgaattttcgatttatcgctataaccctgatgtcgacgacgcgccgcgtatgcaggattacaccctggaaggcgaagaaggccgcgacatgatgctgcttgatgcgctgatgcagctgaaagaaaaagatccgacgctggcgtttcgtcgctcctgccgtgaaggcgtgtgcggctccgacggtctgaacatgaacggcaagaatggcctcgcctgcatcacgccgatttcggcgctgggtaacggcacgaagaaaattgtcatccgcccgctgcccggtttgccggtcgtccgcgatctggtggtggacatggggcaattctatgcccaatatgagaagattaagccttacttgttgaataatggacataatccgccagctcgcgagcatcttcagtcgccagagcagcgtgaaaaactggatgggctgtacgagtgtattctctgtgcatgctgttccacatcctgtccgtcattctggtggaacccggacaagttcatcggcccggcgggtctgctggctgcgtatcgcttcctgatcgacagtcgcgataccgaaaccgatcagcgcctcgaagggctgagcgatgctttcagcgtatttcgctgccatagcatcatgaactgcgtcagtgtgtgtccgaaggggctgaacccgacgcgcgccatcggccatattaagtcgatgctgctgcaacgtagtgcataagtaagattgccggatggcgctgcgcttatccggcctacagttaagtaggcccggtaaacgcagtgccaccgggcaaaccgagtgaaaatgcaggaaacctctaaaaactgccctgacagagagacagtttttaaaggttccttcgcgggccaactcagtgaaaagagctcgcaagtgaaccctggtacgtgcgcctggcggtgtacggtgtagttatccacggcgaataagcataccaatgcttaagggatcacgatgcagaacggcgcaatgaaagcctggctggactcttcttacctctctggctccaaccagagctggatagaacagctctatgaagacttcttaaccgatcctgattcggtagatgaaaactggcgctctatgttccagcagctaccggtgaccggtatcaaaccggaccaattccattccaaaacacgtgattatttccgtcgtctcgcgaaggatgcctcacgttatacctcttcagtttctgaccctgacaccaacgtgaagcaggttaaagtcctgcaattgatcaacgcctaccgcttccgcggccaccagcatgcgaatctcgatccgctgggactgtggaaacaagagcgcgtggccgatctctccctcgattatcacgacctgaccgaagccgatctggaagaaagtttcaacgtgggatcttttgccatcggcaaagacaccatgaaactgggcgagctgttagaagcgctgaaacaaacctattgcggttcgattggcgcggagtacatgcacatcaccagcaccgaagagaagcgctggatccagcagcgtatcgaatcggcagcgggtcatggcattttcagcgccgaagagaaaaaacgcttcctcagcgaactgacggcggcggaagggatggagcgctatctgggcgcgaaattccctggcgcgaaacgcttctcgctggaaggcggcgacgcgctggtgccgatgctcaaagagatgatccgtcatgccggtaagagcggcacgcgcgaagtggtgctgggtatggcgcaccgcggacgtttaaacgtgctgatcaacgtgctgggcaaaaaatcccaggatctgtttgacgaattcgccggtaagcataaagaacatctgggcacgggcgatgtgaaataccacatgggcttctcctcggatatcgaaaccgaaggcggcctggtgcacctggcgctggcgtttaacccgtcgcacctggagatcgtcagcccggtggtaatgggttctgtgcgcgcccgtctggatcgtctggacgagccgagcagcaacaaagtactgccgatcaccattcacggcgatgcggcggtaaccggccagggcgtggtgcaggaaaccctgaacatgtcgaaagcgcggggctacgaagttggcggtaccgtgcgtatcgtgatcaacaaccaggtgggctttaccacctctaacccgctggatgcccgttccacgccgtactgtactgacatcggtaaaatggtgcaggcgccgattttccacgtgaatgcggacgatccggaagccgttgctttcgtcacccgtgtggcgctggatttccgtaacaccttcaagcgcgacgtgtttatcgatctggtgtgctaccgccgtcacggccataacgaagccgacgagccaagcgcaacccagccgctgatgtaccagaaaatcaaaaaacatccgacgccgcgcaaaatctacgccgacaagctggagcaggaaaaggtcgccaccctggaagatgccaccgaaatggtcaatctttaccgcgacatgctcgatgcgggtgaatgcgtggtgaaagagtaccgtccgatgaacatgcattcgttcacctggtcgccgtatctgaaccacgagtgggatgaaagctacccgaacaaggtagagatgaaacgtctgcaggagctggcgaagcgcatcagtacggtgccggatgccatcgaaatgcagtcccgcgtggcgaaaatttacggcgatcgtctggcgatggcggcaggcgagaagctctttgactggggcgcagcggaaaaccttgcttacgcgaccctggttgatgaaggcatcgcggtgcgtctgtccggcgaagatgccggccgcggcaccttcttccaccgtcatgcggtgatccataaccagaccaacggctccacctggacgccgctgcatcatgtccacaattcacagggcactttccgcgtctgggactccgtgctctctgaagaagcggtgctggcgttcgaatacggctacgcgactgcagaacctcgtaccctgaccatctgggaagcgcagttcggcgacttcgctaacggcgcgcaggtggtcattgaccagttcatcagctccggcgagcagaaatggggccgtatgtgcggtctggtgatgctgctgccgcacggctatgaaggtcagggtccggagcactcctccgcccgtctggagcgttacctgcaactctgtgcagaacaaaacatgcaggtctgcgtaccgtccacaccggcgcaggtgtaccacatgctccgccgtcaggcgctgcgcggtatgcgccgtccgctggtggtcatgtcgccgaaatcgctgctgcgtcatccgctggcggtatccagccttgacgaactggcgaacggcaccttcctgcctgctattggcgagatcgacgatatcgatccgcagggcgtgaagcgggtcgtgctctgttctggtaaggtttattacgacctgcttgagcaacgtcgtaagaacgaccagaaaaacgtcgtcatcatccgtatcgaacagttgtatccgttcccgcaccaggcggtgcaggaagccttaaaaccttatgcccatgtgcatgattttgtctggtgccaggaagagccgctgaaccagggcgcatggtactgcagtcagcatcatttccgcgaagtgatcccgtttgggtccgctctgcgttatgccggtcgtccggcctccgcctctccggcggtagggtatatgtccgttcaccagaaacagcagcaagatctggtcaatgacgcgctgaacgtcgattaattaaaggataaataatgagtagcgtagatattcttgttcccgacctgcctgaatccgttgcagacgcgactgtagcgacctggcacaaaaaaccaggcgatgcggttacccgtgatgaagtgctggtagaaatcgaaactgacaaagtggtactggaagtaccggcgtcggccgacggcattctggacgcggtgctggaagaagaggggaccaccgtcacctcccgccagatcctgggtcgtctgcgcgaaggcaacagcgcaggtaaagagagcagcgcgaagtccgacagcaatgagtccactccggctcagcgccagcaggcatccctggaagaacagaataacgaggccttaagcccggcgatccgtcgcctgctggctgaacatggtcttgaagcgggtgcgattaaaggcaccggcgtgggtggccgtctgacccgcgaagatgttgaaaaacatctggcgaaagcgcctgccgcaaaagaagaaaaagcgccggctgcaccggctcctgccagcgcgccgtcccagtctgcgccagcgctgggcaaccgctccgaaaaacgcgtgccgatgacccgtctgcgtaagcgcgtggccgagcgtctgctggaagcgaaaaactcaaccgccatgctgaccacgttcaacgaagtcaacatgaagccgattatggatctgcgtaagcagtacggtgacgccttcgaaaaacgtcacggcatccgtctgggctttatgtccttctacgtgaaagccgtggtggaagccctgaaacgcttcccggaagtgaatgcctccattgatggcgatgatgtggtgtaccacaactatttcgacgtcagcatggcggtgtccaccccgcgtggtctggtcacgccggtactgcgtgacgttgacgcgctgggcatggccgacattgaaaaacgcatcaaagatctggcggtgaaaggtcgcgacggcaaactgaccgttgaagatctgaccggcggtaacttcaccatcaccaacggtggtgtgttcggttccctgatgtccacgccgatcatcaacccgccgcagagcgccattctgggcatgcacgccattaaagatcgcccgatggcggtggatggcaaggttgagatcctgccgatgatgtatctggcgctgtcgtacgatcaccgcctgatcgatggccgtgaatcggtgagcttcctggtggccattaaagagctgctggaagatccgacgcgtctgctgctggacgtgtagtaataagaagatcacctgctccgtaggcctgataagacgtgacaacgtcgccatcaggcgttgcaccatcgccggatggtggcgttaccgccttatccggcctacggatctaaaaaacgattacctgaaaagtggatagaacacatgaacttacatgaataccaggcaaaacaactttttgcccgctatggtttgcccgcgccggtaggctatgcctgcaacactccgcgcgaagccgaagaagccgcgtctaaaatcggtgccggtccgtgggtggtaaaatgtcaggttcacgccggtggccgcggtaaagcgggcggtgtgaaagtggtgaagagcaaagaagagatccgtgcttttgctgagcactggctgggcaagcgtctggtgacctaccagacagacgcccacggtcagccggttaaccagatcctcgtggaagccgcaaccgacatcgataaagaactgtatctgggcgcggtagtggatcgcagctcccgtcgcgtggtgttcatggcgtctactgaaggcggcgtggaaatcgaaaaagtggcggaagaaaccccgcacctgatccacaaagtggcactggatccgctggccggcccgatgccgtaccagggacgcgaactggcgttcaaactgggtctgcagggcaaacaggttcagcagttcaccaagatcttcatgggtctggcgaacatcttcctggagcgcgatctggcgctgatcgaaatcaacccgctggtgatcaccacccagggcgatctgatttgcctcgacggcaaactgggcgctgacggcaacgcgctgttccgccagccggatctgcgcgaaatgcgtgaccactctcaggaagacgcccgtgaatctcaggcggcacagtgggaactgaactatgtggcgctcgatggcaacatcggctgcatggtgaacggtgcgggcctggcaatgggcaccatggacatcgttaagctgcacggcggcgaaccggctaacttccttgacgtgggcggcggcgcgaccaaagagcgcgtaaccgaagcgttcaaaatcatcctctctgacgacaaagtgaaagccgttctggttaacattttcggcggcatcgtacgttgcgacctgatcgctgacggcatcatcggtgcggttgaagaagtgggcgtgaacgtgccggtcgtggttcgtctggaaggtaacaacgccgaactgggcgcgaaaaaactggctgacagcggcctcaatattatcgcagcgaaaagtctgacggatgcagcacagcaggttgttgccgcagtggaggggaaataatgtccattttgatcgataaaaacaccaaagtgatctgccagggcttcaccggcagtcagggcacgttccactctgagcaggcgattgcctacggtacgcagatggttggcggcgtgacgccaggcaaaggcggtaccacgcacctcggcctgccggtgttcaacaccgtgcgcgaagcagtagaagccaccggcgcgaccgcgaccgtgatctacgttccggcgccgttctgcaaagactccattctggaagctatcgacgcaggcattaagctgatcatcaccatcaccgaaggcatcccgacgctggatatgctgaccgtgaaagtgaagctcgacgaagcgggcgtgcgcatgatcggcccgaactgtccgggcgtgatcacgccgggcgaatgcaaaatcggcatcatgccgggccacattcaccagccgggtaaagtgggcatcgtctcccgctccggtaccctgacctatgaagcggttaagcagaccaccgactacggcttcggccagtccacctgtgtgggcatcggcggcgatccgatcccgggctctaacttcatcgacatcctgaagctgttccaggaagatccgcagaccgaagcgatcgttatgatcggtgagatcggcggcagcgcggaagaagaagcggcggcgtatatcaaagatcatgtcaccaaaccggttgtcggctacatcgcaggcgtgaccgcgccgaaaggtaaacgtatgggccacgcaggcgcgatcatcgcgggcggcaaaggcacggcggatgagaaattcgcagcgctggaagcagcaggcgtgaaaaccgtgcgcagcctggcagacatcggcgaagcgctgaaaagcatcatctgatcttactgaagtaagacaataataacgttcgacatggttggccatcgcaagatggccttttttattgccgccgttttgccaccagcgtgaatttatagtcgtcgcttttgaacagattgcggctgtactcgaacacttccccgcttttcagaaaaccgcgtgagatcttctcaaggatcggtctggcaggatcaatccccagcgcgtcgaccgcctcctcgtcgggcatcaccggcacgatctcctgctcgctgcgatcgataacccgctttttcacctgctcgataaaatggtatttggagttttccatcacctcccaggtgagatcaggaaagagcgcaagcggcatccaggtctcttccagcgccaccggcttttgcctgataaagcgcacccgcttcacatgccaggctttatcaccaggggtaaggtgcagctgcgccgccagcgtttcatccgttttgatcacttcgaacacctgcacttcgctgtgcgtatcggcatgacgatcgccgagcttttccgaaaagctggtcagctgatagatgtcgtaattcacgcgctcctctttcacataggagccgctgccctgaatgctttcaataattccctgttccgtgagctgtttcagcgcctggcgcaccgtgacccgactgacgctaaactgcgcctgtaaggccgactcggtaggcagcgcatcccccggcttcagttcgccgctttcgatctgcgtgcggatcgccccggcgatctggcggtacattggctgtctgctcatggaaccctcgtgttgtaccagacaaatatccccgattatgcccggcgcggcgctgaagtaaataatacaaatttaatacaactattcattaagttgaatttgatcgcaaaattgtatggttagatcgcacagaatgccttcgtctgaagccgtcatggtggcggcttacccaggactcaatgaggaagagatgaacctgacggcattaactcacccggacgcctgcctgatccagacgcagttcgtcagtcgggacgacgccattcgtgcactggccgtgcggctgcaccagctgggcaacgtgcgcaatctggatgaatttgtgaacgaagtgctgcgccgcgaagcggatggcccgacggcgctcggggaagggctggcggtgccgcacggcaaaaccgacgcggttgtagaggcggccttcgctgtcgccaccctgcgtgagccgctgatgtgggaaggtatcgatggcccggagccggtgacgctgattgttctgcttgccattccctgcgccgaagccgctaccacccatatgcaactgctgacccggctgaccagtctgctggcggatgacgccctgcgcgaacaggtgcagggggcaaacaacgccgacgaactgctggcgctgctggcagaggcacccgcagagaaaacgccgctaaccctgcgcgatgcgccgacggtggtctgcgtcaccgcctgtccggcgggcatcgcccacacctatatggcggcggaatatctggaaaacgccgggcgcaggcgcggcattcaggtgtatgtcgaaaagcagggggcgaacggcattgaggggcgcttaaccagcgagcagctgaaagccgcccgcgcctgtatcctggcggctgatgtggcggtaaaggacgccgaacgctttcagggtatcccgacgctggcggtaccggtggcggaacccattaaacaggccgatgcgctgcttacccgggcgctggcgcttgatgccagcaccgaaccccggacggcggcaccccttagcgttaaaaccgagctgaagcaggcgctgctgagcggtatttcctttgccgtgccgctcatcgtcgcgggcggaaccgtgctggcggtgtcggtgctgctggcgcagattttcggtctgcaacacctgttcgagctggaaaactcctggctgtggctgtaccgcaaactgggcggcggcatgctcggcaccctgatggtgccggtgctggcggcctacactgcgtattcgctggcggataaaccggcgctgaccccaggcttcgcggcggggctggcggccaatatgataggcgcgggctttctgggcgcggtggtgggcgggcttatcgctggctacctgatgcgccaggtgaaaatccatatccggctgggcagccgttataacggctttctgaccttttatctctatccggtgctgggcacgctgggggcgggcagcctgatgctgtttgtcatcggtgagccggtggcatggctgaaccagggactcaccgcctggctgaacggcttgtccggcagcaatgcactgctgctgggcgctattatcggctttatgtgttcctttgaccttggcggcccggtgaataaagccgcttacgccttctgcctgggggcgatggcgaacggcgtatacgggccttacgccatttttgcggcggtaaaaatggtctctgcgtttaccgtcaccgcctcgaccctgcttgctccccgcctgttcagagcatttgaaatcgaaaccggtaaatctacctggctgctggggctggcggggatcaccgaaggggcgatcccgatggcgattgacgatccgctgcgggtgatcggcgcttttgtgatcggatcgctggtcacgggggcgctggtgggtagcgcgggcatcgggctgtcgacgccgggggcggggatcttctcgctgtttttactgcatgacaacgggctggggggcgttaccgccgccgccatctggtttgccgcggcgctgctgggcgcggcaatttccaccgctattttgctggcatggcgtgctcacgcggtgcgtagcggcacatatcttaccgatcgccattaaaggacagaacgatgaaaaaggtatcgcgcgtgcacatcacgccgcatatgcactgggatcgtgaatggtacttcaccagcgaagagtcgcgcattttactggtcaacaatatggaggagatcctcacccgcctggagcaggatgcggagtacaaatactacgtgctcgacgggcaaacggcggtgctggaagattatctcgccgttaaaccgcagaacgcgccgcgcataaaagcgcaggtccaggcgggaaaactgatcgtcggcccctggtatacccagaccgacacctgcatcgtggcgggggagtcgattgtgcgcaatctgctgtacggcatgcgcgactgccgggcctttggcgagccgatgaaaattggctatctgccggactccttcggcatgtccggccagctgccgcacatctataacggttttggcattacccgcgccatgttctggcgcggctgttcagagcggcacggcaccgacaaaaccgagtttatctggcaaagccgcgacggcagcgaagtcatcgcccaggtgctgccgctgggctatgcgatcggcaaatatctgccggaagacgaagcgggtttgcgcaagcggctggagagttactttgcggtactggaaaaggcctcgctgaccggggagatcctgctgccaaacggtcacgaccagatgccgctccagcagaatatttttgccgtgatggaaaaaatgcgccagatctggccgcagcgcgaatttgtgatgagccgcttcgaagacgtatttgaactgatcgaacagcaacgggagaggctgccgcggctgaccggcgagtttatcgacggcaaatacatgcgcgtgcatcgcaccatcggttcgacgcgcatggatataaaactggcccacgcgcgcatggaaaaccgcattgtaaacctgctggagccgctgtgcgccatcgcctggcggctgggctttgagtatccgcacgggctgctggagaagatgtggaaaacgattttaaaaaatcacgcccacgacagcattggctgctgttgcagcgataaggtgcatcgcgaaatcctggcgcgctttcagcaggcggaggacatggcagaaaatctgctgcgcttcacccagcgcaaaatcgccgacggccagcccggcgatggcgacaagctggtgctcttcaacctgatgccgtacccgcgcgaagaggtgatcaacaccaccctgatcttacgcgccagccagttccgcctgcgggatgtcgacgggcgcgaggtggcgtattttattcgcggtaagcgggagatcgatccgggacagattgaccggcaaatcgtccattacggcaattacgatccctttatggcctttgacatacagctgatacagacgctgcccgccatgggctacagcacgctgtttatcgagcctgacgtgcccggcatgctggccgcgccgctcgcatccccgcgcacggcgcttatggaaaacagcttctgggaaatcagcctgaatgacgatggcacgctgcatctgcgcgataaagcgaacgggcaggtttatgaccgggtgctgaccctggaagaaagttctgacgacggcgatgaatatgactactccccggcgcgcaaagagtggctgctcacctctttacagtcgacacatacccatgaggtgatccacgaggcctggcagagcagggcggttattcgcgtcgcgctggcggttccacttaacctggacgagcgggcggcgcgtcttaccagcgggtcgctcggggcggaattccatgtcacgttaagtcacaacagccgccgtatcgacattgaggtacagctggataaccaggcggatgaccaccgcgtgcgggtgctgatccccacacctttcgtcaccgatcacgtgctggcggatacgcagttcggtacggtttcgcgcccggttaatgacggcgcgatggcggactggcaggcgcagggatggaaagaagcgccggtgtcggtgtggaatatgctcagctataccgtgctgcaacaggcggagcacgggctggcgctgttcagcgaagggctgcgtgaatttgaaattgtcggggaaggggagaaaaccttcgccctgacgctgctgcgcggcgtgggaatgcttggcaaaagcgatctgctgctgcgccccggcagaccgtcgggcattgggctgccggtccccgactctcagctgcgcggacggctgcaaagccggttcagcctgtggagcttcagcggcgatccccttgacgccggggtggcgcagcaggcgcgccgctggctgacgccggtgcagtgctataacaaaatcccatggaacgcgatgaagctcaacccttcgccgcaggtgacgccggcgcattacagtctgctgactctgccgccgcatggctgccagctgagcgcgctcaaaaaagcagaagatcgggacaggttaatcatcaggctgtttaacccgtccgcgaccaccctctgcgggacgcggctggccttcagcggtccggtgagcctgcgcgaaaccggtatggatgagcaaccccgtgagcggggtgaagaggaatggcagcgcttatcgccgggacagtccgtgacgctggaagtggcatttcctgaataagctcattctcatctcgtattaattatcggttttttaacatttatccctttataaaagtcgcgccccgggaaattattttcgtggcgcgaacacctcgttgtgaaattaaaaattacgttgtgcgaaatttattattaaaatgcagaaatcaggtaaatattgactccttttataaacataattttaacatggtttttaccaatacattcattggtgacacaacgttaacaaacgcgccaaaaattgatttaaatcaatatttaaatcgtggaaaaagactttaaaaaacgttaaattgctcccgatcaaattggttgaaaagtagtagaatgccgataaattgatccccgtcgaaaaactcaaaagagcatcaataaaaacctgtttattgtaagggttttgcggcgtaatatattgcgggatcaatttagggtgttttttaacgtatctttaacttttctttgcgcctgtcactttcattcgaataacagcgacaaagaacagcgcggatatttttgtaatggggcatgtgtgtaaatccgtttgccgggtttactcccgaagtcttcatgcgttgagcaaggagtcatgatgttagatatagtcgaactgtcgcgcttacagtttgccttgaccgcgatgtaccacttcctttttgtgccactgacgctcggtatggcgttcctgctggcgatcatggaaacggtgtacgtcctctccggcaaacagatttataaagatatgaccaaattctggggcaagttgtttggtatcaactttgcgctgggtgtggcaaccggcctgaccatggagttccagttcgggactaactggtcttactattcccactatgtgggcgatatcttcggtgcgccgctggccattgaaggtctgatggccttcttcctcgaatccacctttgtaggtctgttcttcttcggttgggatcgtctgggtaaagttcagcacatggccgtcacctggctggtggcgctgggctctaacttatccgcattgtggatccttgttgctaacggctggatgcaaaaccctatcgcgtcggatttcaacttcgaaaccatgcgtatggaaatggtgagcttctccgagctggtgctgaacccggtcgcgcaggtgaaatttgttcataccgtagcctcgggttacacctgcggcgccatgttcatcctcggcatcagcgcctactacctgctgcgcggccgcgatgtcgcctttgccaaacgctcttttgccattgcagcgagcttcggtatggcggcgatcctctctgtgatcgtgctgggtgatgaatccggttacgaaatgggcgacgtgcagaaaaccaaactggcggcgattgaagccgagtgggaaacgcaaccggctccggcggcatttaccctgtttggtattcccgatcaggaaacccaggaaaataaatacgccatccagatcccgtatgcgctgggccttatcgccacgcgttccgttgatacgcaggttatcggcctgaaagatctgatggtgcagcatgaagagcgtatccgtaacgggatgaaagcctaccagctgctggaagagctgcgtgccggatcaaccgatcagaacgtgcgcgatcagttcaacagcatgaagaaagacctgggttacggcatgctgcttaagcgctataccgagaatgtcactgacgccaccgaagcgcaaattcagcaggcaaccaaagattctattccgcgcgttgcgccgctctacttcgccttccgtatcatggtaggtagcggcattctgatgctgtttatcatcggcttctctttctggaccgtctgccgcaaccgtatcggttctaaaccctggctgctgcgcgctgccctgtacggtatgccgctgccgtggatcgccatcgaagcaggctggtttgtcgcagaatatggccgtcagccgtgggcgattggtgaggtgctgccgactgccgtggcgaactcctcgctgaccatcggcgatctgctgttctcgatgatcctgatttgcggtctgtacacgctgtttatggtggcggaagtattcctgatgttcaaattcgctcgccttgggccgagcagtctgaaaacaggtcgttatcatcacgagcagcctaccgtggcttctcagccggcacgctaagacaggagtcgtcaaatgatcgattatgaagtattacgttttatctggtggctgctggttggcattctgctgattggttttgcggtcaccgacggcttcgacatgggcgtagggatgttaacccgcgtgctgggtcgcagcgacacggaacgccgtatcatgattaacgccatcgccccgcactgggatggcaaccaggtatggcttatcaccgctggcggcgcgctgttcgctgcctggccgatggtctatgccgccgcgttctcgggcttctatgtggcgatgatcctcgtgctggcgtcgttattcttccgtccggttggttttgactaccgctcgaagatcgaagacacacgctggcgcaacatgtgggactggggcattttcatcggcagcttcgtaccgccgctggtcattggcgtggcgttcggcaacctgttacagggcgtgcctttccatatggatgaatacatgcgcctgttctacaccggcaacttcttccagctgctgaacccgtttggcctgctggccggtgtggtgagcgtggcgatgatcgtcacccagggggcaacctatctgcaaatgcgtaccgtcggtgaactgcatctgcgtgtgcgtggcgtggcgcagatcgccgcgctggtaaccctggtgtgcttcgcgctggcaggcgtgtgggtagtgtatggtattgacggttacgtggtgacctcggttatcgatcatcatgccgcctctaacccgctgaccaaagaagtggcgcgtcaggctggtgcctggctggtgaacttcaacaacacgccgatcctgtggctggtgccagcgctgggcgtcgtgctgccgctgatgaccaccctgatgtcacgtcttgagaaaccggcgtttgccttcgtcttctcatcactgacgctggcgtgcatcatcctcaccgcgggcatcgccatgttcccgttcattatgccgtccagcacgatgatgaacgtaagcctgacgctgtgggatgcgacctccagccagatgacgctgaatctgatgacctgggttgcggcggtgtttgtacctgtcattcttctttataccgcatggtgttactggaagatgttcggtcgcatcaccaaagaagacattgaaagcaacactcactctctgtactaagtaaggagcatacaatgtggtatttcgcatggattttaggaacgcttcttgcctgcgcattcggagtgatcaccgccctggcgcttgagcacgtagaagcgactcaggcaggtaaagaagaacactgatgaacgctattatcgcaaaactctatgcggtaatggataagggcccgcttcgggccctttccttagtgatggcgctggtgttggcaggctgcgtattctgggatcctgcccgctttgccgcgaagaccagcgactacgaaatctggcaaggtttcctgatgatgtgggccgtctgtagcggcgtgatccacggggttggttttcgtcctgctgccgttcactggcagggcatattttgcccgctcatcgcagacatcgtgctggctgccgcgctgttttattttttcttttgactaagaactgtccgttaacgtcatgggcttgtaaaagcccataaatttttactctccgttcacctgaacccattccaaagcaacattcccgcgcgtatagtagcaacgtttttgagcgctaacttttattgcattaccgggatgtaaagtgaatacaacgctgtttcgatggccggttcgtgtctattacgaagacaccgatgccggtggtgtggtttaccacgccagctacgtcgctttttatgaacgggcacgcacagagatgctgcgccaccacaactttagtcagcaggttttgctggcagagcgcgtcgccttcgtggtgcgtaaaatgacgctggactattttgcgcccgccagactcgacgatatgctcgaagtccaatcggaaattacatcagtgcgtggaacctctctggttttcacgcagcggatcgtcaacgcagagaacaccgtgcttaatgaagctgaagtactgattgtttgcgttgatccactcttaatgaagcctcgtgcgcttcccaagtctattgtcgcggagtttaagcagtgactgacatgaacatccttgatttgttcctgaaggcaagccttctggtcaaacttatcatgttgattttgattggtttttcaatcgcatcctgggccatcatcattcaacgcacgcgcatacttaacgcagccgggcgtgaagcggaagcctttgaagacaaattctggtcaggcatcgagctgtctcgcctgtatcaggaaagtcagggccgccgcgaaacgctctccggttcagaacagatgttctacagcggatttaaagagtttgcccgtttacatcgcgccaacagccatgcgccggaagcgatagtggaaggggcatcgcgtgcgatgcgtatctccatgaaccgcgaactggaagcgctggaaacgcatattccgttcctgggaacggtcggttccatcagtccttatatcggccttttcggtacggtatgggggatcatgcatgcctttatcgcactgggtgccgttaaacaggccacgctgcagatggttgcgccaggtatcgccgaagcgctgattgccacggcaatcggtctgtttgcggctattccggctgttatggcgtataaccgcctgaaccagcgcgtgaataaactggaacagaattacgacaactttatggaagagtttaccgctattctgcatcgtcaggcgtttaccagcagcgagagcaacaaggggtaagccatggccagaaagcgtggacgaggaagtcgcgaactcaagtccgaaatcaacattgtaccgctgctggacgtcctgctcgtgctgttgctgatctttatggcaaccgccccgatcatcacccagagcgtggaggttgatctgccggatgcgacagaatcacagagcgtcagtaccaatgatgatcctccggtcattatcgaggtctctggcgtgggacagtacagcgtggtgattgaaaaagatcgtctggatcaactgccgcctgaacaggtcattgccgaagcgcagcgtcacctgcaggcgaatccgaaaacggtcttcttaatcggtggtgcgaaagaggtgccatatgatgaaatcatcaaagcgctgaacctgttacacagcgcgggtgtgaagtcggttggcttgatgacgcagcctatttaatcctgcataacaggcgaacagtttttgggaaccgatagtgtcaaaggcaaccgaacaaaacgacaagcttaaacgggcgataaccatctcggcggtgctgcatgtgattttatttgcactgctgatctggagttcgttcgatgagcacatagacgcctctgctggcggcggcggtggttcatccatcgacgccgttatggtcgatcccggcgccgttgtacagcagtacaaccgtgagcagcagcaacaggcgagcgcgaaacgcgctgaagaacagcgtgaaaagcaggcgcaacagcaggcggaagagattcgcgagaagcaggccgccgagcaggagcgtttaaaacagctcgaaaaagaacgtttgcaggcgcaggaaaacgcccgcgaacaggcacaacagcagaaacaggcagaagaagcggcgaagaaagcgcaggagcagcaaaagcaggctgaagaagccgctgccaaagctgccgccgatgcgaaagcgcaggctgacgcccaggcgaaagccgccgcagatgccgcgaagaaagccgaagccgaggctgccaaagccgctgccgccgccgcgaagaaagcggaagccgaagccgccaaagccgccgccgatgctgcgaaaaaagccgaagcggaagctgcgaaaaaagcgcagcaggacgccgagaagaaagcacaggctgaagccgctaaaaaagccgctgccgctgaaaaagctgctgcggcgaaagcagccgctgctgaaaaggctgccgctgagaaagctgctgccgctgccgaaaaagccgcggccgcgaaagctgccgctgctgaaaaggccgccgctgataaaaaagctgcagctgagaaagccgctgccgataagaaagcagccgccgacaaagccgcagcagcaaaagccgccgctgcgaaaaaagccgcggcagagaaagccgccgcgtctgatgtcgacgacctgtttggcgacctcagctccggtaagaatgcgccgaaaaccggcggtggagcgaaaggaagtaatgcagcgccagcaggaagtggtaacactaaaaacaatggcgcttcaggggctgatatcagcaactatgctggtcagataaaagcagccatcgaaaccaagttctatgatgccgcatcctatactggcaaggtatgtacgctgcgcatcaggcttgagccagatggtacgttgaaagatattcagtctgaagggggcgatcccgcgctttgtcaggccgcacttgctgcagcccgtcaggcgaagctcccgaaaccgccgacgcaggcggtgtatgaagtgtttaaaaatgcgccactggacttcaaaccttaagatacacttttccacataacgccggaaaagggactattttagtcacggggtttcgatagttttgtctatttgagtttgttaacattctgctaaattatcgcaggttttcagcctggataagggagatatgatgaagcaggcattacgtgtagtgtttggttttctggtactgtttgcagcggcgctgcatgcagaagtgcgcattgagatcacccagggtgtcgactctgcgcgtcctattggcgtggtcccgttcaaatgggcaggtccgggcgcagcgccggaagatatcggcggtatcgttgccgctgaccttgcgaacagcggtaaattcaatccgctggatcgttctcgtctcccgcagcaaccggcttccgctcaggaagttcagccagccgcctggtctgcgctgggtattgacgcggttatcgtaggacaggttacgcctactccggacggcggctacagcgtgtcttatcagctggtggacaccggcggcgcgccgggtaccgtgctgtcgcaaaacacctttaaggttaacaaacaatggctgcgccttgcgggtcacaccgccagcgatgaagtctttgaaaaacttaccggtatcaaaggtgccttccgtacgcgtatcgcctatgtagtgcaaaccaatggcggccagttcccgtatgaagtgcgcgtgtctgactacgacggttataaccagtttgttgtgcacaaatcaccgcagccgctgatgtccccggcctggtcaccagatggcaaccagctggcttatgtgaccttcgaaagcggtcgttctgcgctggtggtgcagaatctggcaagcaccgcaacgcgtcagattgcctctttcccgcgtcacaacggggcacctgcgttctcgcctgatggcaaaaaactggctttcgctctgtctaaaaccggcagtctgaacctgtacgtgatggatcttgcttctggtcagatccgccaggtgactgatggtcgcagcaacaacactgaaccgacctggttcccggatagccagaacctggcgttcacctccgatcaggctggtcgtccgcaggtttataaagtgaatatcaacggcggtaccccgcagcgtatttcctgggaaggttcgcagaaccaggatgctgacgtgagttccgacggcaaatttatggtaatggtgacctctaacggcggtcagcaacacattgccaaacaagatctggtagcgggtggcgtgcaggttttatcgtcaacgttcctggatgaaacgccaagtctggcacctaacggcactatggttatctacagctcttctcaggggatgggatccgtgctgaacctggtttctacagatgggcgtttcaaagcgcgtattccggcaactgatggacaggtcaaattccctgcctggtcgccgtatctgtaataataaataattgattattaaaggaatcaaagaaatgcaactgaacaaagtgctgaaagggctgatgctcgctctgccggttatggcaatcgcagcgtgttcttctaacaagaacgcaagcaacgaccagagcggcgaaggcatgctgggtgccggcactggtatggacgctaacggcggcggcaacatgtcttctgaagagcaggctcgtctgcagatgcagcagctgcaacagaacaacatcgtgtacttcgatctggacaagtacgacatccgttctgacttcgctgcaatgctggacgcgcacgctaacttcctgcgtagcaacccgtcttacaaagtcaccgtagaaggtcacgctgacgaacgtggtaccccggaatacaacatctccctgggtgagcgtcgtgctaacgctgttaaaatgtacctgcagggtaaaggcgttaccgctgaccagatctctatcgtttcttacggtaaagaaaaaccagcagtactgggccatgacgaagcggcttacgctaaaaaccgtcgtgccgtactggtttactaagagaattgcatgagcagtaacttcagacatcatctgatgagtctgtcgttactggttggcatagcggccccctgggccgcttttgctcaggcgccaatcagtagtgtcggctcaggctcggtcgaagaccgtgtcacccaacttgagcgtatttctaacgctcacagccagcttttaactcagcttcagcagcaactttctgataaccagtccgatattgattccctgcgcggtcagatccaggaaagccagtatcagctgagccagatggtggaacgccagaagcagatgcagtcgcagcttgatggtctgagcagcggtggtgccgccgcacagccagcgacaggcgatcaaacaggcgcagcgaccgcgacgccgaacgccggggcgcaaacgccatcagcgccggtacagagcggtgatgctaatacggattacaatgctgctattgcgctggtgcaggataagtcccgtcaggatgaagccattaccgcgttcggcaacttcgttaaaaattacccggattccacttaccagccgaacgcgaattactggcttggtcagctgaattacaacaagggtaaaaaggatgatgcggcgttttattttgcctccgtggtaaaaaattacccgaaatcaccgaaagcgccggacgcgatgtttaaagtcggcgtgatcatgcaagacaaaggggacactgcaaaagccaaagcggtttatcagcaggtgatcagcaagtaccccggcactgaaggcgcaaaacaagcgcaaaaacgacttagtgcgatgtaatgaatgctgcatgaccagaaatcgcggaatttctggtcttgtcgcatgaatcataagcagttaagtgatctatatcgaaatttttgttgcgccagattcataaaccagtaatatatgccgccgttgccacgggatatgagacatacctgaagcagcgcaaaaaagcgttatagtgggtcgttagctcagttggtagagcagttgacttttaatcaattggtcgcaggttcgaatcctgcacgacccaccaatctttcgattgaacgcagtagtaacagaatgatgagtaatttgagtgggtgattagctcagttggtagagcatctcctttacacggagggggtcggcggttcgagcccgtcatcacccaccactcgggtcgttagctcagttggtagagcagttgacttttaatcaattggtcgcaggttcgaatcctgcacgacccaccaatactcaggtggaaagcagtagttaaacgtgaaggataacgttgcaacagcaacggcccgaagggcgaggcgaagccgagtcatcctgcacgacccaccaatcattcttgcctgatttaaatcttcgaagtcaacaccctgaatgggtcgttagctcagttggtagagcagttgacttttaatcaattggtcgcaggttcgaatcctgcacgacccaccaattcatcggtggaccatgatagtgagacgtgaaggataacgttgcgacagcaacggcccgaagggcgaggcgaagccgagtcatcctgcacgacccaccacttcgaagaaaatcccctaaggggtcgttagctcagttggtagagcagttgacttttaatcaattggtcgcaggttcgaatcctgcacgacccaccactctttaagcaacaaaacagtaataaagcgtgaaggataacgttgcgacagcaacggcccgaagggcgaggcgaagccgagtcatcctgcacgacccaccaatgtggaaaggcgccctaaaggcgcctttttgctatgcgcgaaatgcaggttttttgccgggtggcgctgcgcttacccggcctgcagcgtacgcgtaggcccggcaagcttgcgccgccgggcgtatacctcttcccgcaaaaaaacgtccgccagcatctttatctctgtgactttcccctgctaatcggctatgcttgtttagcatataaaacgcatctggttttttataagcaatttatcgctttatgaaccgatatttgttaagtcagcaaaacgagaaagccacatgagcgtgatgttcgatccggaaaccgcgatttatccctttccgccaaagcctgcgcccttaaaccatgatgaaaaacaggcgtaccgcgaagaaattaaacgtcttctgaaagcgcgggatgcggtgatggtggcgcactactacaccgacccggaaatccaacagctggcggaagaaaccggtggctgtatttctgattcgctggagatggcgcgctttggcgcaaaacatcctgcctcaacgctgctggtcgcgggcgtccgctttatgggcgaaaccgccaaaattctcagcccggaaaaaaccatcctcatgccaacccttcaggcagaatgctcgctggatctcggctgtccggccgatgcgttcagcgcattctgtgatgcccatccggatcgcaccgtggtggtgtatgccaacacctctgccgccgtcaaagcgcgcgccgactgggtggtgacctccagcatcgccgttgagctgatcgagcatctcgacagcctcggagagaaaatcctctgggcgccggaccggcatctcggcaattatgtgcaaaaacagaccggcgcggatgtgctgtgctggcagggtgcctgtatcgtacatgatgagtttaaaactcaggcgctggcgcgcatgaaaggattgtatccggatgctgcgatccttgtgcatccggaatccccgcaggcggtggtggagatggctgacgcggtgggatctaccagccagctgattgccgctgcgaaaacgctgccgcaaaaacagctgattgtggccaccgatcgcgggatcttttataagatgcagcaggccgtgccggaaaaggaactgctggaagcgccgaccgcaggcgagggggcaacctgccgcagctgtgcgcactgtccgtggatggcgatgaacggcctgaaggctatcgctgacggcctcagaagcggtggcgctgagcatgagatccatgttgacgccgcgctgcgtgaaggcgctctcaggccgttaaaccgcatgctggattttgcagctacactacgttcatcaacgtaaacaatcatttggggaaaagatggatttttttagcacgcagaacattctggttcacatcccgattggcgcgggtggctatgatttatcatggatcgaagcggtgggcaccctggcgggattgctttgtatctggctcgccagcctggaaaaaatcagcaactacgcgtttggtttaatcaacgtcacgctgtttgcgattattttcttccagatccagctctacgccagcctgttattacaactgtttttcttcgccgccaatatttacggatggtacgcctggtcacggcaaaccacacaaaacgaagccgtactgcaaatccgctggctaccgctgtcgaaggctatcacgtggcttgcggtctgcgtcgtcgcaatcggtctgatgacggtgtggatcaacccggtcttcgcgttcttaacgcgtatcgccgtggcgctgatgcagagccttgggcttaacgtggcgatgcctgaacttcagccggacgccttcccgttctgggattcctgcatgatggtgctgtccatcgtggcaatgatcctgatgacgcgcaagtatgtggaaaactggctgctgtgggtggttatcaatgtgataagcatggtgatctttgcccgtcagggcgtctacgcgatgtcgctggaatacctgctgctgacgtttattgccctcaacggcagccggatgtggatcaaaagcgcacgggaacgtggttcacgcgcgctcagccgttaatgatggtgatgtgcatgaccggacggcagcgaattcagctcgcagtccggtccgctacagggctgatactccatctgcacggtgacatgctcaatgtcataatgatgcgccagaaagtgctgaatgcgcgtcagaagggcatcatggtcgtgcggcggaaccacctgcacgtgcagcgtcatcaccgtcttttcaccaatcgtccagacatgcacatggtgcgcatcacgcacttccggtatatcccggcgcagatgacgcttgagggcattaatatccagcgacaccggcgcgccttccagtaattcattgacgctttcccgtaacagctgccacgcgctgcgcaacaccagacaggacaccagcaccgacaggatagggtcggcaggcgtccagcccgtccacaggatcaccaccgcggcaacaattgccccgaccgaacccagcagatcgcccagcacatgcagggcagcggcccgcacattcagatttttttccgaactgccccggtgcaggatccagaatgccagcagattggcgaccagaccggcgaaagcaatcgccatcatggtgacgctcgctaccggctgcggatgacggaaacgctggtatgcttcccagacaataagcagagtgatcaccaccagcgcaatggcgttcacaaaggccgccagggtggtcagccgcagccagccaaaggtgtgtcggccgctgggcggcttacgtgcaaatcccactgccagcagggcgaagagcagggcggcggagtcggtcagcatatgaccggcatcggcaagcagcgccagcgagccggaaaccaggccacccacgacttcaataatcataaacagggtggtgacgccaaacgccagcagtaaacggcgtccgttttcatcggcgggcgggtgagaatgagagtgcgaatgcgccatttttataatcccggcatggttaataatcagcgccttacatcattacagatttttttgttttcggcacaaaaaaggagagccgaagctctcctctttatcaacttatggctgccggttactgggacgtgccatcagttttggtgttggtatcgttattcacaccgtcaccggtctgaactttttcattgatgtccgggcatttgccgtctttacactgggtatttttgtggatgtcgtctttactcatcgtctcgccagaggcgctggtgttgccgccagtcatacccggcgctgtagtaccggtggtggtattggtaccagttgcagtattggtattgccggtattgatgtctttattacccacactatttggcgctacattctgatgagcatccggggcaacctgacccgcgctcgctgccgcattcgcgttgccgttgttatcggaagaagcagcatccgccgccagtgctgcgccgctggccagcgttaatgtcgtcgtcaggaaaagtgcagttaatttattcattttcatcatattgctcctgtgctcgtcatttgattggacattgggtccaacagtgcagatgtgatacgaattcatcgcccagtggtgaaagatgccaaatccagccggtaaggcagaatgggatctcgttaaaacaaacaaataaagtgcttacagtaaaaaagtttagctacgaacccgacgttcgctactatctggagctttttaactggttttcaggaattatccgtatcaagtgtaaaagcgcgtttacactttaatgccgagcagttagattgggagtattgcaatcacttctatttgtatggcaaagctgggatccccatgaattatcagaacgacgacttacgtattaaagaaatcaacgagttattacccccggttgcactccttgaaaaatttcctgcgacagaaacggctgccaataccgtctcccacgcccgtaaagcgatccataacatccttagcggtcacgatgaccgtttgctggtggtgatcggcccctgttccatccacgatccccaggctgcgaaagagtatgccgcccgcctgctggcgctgcgcgatgaactgaaaggcgagctggaagtggtgatgcgtgtttattttgaaaaaccgcgtaccactgtgggctggaaagggctgattaacgatccgcatatggacaacagcttccagatcaacgacggcctgcgtatcgcccgtaagctgctgctggatattaacgacactggcctgccggcagcgggtgagtttctggatatgatcacgccgcagtacgtggcggatctgatgagctggggcgctatcggcgcgcgtacgacggaatcccaggtgcaccgtgagctggcatcgggtctttcatgtccggtgggcttcaaaaatggcaccgacggtaccattaaagtggccattgacgccattaatgccgccggtgcgccgcactgcttcctgtctgtgaccaaatggggtcattcggcgatcgtgaacaccagcggtaacggcgactgccatatcattctgcgcggcggcaaagagccgaactacagcgcgcgccatgtggctgaagtgaaagaggggctggttaaggccgggctgccgccgcaggtgatgatcgacttcagtcacgccaactccagcaagcagtttaaacgtcagatggacgtgggcgcagacgtctgcaagcagatcgcgggcggtgaaaaagccattatgggcgtgatgatcgaaagccatctggtggaagggaatcagagcctggaaagcggcgaacccctggtatatggcaagagcgttaccgatgcctgcatcggttgggaagataccggcgtggtgctgcgtcagttagcggaagcggtgaaagcgcgtcgcggctgatcggccaatctgcactctgcagacccggcgcctgccgggttttttatattcgcaccccaagcacgggtgggcgaaaaatgataattgtgaaaattatcatattgccatgtcaaagaatgataatagccgtgccccagtgattatcaccttttgctgccttcagatactcttgagttaattcacaggaagggacacgccataaatatcctttctgctgaatgaccgcattaattactgtttccggtatcagggatcttataaggatatttatgatgagcggtgcaatgagtgctttagaaaaagtgatattgccggtggcgataaagctgggaaaacaggttcacgttaacgccataaaaaatggttttattcgcttaatgccgttaacgctggtgggggcgatgtttgtcctgattaataatgtgttactgaattttggcgaagggtcgtttttctggtcgctggggatccatctggatcaggaaacgataacccggcttgatgcatttaaggtgatcggcggcagcgtttataacggtaccctgggcattatgtcgctgttaacgccgttctttatcggcatggcgctggcggaggaacgaaaggtggatggactcgccgccgggttgttatcgattgcggcgttcatgaccgtaacgccttaccaggtcggtgacgtggctgcgattggcccgggctggctcggtggcgcgaatattatttccgggatgattatcggccttgcggttggcgaaatgttcgcttttatcattcgccgccagtgggttatcaccctgccggacagcgttccggcttccgtggcgcggtcgttcacggcgttggtgcccggatttatcattttgctgatcatggggctgataagcggcggattatcgctggcgggtacgcattttcaccagatcattatgagtatggtttccacgcctctggcctctctgggcggcatagtcggctgggcatatgtcatctttaactctttgctgtggtttttcggtgttcacggtgggctggcattaactgcgctgaacagtggtattcttgggccgtggggtatggaaaatatggccatttataccgaatatggttctgtagaggcggcactggcggcgggcaaaaccttccatttctggacagggccgatgatggaatcctatgtttatctgggcggtacgggggccacgctgagccttatttttgccatctttattgcatcgcggcgggcagattatcggcaggtagcgaaactggcattaccttccggcctgttcaatatcaacgagcctattctctttggtctgccgatcattatgaatccggttctgatgctgccttttgtgctgatccagccgttgctggcggggattacgcttgccgcttattcgctgggtttgatcccgccctcaaccaattttgcaccctggacgatgccgccaggcttaggcgctttctttaattccaatggcagcatagcggcattaattctcgcgctggtaaacctggtgttggccacgctggtgtatttaccttttgttattatcgccaataaggcgcagggcgtgattgccgaagaagaaagcgagaccgacatcagggcagcgctgcaattttgaggaaacggtgatggaaattaataccgtacaggaaagccagtttttgaagggtaatgatttttatttttttatccttgataaatcgacaagcgtgagcgggctgcaccagcatgattattatgaatttacgctggtactgactggccgctgccgtcaggtcattaatggcaaatcagtttctttaaagcgtggtgacgtggtttttatcccggtcggatcgtcacatcagacattttatgattacggcgtcgcgcgcattttaaatatggggattggtcggcgctatttcgaagcgcactattccgcgatgctaccggtgtgttttgtggcctcgcaaagttatgccattgcaccagcttttttaacttatatcgaatccacgttatcgtctttaagtttacagccgggtgaatgtgatgaatttaataagttgttgacctattacgtagtgaatcatttgcatcattatgaacatcctcagtgtcagcaggatattccggcgtggctgacgcgagtgatccgtgagatgcataataaaacgctgtttgccgataacgctctgaagaatatggtgcgcctggcagggaaaacgcagtcctatctgacgcgggctacgcagttttattatcacaaaacgccaggccagatcattaatgaaatccgcatcaattttgctaagcagcaactggaaaccactaatttctcggtggccgatattgctttcgatgccggattcagcagccccggcatttttatcaacaattttaaaaaaatcacctccttcacgccgggacattaccgtcgacaattggcaggccagccgactaacggagcaacagaggaataaggatgaataaattaaaagtagtgaccatcggtggcggcagtagttataccccggaattagtcgaagggtttatccggcgctatcatgaattaccgatcgatgagctatggctggtggatattgccgaaggaaaggaaaaactcgcgatcatctgtgagctgtgtcagcgcatggtagaccgtgccgggctgcccatgaaaatcgttcaaactcttgatcgccgggaagcgttgcgcgatgccagttttatcactacccagtttcgtgtcggccagttagcggcacgggaaaaggacgaacgcatcccgctttctcatggttatttaggccaggaaaccaacggggcgggggggttatttaaagggctacgcaccattccggtgattgttgatatcatcaaggatattgaggaaatctgccccgatgcgtgggtcattaatttcactaatccggctggtatggtcactgaagcggtatatcgtcatactcatttccgccgctttatcggtgtctgtaatgtgccggtaggaatgcacaggtttattcaggatattttatcccttggcaaaaccgatcacctctctcttgatctctttggtcttaaccatctggtatttatcaaagatgttctcgttaatggtcattcccgttttacggaggtgatcgacaaagtggcttccggtaactttagcggcagcacggtaaagaatatttttagcctgccttttgcgggaagccttatccgggggctgaatttactgccctgttcttatcttctctattactttaaacataaagagatgctggccattgagcttggcgaatattacaaaggcgaagtgcgcgcgcaggcagtgcagaaacttgaacgccagttatttaagatctatcaggatccaacccttgcagtaaaacccgccgaactggaggcgcgtggcggagcgtattattccgatgccgcctgtgaagtgattaatgccatctataacgataagcaaagtgaacattatataaacctgccgcataacggccacgttgaaaacattcctgatgactgggtggtggaaatgacctttctgctggggcgcaacggaggaacaccgcacccgcgccttacccgttttgacgataagaccatggggcttatccacaccatcaagggctttgaaatcgccgccgcccgcgccgcgctgaacggcaacctcaatgatctgttactcgcgctcaacctcaacccactggtgaattctgacagcgacgccgaattactggcgcgggagatgctgctggcgcatcagtcatatttgccgcagtttgccgatgctatcgcaacctttactgcaacaagggaggcgtaatgtgacgaatctgttaattgtgaacgccgacgattttggcctgagccaggggattaactacggcattattgaagctcatcgtcacggggtggtcagttccaccacggctatgatgaatgcgcctgcgatcgaacacgcagcagaaatcagcgcagattttccggcattaggcgtggggctgcatttcgtgctcagctttggcgtgcctctaacgcccatgacttcgctcgtccgtgaagggcagctgggcaaatggctggtgcaacaggcaacgctggggctgctcgccagtgatgagattgcggcggaattgcaggcgcaatatcagcgctttatctccttgtttggttatccaccagtgcatatcgacagccatcaccacgcccattttatccctccggtctgggcacaggtggtgtcgtttgcccgtgagaaaaacatcccgctacgcatcgatcgcgaggcgcttcaccagcaggggatcgtcccgcagggtgtgcgcagtaccgacggttttatcggtgatttttatgctgataacgtttcagcgcaggcttttctcttagcgctgtcgcagtcaaaagcgcgcggtgagcgttcagttgagctgatgtgccatccgggttatgtggatcaaggggtcaaacagagccgctattgcgatcagcggctggacgaactggcggtattgaccacagcgtcactcaggcaagccgtggaagcccagggttactggctgggaaactatggtgatctggcgcagatcgatgcatgagacggcaacgaaaccggatagccatgcggtttgtaaataacgcttataacaggtaatgccgtcgctaaaaaagcgtgggaaggtcccacgctttttttattacttcgctttaccctggttagcgacggccgccgcttttgcagcgatttcgtcagcgttacccaggtagtagcgtttcagcggtttgaagttctcgtcaaactcatacaccagcggtacgccggtcgggatgttcagttcgaggatctcgtcttcgctcatgttatccagatatttcaccagcgcgcgcagggagttaccgtgcgccgcaacgatcacacgctcaccggacttcatgcgcggcagaatggactcgttccagaacgggatcacgcgatcgatggtcagcgccaggctctcggtggtcggcagctcctggtcggtcagtttagcgtagcgcggatcgtggcccgggtagcgctcatcatctttggtcagctccggcggggttaccgcaaagccgcgacgccactgtttaacctgctcgtcaccgtatttttcagcggtttcagctttgttcaggccctgtagcgcaccgtagtgacgctcgttcagtttccaggatttttcaaccggcagccaggcctggtcgagctcgtccagcacgttccacagggtgtggatcgcgcgtttcagcacagaagtgtacgcaaagtcgaagctgaagccttcgcttttgagcagtttacctgctgctttcgcttcgctgacgcctttttcggacaggtccacatcgtaccagccggtaaagcggttttcgttgttccactggctttcgccgtgacgaaccagaacaagcttagtaactgccatactctactcctccaaaaactgattgaatgataacaattctcattatattgccctgaggtcgtcagcggcaacgcataaccttaaccatagcgaaaatagtcgcgcagtgtaaggtgcatgtgaatgcagggttatgtttttgtcggtaaatggcgtttatttcagcgaaatgaacaaaaaagtcacggcaaaacagagaacgcccggcaggcgaagcgccgccgggcaaaacgaaaggatcaggatggaataaactggtactcggtaatactcagatattcctcgcccggacgcagaacacaatccggttgcggccactccggatgattcggactgtccggcaacagctcgctttccagcgccagtccctgccaggcctcatacgctttcagctcgcgcgacggcgtcccttcgaggaagttaccggagtagaactgcaatgccggggcggtggtatagaccgacatttgcaggcggttatcgctggaccacaaatgcgccgcaggctggctgagatcgcctttcgcctgcagtaaaaaggcgtggtcgtagcccttcacctttttctgatcgtcatcgctgaggaaatcctgcgccagggttttcgggcggcggaaatcaaagctggtctgatcgacggctttcaggccactgtccggaatgccgtcttcgcccaccggcagatagtgatccgccagcagttgcaattgatgctgacgcacgtctccctgcgcgccatccagattgaaataggcgtggttggtcaggttcaccgggcacggcttgtcggtggtcgcgcgatattcaatgcggatacggttgtcgtccgtcagacggaacagggcgctggcggtgagattgccggggaaaccctgatcgccgtccggcgagtcgatggagaacagcacttcgctgtcgttctgccgcacaatgcgccagcggagcttgtcaaagccctgcgggccgccgtgcagctggttttcgccctggctcggcagcagttgatattcctgcccgtcgaggcggaaacggcttttgctgatgcggttagcatagcgtccgacagacgcgcccagataggcggtctgctccgggtaggtctgcggcgtacggcagccgagcagggtttcacgcaccgagccatccggcagcggtacgcgcgcggagagcagggttgcgccccagtccatcagcgtcaccaccatccctgcgccattgcgcagggtgatcagacgataagccagcccgtccggggccagcgcaggcgtttcgtttagcactgtcctgccccctgtgatgctttgcaaacgtagaaggtttctttgatcccggttttggcttcgtactgttccgccacggctttctgcacttccggcaccatcgcttccggtaccagcgccacgatgcagccaccgaagccgccgccggtcatacgcacgccgcctttgtcgccaatggtcgctttgacgatgtccaccagggtgtcgatctgcggcacggtgatttcgaaatcgtcacgcatagaggcatgggattccgccatcagctcacccatacgggtcagatcgcctttttccagcgcgctggccgcttccacggtacgcgcgttttcagtcagcacatggcgaacgcgtttcgccaccagcggatccagttcatgagccacggcgttaaactgatccagcgacacatcacgcagtttcggctgctggaagaaacgcgcgccgatttcacactgctcgcggcgggtgttgtactcgctgcccaccagcgtacgtttgaaattactgttgatgatgaccaccgccacgccttccggcatggagacggctttggtgcccagcgaacggcagtcgatcagcagcgcgctgccttctttacccagggcagagatcagctgatccatgatgccgcaattacagccaacaaactggttttccgcctcctgaccgttgagcgcgatttgcgcgccgtcgaggggcaggtgatacagctgctggaatacggtgccgaccgccacttccagcgaggccgatgaactcaggcccgcgccctggggcacgttgccgctgatcaccagatccgcgccaccgaagctgttgtcacgctgttgcagatgcttcactacgccgcgcacatagttagaccactgctggctgtcgtgggccacaatgggcgcatccagggaaaattcatctgactgattgtcgtaatcggcggcaattacccgcacggtacgatcctgacgcggcgcgcagctgatcaccgtctggtaatcaatggcgcacggcagcacgaagccatcgttatagtcggtgtgctccccgatcagattcacgcggcccggcgcctgaatggtatgagttgcagggtagccgaatttttcagcaaacagggattgtgttttatctttcagaggcattgttattctccggatgcacgaaaatggatatcactgaccgcgcgcagacgttcggcggcctgttcagccgtcaggtcacgctgggtttccgccagcatttcatagccgaccataaacttacgcaccgtcgcggagcgcagcagcggcggatagaagtgcgcatgcagctgccagtgttggttttcttcaccgttgaaaggcgcgccgtgccagcccatggagtaggggaaagagcactggaacaggttgtcgtaacggctggttaatttcttcaggcacagcgccagatcgctgcgctgggcgtccgtcagatcggtaatgcgcaggacgtgcgcttttggcagcagcagcgtctcgaacggccatgccgcccagtagggcaccacggccagccagtgctcggtttccaccacggtgcggctaccgtcagcctgttcgcgctgaacataatccagcagcatcggcgactgatgctcatcgaaataggctttctgcaggcgatcttcccgctccacttcgttcggcaggaagctgttcgcccacacctggccgtgcggatgcgggttagagcagcccatggccgcgcctttattttcaaacacctgcacccacgggtaggttttccccagatcggcggtctgcgcctgccaggttttgaccacttcttccagtgcaggcaggcttaactccggcagcgttttgctgtgatccggcgagaagcagatcacccggctgacgccgcgcgcgctctgggtgcgcatcagcggatctgtactctccggcgcttccggggtatcgctcatcagcgcggcaaaatcgttggtaaacacgaaggtgccggtgtactgcgggtttttatcccccgtcacgcgcgtgttgcccggacagaggaagcagtcaggatcgtgggacggcagggtttcctgcgacggcgtctcctgtgcgccctgccacggacgtttggcacgatgcggtgaaactaaaatccattgcccggtaagcgggttataacgtcgatgcgggtgatcgaccgggttaaattgcgtcatcactattccttaatctgcatatccctgcggatggcgtgactgccagcgccaggtatcttcagccatttcgtccagtgtgcgggtgactcgccagttcagttctttatcagcacggctggcatcggcccagtaagcgggcagatcgccatcgcgacgcggggcaaagtggtagttaatgggtttaccgcaggctttgctgaaagcgttgaccacgtccagcacgctgctgccgacgcccgcgccgaggttgtaaatatgcacgccggatttacctgccagctgctgcatggctgccacatgaccgtctgccagatccatgacgtgaatgtaatcgcgcacgccggtaccgtcttccgtcgggtagtcgttaccgaaaatcgccagcgactcgcgacggcctaccgccacctgggcgatgaacggcatcaggttgttcggaataccctgcggatcttcccccatatcgcccgacggatgcgcgccgaccgggttgaagtagcgcagcagcgcgatgctccattccggctgcgctttttgcaggtcggtaaggatctgctcaaccatcagcttgctcttgccgtacggactttgcggcgtgccggtggggaagctttcaacataagggattttaggctggtcgccgtagacggtggccgacgagctgaaaatgaagtttttgacattggccgcgcgcatggcgctaatcaggcgcagggtgccgttgacgttgttgtcataatattccagcggtttggcaacggattcgcccacggctttcagaccggcaaagtggatcaccgtatccacggcgtgatcgtgcaggatctcggtcatcagggcttcgttacgaatatctccttcaacgaaggtaacggatttgcccgccagccgctcgatcaccggcagcacgctgcgcttactgttacataagttgtcgagaataatgacctcgtggccgttttgcagcagttgcacacaggtgtgactcccaatgtaaccgctaccaccagtaaccagaactcgcatatgacactccatcaggcgtatgttatgtaataaacatagcataacagagcgggaaaaagtgtgacatgaccgaaaatagtggaatcgtttacactaacgcatttcaggatcgctggggcgtcaaaggctactataaatcaataagatagtagggtggcgctgtaatttgtctgaaagtgagcgcctgccgggcggcaggcgtgaaagggtcagcgcacggcggcgagatggtaacggtatccctcgccgtccggcaaaaattccagccggtgcgtaatacaggccggggcatccgcggcgtggtgggagacaaacagcaactgcgtttccccttcgctaatcagcacatccacaaaacggcgcaccagctggcggttaagcgggtcgaggccctgaagcggctcatccagaatcagtaaggtcggatgtttcaccagcgcacgcacgatcagcgccagccgctgctgcccccacgacaggctatgaaagggcgcgtcggcggtgcgggcgtcaaagcccagaatatccagccacgcctgcgccagcttatgctgcttgtccgataccgcctgatagatgccgatggaatcaaaatagccggacaaaatcacattgcgcacgttggtgctgacgcggtaatccagatgcaggctgctgctgacatagccgatatgctttttaatatcccagatggtttcgccgctgccgcgacgcacgccgaacagcgtcagatcgttgctgtaaccctgcggatgatcgccggtgatcagattcagcagcgtcgatttccccgcgccgttaggcccggtgatctgccagtgctcgcccggttttaccgtccagctcagatgattaatgatcggcctgtcatcataagagaccacgccgtccctgagcacgatgcgcggcgcgtccggcggcagggcatggcgggcggagggggcatccggcggcggcagggcgatgccctgtagccgttcactgtgcgcgagctgggcgatcagcgcctgctgcaacagcgtcgccttttcgccggtttccgccagcgcgcagtccaccaccaccccggcatgctgcacaaattcggggatctcatcaaagcggttaagcaccagcaccagcgtaatgccctggccgttcagcagggcgaggtgttccgccagctgtgcgcgggatgccacatccagcccgtcaaaaggctcatccaggatcagcagttcaggggaggccatcagcgcctggcagagcagggtttttcgcgtctcgccggtggaaaggtatttgaaacggcgatcgagcaggccgctgatgccaaactgcgccgccagcgctgcgcagcgttcgctgtctttgatctcgtcctggatgatgtccgcggtggtgcgcccggtatcggtctcatcgggactttgcatgtcggtgttattgcgctgccactcgtcgctgaccagtttttgcagctgttcaaaggagagacgggtgacgcgggcgtagtcgcactggcgctcgcctttcagcagcggcagttcccctgccagcgcgcgggcaagggcggatttgccgctgccgttgctgccgacaaaggcccagctttccccggtgtgcaggtacaaatcggcgatctgtaaggtgcgggtgtcgctaatgcgaaacgtgccttgcgaaatatgcaataaagacattgtgtatcccgttttttgcagcagaaaatacagaaatacgtggcagcggacgctttgtcaatgcactcagcacaatgtcgcgacaatcacctggtcggcggcaaaacaggcgatgacctcgctgttttcagccagatccttcgcctgcgcctgcggcagggtggcgcacagcgtctgcccgtccgggagtgtcatcagcacttcgcactgggtttccccgcgttcgatatggctgacaatcgcgggtagctggttatccatgcccgccgccaccgccggatcctgtgtcagcttcacccagggcgctttcagcaataccagcacctctttaccttccaccagcccgagccgggcgctgctttgcgcggtgatcgctactttcagacgcgtgctgccatccgccagcaatacctcaatggcgtgctgcacctggtgggattcgcgggcgaccacggtgccgaaccactgattgcgggcgctggtttgcagggaaaaacgtgagatggccgccagcaggctgtccagcggcagggcatcgtcgtcgctcaacacatcaaaggctttttgctggatctgcgccagcagatcataaagcgcgatcagccgctgtccgtaacgggtaagcagcgcgccgccgccgcccttaccgccggtggcgcgttccaccagcgtctgttcgctcagctggttcatctcgttgatggcatcccaggcgcttttatagctgatgccggcgttcttcgcgccctggctgatggagccggtttcggcgatctgtttgagcagggaaatgcggcgcggatcggcaaaaagccgttgctgaagtttgagagtgaggagaatttcggcctgcataacaatgtcctggcaaatagggtattgtgacggaattcgcccctggcgcaacgggcaccgcacaaaagggacgtgtaattttcgcggatcgggttagaataaatgcttaactcactgtggagtcgaccatgttagaattattaaaaagtctggtatttgcggtcatcatggtaccggtggtaatggcgatcattcttggcctcatctacggcctcggtgaagtcttcaatatcttttccggcattggccacaaagataaatccagacaatcacattgatttcaaaaaaagcgcccgctcagcgggcgttttgctattcaggatttgccccagcctgccgataatttctctgccgccccgttaacaccagagtagtaccaattagtcctgtaaatttgtatggctatcgttatattataaagtatataacgaaatgcacaggagttaaaaaatgatccgtaccggtttacgtctgctggcaggcgccacgctctccctctcactggcgggcgctgcgctggccgatgaaagtaaaatcaccgtatttgctgccgcctcgctgaccaacgcgatgcaggatattgccacgcagtacaaaaaagagaaaaacgttgaggtggtgtcgtcctttgcctcatcgtccacgctggcgcggcaaatcgaagccggcgcgcccgccgatctgtttatttctgccgatcagaaatggatggattatgcggtggaaaaaaaagcgattgaaaccgacagccgcgaaacgctgctgggtaacagcctggtggtggtggcatcgaaagccagcgtccaggggccaatcgccattaacgcgcaaacacagtggacaaccctgctgaacggcggccgtcttgcggtgggcgatccggagcacgttccggcaggcatttacgccaaagaggcgttacaaaaactgggtgcctgggatacgctgtcgcccaaacttgccccggcggaagatgtccgcggcgcgctggcgctggtggagcgtaacgaagcgccgctcggcatcgtttacggctctgatgcggtggccagtaaaggcgtgaaagtggtggggactttcccggaagattcacacaaaaaagtggaatacccgctggcgattgtcgaaggtcataaaaacgcaagggtgagcgcgttttacgactatctcaaaggcccgcaggcttctgaaatctttaaacgttatggatttacaacgcaccaatgatactgaccgatcccgaatggcaggcggttttgctgagcctgaaagtctcatccctggccgtactctttagtctgccctttgggatcttctttgcctggctactggtgcgctgcacctttccgggcaaagcgctgctcgacagcctgctgcatctccctcttgtcctgccgccggtggtggtgggctatctgctgctcatcagcatggggcggcgcggggtgatcggcggctggctgcatgactggttcggtatcaccctggcgttcagctggcgcggggcggtgctggcggcggccgtgatgtcctttccgctgatggtgcgcgccattcgcctcgcgctggaaggggtggatatcaagctggagcaggccgcccgtacgctgggtgccgggcgctggcgcgtctttttcaccatcaccttaccgctgacgctgcccggcataatcgtcggcaccgtgctggcctttgcccgttcgctgggggagtttggcgcgactatcactttcgtctccaacattcccggcgaaacgcgcactatcccttccgccatgtacacgctgatccagacgccgggcggggaaagcgccgccgcgcggctgtgcgtgatctccattgtgctggcgttaatttcactgttgatttctgaatggctggcgcgggtcagccgcgaacggacggggcgctgatcatgctggaacttcactttacccagacgctgggcacgcaccgtttacagattaacgaaaccctgcccgccagcggtattaccgccatttttggcgtttccggggccggcaaaacctcgctgattaacgccatcagcggcctgacgcgtccgcagcaggggcgcattgtgctgaaaaatcgcgtgctcaacgacgccgaaaagggcattttcctcgccccggaaaaacgccgcgtgggttatgtttttcaggatgcgcgtctgtttccgcactataaggtgcgcggtaatctgcgctacggcatggcgaaaagcatggccggacagttcgacaagctggtggaactgctcggcattgcgccgctgctcgatcggctgccgggcacgctctccggcggtgaaaaacagcgggtggcgattggccgcgcgctactcaccgagccggagctgcttctactcgacgagccgctggcctcgctggatatgccgcgcaagcgtgagctgctgccctacctgcaacggctggcgcgggaaattcacattccgatgctctacgtcagccactcgctggatgagatcctgcatctggcggataaagtgatggtgctggagggcggggcggtgaaagcgtttggctcgctggaggaggtctggggcagtcgggtgatgaacccctggctgccgccggatcagcaaagcagcgtgctgaaggtcagcgtgctggagcatcacccgcactatgcgatgaccgcgctggcgttgggcgatcagcatttatgggtcaacaggctggatcgcccattgcagtccacgctgcgcatacgtattcaggcgacggatgtttcgctggtgctgcagccgccgctaaacagcagcattcgtaatatcctgcgcgcgaaggtgttgcagtgtctggacgatcaggggcaggttgaagtgcaactggaggtgggcagccggacgatctgggcgcgcatcagcccgtgggccagggatgaactggcgatcaaacccggcctctggctgtacgcgcaaatcaaaagcgtgtcgataaccgcctgatcacaacagatgtttgtagaggtattcggcgatagtctcagtgctgttatcgccgatcaccacatccgcccgcgctttgacctcatcatcggcattgcccatagcgacgccggtgcccgccgcttccagcatactgatgtcattatagttatcgccaaaggcgatcacgtcctgcattgacagcccctgcgccgccacccactgggcaaggcgtttgcctttgctgttgccgcgccgggcgatatccacctgatcgtgccatgaacgttcgcactccagtcccagcgtctgctccacatgcagggcgaaggcatttaacttatcgctgttttcatcggtcagggcgaatttccagatggcctccacctcctgcgccgtctgtttcagggaggccacctgcgtgaaggtcgggcgctgggcttccggtaggttcagcgcccagttgcgggtgcggatcacatggccggtgggcttttcatacaccatcgcatcgtcaacatacatcagggcgtgcacctcatgatcattcagcatatctatcagttgcagcgcctgatcgaccggcagcggatcggactccagcaccgtttttgcatgataatcatacaaataagtgccattacaacaaattgcaggtgtatcaagagccagtgcctgataaaaaggatggatggcaacatgatggcgaccggtcacgataattaactgatacccggcagctttcgcacggttcatggcctcaagcgtggcgggaagcagggttttgccgggggacagtaaggtgccgtctaaatcaagagcgataacgcgcgaggtcatgtcgtattccatatgaatgatgagaaatcagctgccggaatggtacacccgatacggggtcggacaaaatgcacgcgcagaaatccagcattcaccgttaaaaaagactatcctggtaatctacttcactgctttgtgatcaaggagaattcatgaaacaaaccgtttataccgccagcccggaaagccagcagatccacgtctggcgtcttaatccggaaggcgcgctgacgctggtccaggttgttgatgtgccggggcaggtacaaccgatggtcgtaagcccggataaacgctttttgtacgtcggtgtgcgcccggaatttcgcgtgctggcgtaccgcatctcagcggaagacggcgcgctgacctacaccgccgaagcgccgctgccgggcagcccgacgcatatctccaccgatcacagcggtcgcttcctgttcagcggctcctataacgcgggctgcgtcagcgtgacgcgtctcgatgacggtattccgggtgaaaccgtgacggttgccgaagggctggaaggctgccactccgcgaatatctccccggacaaccgcacactgtgggtaccggcgctgaaacaggatcgcatctgtctgttcacgctgggcgaggacggctcgctgtcggcacaggaaccgggcgaagtgaaaaccgtggaaggggccggtccgcgccatatggcgtttcacccgaaccagcagttcgcttactgcgtgaacgagctgaacagcagcgtcgatgtctggcaactgaagaacccgcacggcgagatcgaatgcgtgcagacgctggatatgatgccggccgattttgccgatacccgctgggcggcggatattcatatcaccccggacggacgtcatttgtatgcctgtgaccgtaccgcgagcattatcaccgtgttcagcatctcggaagacggcagcgtgctggcgatcgaaggctatcagccgacggagacccagccgcgcggctttaacatcgatcacagcggtaaattcctgattgctgccgggcagaagtcgcaccatatcgcgctgtatgaaatcagcggcgcgcagggcttactggaagagaagggccgttatgcggtcggccagggcccgatgtgggtggtggttaacgcgtactaaaccggacgaaaaaaaagcccgccatctggcgggcttttttattactcataggttactgcttcggctctgccacaacctgactgcccacgccgcggttgttgaactcccacatgcggttgaactgcgcatcgttcagatcgcgcgtcacgttgcctttgtcatccacgctgccggtgttacccgcaaaggcgcgctgtgtacctgcggccgcggcccagggtttcgccacgttaaagccttcgttgatcacgctgtcgcggatcactacctgaccgttggtcgcggagtcaatatccagcgagcggcccagctgcgccacgccttcaccggcggcgctgaagcggctgttcactgccaggaaaccgtagaagatgttcgcctgagtagccggcgcgaagacataaccttcctgctgggtgcgcgaattcaccacgcggaaatcggtgttgtcaaagaccaccgcgccgcgaccggcaaccagatccacatcgccctcaacgtagctgtctttcaccagcgtacgggtctggcgatcggtacgcagggtattatccacgctgctgttggtgacgaagaaggtgttctggcgacccagaatgttcaccttgttgatctgcactttatcgccatcgctgcgcagagccaccgcctggtggttacccgcatcgacgctgtcgcccaggctgttctggatggtcaggttttgcagttgcaggccattgttctgtgaccagacgaccgccgaacacatcacgcccacggtggcgttacgtttgctctggcaggcatcaaacatataccaggcaggtttacccggcatatatttccctgccggattcaccaggcgacgccaggtgttggtgtccatttcggaatccaccgcgaggccgattttcacgtccagcggtttttcgccggtgccgtacagcgtcaggctgccaggcgctgccggaatatacacggtgccttcatattcgcccggcagaatcgcaatgtactggcgatcgctggtgtgtttattgatagccgcatccacggcggcctggatggtggtatgcgtgacaccggcagtgccagccgggccgacgacaaagttcgcctgctgcggcagacgaatgccggacgggctccatggcgcggcgttcggatccatagacgcgaaatagcgcgccgggacaaaattctgtgcttcattcgcagacaataccggacgggaggcagtccccggcgcggcttgcgtggaaggttgttggtccggtggcgttgagctgcatgcagtcagtgtcacgccaaaagccagtgccagcgtcagacgggaaaccgaaaatgtgttcaagggatgctccaggctatcaggttaaaatgaattccttagaagcctgcttttttatactaagttgagcgaaacgggaagccgattgtttaaatcggctgcaatatcccgaaatatttacccaattttgcacgccgcccgttatggcaggaaatgttccggctcccgaaccgcatcgcataccgcccgcgtcagtgcagagagttgttgcggggtgatgatataaggcggcatcaaatagatcagccgaccgaatggccgcacccatacgccgcgtgacacaaagaagcgctgcaaggccgccatattgaccggctggcgggtttcgacaacgccgatcgcgcccagtacccgcacgtccgccaccgcatccgcctcacggatctctgccagttcacggattaactgggtttcgatagccgccacctgttcgcgccagtcgccgctctccagcagttgtaggctggcattcgccaccgcgcaggccagcggattacccataaaggttgggccgtgcataaaacagcccgcctcgccgttgctgatggtttctgccactgcgcgggtggtcagggtggcggagagcgtcatggtgccgccagtcagggcttttccgaggcagagaatatccggcgcaatgccagcgtgctcgcaggcgaacagcttgccggtgcgcccgaagccggtggcgatctcatcggcgatcagcagaatgccttcgcggtcgcacatcttacgaatacgtcttaaccactccgggtgatacatccgcattccgcccgcgccctgcacgatgggttcgaggatcaccgcggcgatctcatgacggtgtgccgccatcagccgggcaaacggcaccatatcaagctcatcccattcgccgtcaaaacggctttgcggcgcaggggcaaagaggttatccggcaggtaaccctgccacaggctgtgcatggagttatccggatcgcataccgacatcgcgccaaaggtatcgccgtgatagccattgcggaaggtgaggaaacgctggcgcggctcgcctttcgcctgccagtactgcaacgccatcttcatcgacacttcaaccgccaccgagccggaatccgccagaaacacgcactccagcggctccggcgtcatcgccaccagcctgcggcataaatccaccgcgggctgatgagtgatgccgccaaacatcacgtgggacatctcatcaatctgcgctttcatcgccgcattgagctgcggatggttatagccgtggatcgccgcccaccaggacgacatgccgtccaccagtcgttcgcctgtcgccagatgcagctcacagccttgggcagactgcaccgggtagaccggcagcggggtggtcatggaggtgtaaggatgccagatatggcgcttatcaaaggcgagatcgttcggtgtcataatcgacttgtaaaccaaattaaaaacatttaggtttacgagtctacaccaaatcaaaacgtaacacacctttggagacgccccatggctcaccgctggactttgtcgcaagtcaccgaactctttaataaaccgctgctcgatctgctgttcgaggcgcaaaccgtacaccgtcagcatttcgacccgcgtcaggtgcaggtcagtacgctgctgtcgatcaaaaccggcgcctgtccggaagactgcaaatactgcccgcaaagctcgcgctataaaaccgggctggccaccgagcggctgatggaggtggagcaggtgctggattcagcccgtaaagccaaagcggccggttcgacgcgcttctgcatgggcgcggcgtggaaaaacccgcacgagcgcgatatgccctatctggagcagatggtgcagggcgtgaaggcgatggggctggaagcctgcatgacgctcggcaccctcgaagacagtcaggcgcagcgccttgccgccgccgggctggattactacaaccacaacctcgacacctcgccggaattttacggcaacatcatcaccacccgcacctatcaggagcgtctcgacaccctggataaagtgcgcgatgcggggatcaaagtctgctccggcggtatcgtgggcttaggtgaaaccgtcaccgatcgcgccggtctgctgctgcaactggcgaacctgccgacgccgccggaaagcgtgccgatcaatatgctggtgaaggtgaaaggcacgccgctggcggataacgacgacgtggacgctttcgattttatccgcaccatcgccgtggcgcgcatcatgatgccgacctcctttgtacgtctttccgccgggcgcgagcagatgaatgagcagacgcaggcgatgtgctttatggccggcgcgaactccattttctacggctgcaaactgctgaccacgccaaacccggaagaggataaagacgtgcagctgttccgcaagctgggtcttaatccgcagcaaaccgacgtcgtcaatggtgataacgagcagcagtatcagcttgaacaacaactgcgtaacgccgacaccgaccagtattacaacgcggcggcggtatgagctggcagacgcgcatcgatacggcgctcgacaaacgtcgcgcggcgcaggcgctgcgcacccggcgcgtgatggagcagggtgccgggcgctggctgacacacgacggcgagcgcttttgtaacttttcctccaatgactatctgggcctcagccagcatccgcaggtgatccgcgcctggcagcagggcgcggaacgctatggcgtaggcagcggcggctccgggcacgtcagcggctacaccggggcgcatcaggcgctggaagcggagctggcggactggctgggctacccgcgcgcgctgctgtttatctccggtttcgccgccaaccaggcggtgatcgccgcgctggcgggtgaggatgaccggcttgtcgccgacaagctcagccacgcctcgctgctggaagcagcggccttcagcccggcgcagctacggcgctatgcgcacaatgacgtgcaaagcctgacagggctgctggataagccctgcgccggacaacagctggtgatcaccgaaggggtgttcagcatggacggcgacagcgcgccgctggcggaaattgccgccgccgcgcaaagcgcgtccgcctggctgctggtggatgatgcccacggcaccggcgtcaccgggccggaaggacgcggcagctgtcacgccgcaggcatccgcccggaactgctgatcgtcactttcggcaaaggttttggcgtcagcggcgcggccgtattgtgcagcgaggcgctggcagattacctggtgcagtttgcccgccatctgatttacagcaccgccatgccgcccgcccaggcgatggccatcagcgcctcgctggcggtgatccgccaggccgacggcgctgcccggcgggaaaaactcggcgcgctgattgaccgttttcgcgcaggcgcgcaggcgctggatgtcagcatgaccgcgtcacagagcgccattcagccgctgatcgtcggcgataacggacgggcgctggatctggccgcgcggctgcggcaggcgggctgctgggtgacggcgatccgcccgcccaccgtgccgccgggcaccgcgcgtctgcggctgaccctgacggcagatcatgaaccgcaggacattgatcgtttgctggaggcgctgcatgacgccggtgaataaatctgcggtcgccgccgcctttggccgcgccgcgcagggctatgcccatcatgcgcaattgcagacgcaaagcgccgaactgctgctggcgatgaccggtgaacgatccgttgaacgggtgctcgacgccggttgcggtccgggaaccctcagccgttactggcgtgagcagggcgcgcaggtgactgcgcttgatctctccgcgcccatgctcgacgaagcccgccgccagcaggccgcgcatcactatgtgctggcagatattgaagcgatgccctttgaccacgcgcagtttgacctggcgtggagcaatctggcggtgcagtggtgtgacgatctgcatcaggcgttaagcgagctgaaccgcgtggtgcgtcccggtggcgcggtggcctttaccacgctggcggcaggctccctgccggagctgaatcaggcctggcaggcggtggatcatcacccgcacgccaaccgttttttaccggcgcagcagctgactgacacggtgagtggctggcgcggccgcagcgggctcgcgcatatcacgctggattttgacgatgcgctcagcgccatgcgttcgctgaagggcatcggcgccacgcatctgcatgaagggcgtcaggcccaggcgctgacccgcggacaactgcaacgcctgcagctggcgtggccgcaacgcgcgggacgctatccgctgacatattcactattctggggagtaattgaacgtgactgaacgctattttgtcaccggtacggacaccgaagtggggaaaaccgtcgccagctgcgcgctgttgcaggcggcaaccgcgcggggaaaacgcactgcgggttataaacctgtggcctccggcagcgagatgaccctggacgggctgcgcaacagcgacgcgctggccctgcaatgccacgccagcctgacgctggactatgaggcggtaaatccctatatctttgccgagccgacctcgccgcatatcgtcagcgccgatcaggggatccccattgattttggcgtgatgtcagcaggcttacgcgcgctggaaacacaggcggactgggtgctggtggaaggcgctggcggctggttcaccccgctgacagaacgccagagttatgcggactgggtgagacaggaagcgctgccggtaatacttgtggtcggcgtgaagctcggctgtattaatcatgcgatgcttaccgcgctggcggtacgtcaggcggggttacggctggcaggctggatcgccaacgacgtgcagccgccgggcaaacgtcatgcggagtatctggaaacgctgcgacgcgtgctgcccgccccttttctgggggagatcccctggcttgcagacgcgccgctggaacggcaaaacggtcattatcttgatctcagcggtcttgatcctgcgtcatccagtgggaaataagctggtcatctaactgatgcacatgcccctgcgccacgttgcgcccgcgatgcagcaggcagaagcggtcggcaacgcggcggataaacgacaaatgctgctccgccagcaggatggtcatgccgagatcctgattcagccgcaccagtaaattgccgagcttatggataaaggcctggcccgcgccccgcgtcggttcatcaaggatcagcaaacgcggttgggtgaccagtgcgcgggccagcgccagctgatactggtcgtcttcggacaagcccgcgccctttacctggcgcagcgcgtacagttccggaaagagatcgtagatcgccggtgtcaccgcacagcccggctcgcctgccgccagcatcgcaatatgcagattttcctcgaccgtcagctgggaaaagatccgccgatcctgcggcacataaccaatccccatcgccgtgcggtgcgccgccgtcacctgtaacagatccagcggcggggcgctggcttcctgccagataatgctgccgctctctatgggcagattgccggtgatacagtttaccagcgtggttttccccatcccctgtaagcccatcaccgtggtacaggtgccgggcactaaatctaaatccacgttccacagcgtatgctgatcgccgtaatactgatttactgcgcgtagacgtaacatcgggcttctcctgttgctggtggctactggcgctgactctgtaaacgagatgttgcaaaagacttgccacctccgacaaaagtcgtatttttcggagcaggatgaccaaaaagacgggaatttaccgcacgctgagattaccgcagaaaatcctgcacgctgtgggtgcgtggcaggcgaaaagggtgcatcagcgaaacggtttggtcaccgaatcgccaggcttttacccgacggcacactttgttccacgcaaaatttagtgataaaaattttttgttattgccgtctcgcctgaaaccgggaatttgctgagcggcaggggatatggcctggcgggagttatccactattcctgtggataaccatgtgcattagagttagaaaacacgtgagaagcgagagttcatgcggcctggacatgaattgatgcgaaacgcggcttttcagtatatttatttaatatcaataacttgtataaaagcaatgcctgtaaaaaaagtgtcactgactgccacaaaactttcatgacatcacttgacaaatgttaaataggaaaactttttggggataacctttttagcgcagcgttttatgccgcaggcaggataaagtcccgcccgttgcgcgcgcaggtttacgcctccactttcataaactagcctgatactggtttttcatccagtattttttattggcaaaaatcgccgtcgcgagtaaaattaatcacctgcccgctcattcctccaccaggtagccgttcatgagtaaaccgttcaaactgaattctgcgtttaaaccttctggcgatcagccagaggccatccgtcgcctgaaagaagggctggaagacggactggcgcaccaaaccttgctgggggtaaccggttcagggaaaacgttcaccatcgctaatgtgatcgccgaccttcagcgtccgaccatggtgctggcgcctaacaaaaccctggccgcgcagctctatggcgagatgaaagagttcttcccggataacgccgtggaatatttcgtctcctactacgattactaccagccggaagcctatgtgccgagctctgacacctttatcgaaaaagattcgtcggtgaacgagcatatcgaacagatgcgtctgtcggcgaccaaagccctgctggagcgtcgtgacgtggtggtggtggcttccgtatcggccatttacggtctgggcgatcctgatctgtacctgaaaatgatgctgcacctgaccaccggtatgatcatcgatcagcgcgccatcgtgcgccgcctggcggagttgcaatacacccgtaacgatcaggcgttccagcgcggcacattccgcgtgcgcggcgaagtgatcgatattttcccggcggaatccgacgatatggcgctgcgcgtcgaactgttcgacgaagaggtggagcgcctgtcgctgtttgatccgcttaccgggcatgtggaatcgtctatccagcgctttaccgtgtatccgaaaacgcactatgtaacgccgcgcgaacgtatcgtgcaggcgatggaagagatcaaagtcgatctcgccgaccgccgtcagaccctgcttgctaataataaactgctggaagagcagcgcctgacgcagcgcacccagtttgacctcgaaatgatgaacgaactgggctattgctccggggtggaaaactactcccgctacctttccggtcgcgggccgggggaagcgccgccaacgctgtttgactatctgcctgcggatggcctgctggtggtggacgaatcccacgtcaccatcccgcagatcggcggcatgtaccgtggcgaccgcgcgcgaaaagagacgctggtggaatatggcttccgtctgccgtcggcgctggataaccgtccgatgaaatttgaagagttcgaagccctggcgccgcagaccatctacgtgtcggcgacgccgggtccttacgagctggaaaaatcaggggaagatattgtcgaccaggtggtgcgtccgaccggcctgctggatccgattatcgaagtgcgcccggtggcgacccaggtggacgatctgctttccgagatccgcaagcgcgtcgccatcaacgagcgtgtgctggtcaccacgctcaccaaacgtatggccgaggatttgaccgagtacctcgaagagcatggcgaaaaggtgcgctatctgcactcagatatcgataccgtggagcgtatggagatcatccgcgacctgcgtcttggcgaatttgacgtgctggtgggcattaacctcttgcgtgaggggctggatatgccggaggtgtcgctggtggcgatcctcgatgccgacaaagaaggcttcctgcgttctgaacgctcgctgatccagaccatcggtcgcgcggcgcgtaacgttaacggtaaagccattctctacggcgatcgcatcaccgcgtcgatggcgaaagccatcagcgaaaccgaacgtcgtcgcgagaaacagcaccagtacaacgtcgagcacggcattacgccgcagggtctgaacaagaaagtggtggatattctggcgctgggcgagaacatcgcgaaaaccaaagcgaaaggccgcggtaagtcccgctcgccggtggtggaagagagcctggaacgcctgctgacgccaaaagcgatgcagcagaagatccacgaactggaagcgcagatgatgcagcacgcgcaaaatctggagttcgaagaagccgctgccgtgcgcgaccagctgcaccagctgcgggaattgtttatcgcggcgtcctgatcccggccgcgctatgccgctatggtatagcgcggtttgtttattgcgcctcagcatatgccaggcatatacttctctgaatgcagttgtccctgcccgggaggagtaaaagatgagaacggtatcgatattcaaaaatggcaataaccgtgcaatacgtttgccccgtgatctggattttgacggcgtgaacgaactggaaatcataagggaaggcgacaccatcatcctgcgaccagttaaaccctcctggggttcattttcgcaggaagaaaaagccgacaaggatttcatgcaggagcgtgaagatatcgtcagcgacgagggacgttttaaattatgagcatgacctacatgctggataccaatatttgctcatttattatgcgtgagcagccagcgtcggtattaacacggctggagcaggctgtaatgcgccgcaaccgtattgtggtatccgctattacctacgcagaaatgcagtttggcgctatcggtaaaaaagcctcaccgcggcacgggcagctggtgcaggcgttctgcgcccgcctcgatgccatactgccctgggatcgcgctgccgttgatgccaccaccaggatcaaggttgcgctggcggcggcgggtacgcctgttggtgccaacgatgccgctatcgccggacatgctatcgccgccaatgttattctggtgactaataatatacgtgaatttgcgcggataccgggtttgatccttgaagactgggcggaataataatgctacataatattatttaccgctcttattaatcccattaattaaccccaatccctatttttaattgctgtgatctgaataacgctgagctttgcataaatgcctccctgcattaattgatggcaaaatacgcaggatcttttctgcgcttttttattaagctggtttttattatccctcccgtaaaaaccaggaaaagagaatggaatcggtaaaatgtctgttaagagaaaatgaatatgccatggatgatgttcttacctgttcaggtattaacgaagaacatcataaaaattatggcgcggtcagcccaccgctggtgaaaaccagtttattcgtgcagcaggattatcagcgctattgtgacgacatgcagcacgaggcggagcgttatatttattcccgcgggctgaatcccaccacggaactgctggaaaataaactcgccgcccttgagcggggcgaagcctgcaaagcctttgcctccggtatgggggcgattgccgccacgctgttcgcgctgttgcgcagcggggatcacattatcctcgctaataacgtctatggtccgacgctggcactggttaagcaaatgcaggcgcggtttaacattacctttgacgtggtactgagcggcgaagcggcggacatcgcggcaaaaatccgccccggcacgcggattatctataccgaatcccccggcaccatgaccatgcgggtggtggatctgcgcgccatcgcccggctggcaaaagcgcacggcattatcaccgttattgacaacacctgggctacgccgctgttccagaagccgctgacgctcggcttcgatctgacgctgcactcctgcaccaaatacattggcggccacagtgacttaaccgccggggcggtggtgggccgccgcgagcatattgacgcgatccgcgatttttcccatcagctgcttggcgcggtgctggcaccggacagcgcctggctggtgatccgcggtctgcgcacgctgccgctgcgcatgaagcagcatcaggaaaatacgctggcggtactggcctggctgtcggactgcgaagaagtggaaaaactctgtcacccggcggtggcggatacacgcagccgggaattaattgccgcgcaaatgtacgggctctccggtttattcagttttgaattacgtgacggcagctttcagaaagtaaaaacctttattgatagttgtaaaatcttcaaacccggatgcagctggggcggttatgaaagcctaattatttcccccaatcgcggttataacgaggaagatattgcccgcgacggtatggcggcaggattaatccgtatttctgtcggccaggaaagtccgcaattattgatcgccgatttgcatcgcgcttttagcgccattaaaaactgctaaatatacaggaaagatgatgaacgctaacagggaaccgggctttaccgctgcgatgctgttattagcggtagtctttatcgtattttttaccggcatcggtatgttaaattatccggtagaattcattcttattgtcatcactattgtttccggcttttttgcccgctattacggggcaggctggcaggagatcatgcagacgtttatcggcaaaataaaagatgccgtgccggcaatgctgatcctgcttaccatcggcatgttaattggctgctggatggtcagcggcaccattccgctgatggtgttttacggcctggaaattatcaatccggcctatctttacctgacggcctttctggtgacggtgtgcatctcaacctttaccggtacttcatggggatcggcgggcaccattggcgtggcgctggtggcggtggcggccgccatgaacgtttcgttgccggtgaccgccggagcggtgatctccggcgcttactttggcgataagctctcaccgctgtccgacaccaccaacatggcggcgttggcggcaggggcggagctataccagagcattcgccacatgatgtacacctcggtcccggcgtttctgttcgcctgtctcggcttctggattgccggttcggatttgcaggcgacagaggcgctgcaactggacaccattccggtcatgaaaaatgcccttgagcagctattctggctgaacccactgctgatggtcccggcgctgctggtatttgtcggcgccatgcgcaaatgggataccgtgattgtgctggtcgcctcgtcgtttatggcgctcggtcttgccgcttttgcgcagccgttcgcgctggcggatctggttaaggcggcgattaatggctttcacaccagcatgatcccggatttcagttcggtgccgatgaacgaggcgaccagtaaaaatatcaacacgctgcttaaccggggcgggatgtactctatggtcagcccgattgtggtgatgctgtgcgcttttctgtttgcctcggcgctggacgtgtccggcgggcttaacgttattttgcagcggctggtgaaaaagctcacttcggtgaccagcaccgtgctggcaaccatgctgaccagctcgctgctggtggcctgtaccggcaatgcggtgatcagctttttcctcgtcaaaaacatgtacgatccctgctttaaaaccaaaaagctgcatatggtaaacatgtcccgcgccatggagtccggcgcgacgctgctggaagggctgttcccctggaccatttcagggatgtttatggcgaaaaccctcggcgtggcgacgctggagtatgcgccctgggtgctgtttaatctgagctgcttcgtgatggcggtactgtacgcggtgctggcgcgctggtccgctttcggaacgcgttacgaaacggagaatgagaggggcatcacatcgtaacgcatttattcatacggcttaatctaaccttaatcttgcgcagcgacactgtcctcagcttaatgaggacagtgccatgcaaaaaataacttccgtacaattactcgcccttgctgccacgctgatgatcgtcgccagcttcctgcatacctggtttaccgtctgagcgccgcctgagcgcgggcatccggaaaccgtacccctgcacgcagcccaggtcctgggtggcgattatgtaaaaataactccccgtcatgtaactgggcgatacggctgacgatactcagacccagccccatgccgccgtaacggctgtccatacgcacaaaggctttgctcagctcgtggctggaggcttcatcaatgccggggccttcatcttcaacggccagtacaggggcgtcgtcatcgctgacggtgagggtaatggtggccagctccgggctgtaacggtgcgcgttttccaccagatttctcagcagaacgcgcagttgcggcgcatcgccgctcaccgcaatatccccggcgttttccggccacactaatttctgctggcgtgtgctcaccatggtgagcagttcgtcctgcaagggcaggatcacatcgcggatcagcatcacctgctgatagcttcccgccgagaacgactgcgccacccgtgccagttgcagcaactgcgagacgttttccgtcatctgctcaatgcgcaaaatgagatggctgacgtcaatcgcatggcttttcgacaacaattccagatgcagccgcagcccggcgagcggtgtgcgcagctcgtgagccacgtccgcggtgaacaggcgctcccgatcgagagtcaccgtcaggcggcccaccagctggttgatcgccgtggtgaccgcttcgacttccggcacgggtttttccagcgcgatgggttgcagattgtccggcgtgcggatctccagttcatgctgcaaatcttttaatgggcgggtgatgcgttttatcgcctgtaagcacagcaccagcgcaaggccgatgatgaccaggcttgggatgagcaggctggcgaccgcttcgtgcacttcatgtttaatattgctgtgattgttggctttgtagatctcgctttccacaatcagctggatctgctctttgctttcatgccacagccagaacacgctcaccagctggcagaccaccagaatggtgccaatggtcagcagcaagcgacgccgcagcgtccagtgtcggaaattcatgctttactgctctcccggcgtttttaccagcagatagccgaagccccgcaccgtacggatgcgatctttacccactttgtcgcgcagattatgaatatgcacttccagggtgttggtggccggttcgttatcccagctgtaaatatcgttgtatagaatttcccggtgcaccgcgttgcctgcttttaacatcaggcgcgaaagcagggcgtactctttcggcgtcagctccagcggcctgcccgccagcttcacctgacggttattcacattcagttgcagatcgcccacagtcagttcgctgtcgccctgattatgctgacggcgcagcagggcgcggatgcgggcgttgagctcctccagcgcgaagggcttcatcagatagtcatccgcgcccgcatccagtcccgatacgcgatcctcaacggtatcgcgcgccgtgagcaccagcaccggcagggcgcatttttcgcggcggagtcgctgcaaaaaatgcacgccgtcttcatcgggcagtcccagatccagtacgatcaggctgtaatgccccatcgccaggctctgcgaggcctcccgcgccgtagagacgccatcgcaggcgtaaccttcggactgcatcgccagcagcaggccctgcaataacagggtatcgtcttccaccactaagattttcatcagcattaccccctgcacggcgcgagaatatcatctgccgcatgatactcgctggtttgtacgcccactaaccctaacatcgttgagaacagattatcctgggaaaatgcttccgcgctggcgcgttttttcaggcagctgtaattcacagcgtgacctttctgatactggtcggaaagccagatcaccatcggaatatgtttttgtgaatccggcgcgatggaatagggcagaccgtgcaaataaacgccattttcacctaaggattcgccgtgatcggaaagatacatcaggctggtggtgacgttgtccggctgcgcctgcaataatttaatcgccttatcgacaatataatccacgtacagcaccgtattatcataggtgttaaccagctgctcgcgggaacaggtctggatttcattggtgtcgcaggttggggtgaatttgcggaactgcggcggatagcggttatagtaggtcggcccatggctgccaatagtatgtaatacgatcagcccgtcaccgggaaaactgtcgatagatttttgcagatcgtgaaacagaatttcatcctggcattcgcccgcaatgcaataatctgccagattcagtttcgtcatatcctggtgcggcacacggtcgcaggcacctttacagccgccgtcattttcattccactgcactgatattcccgcgcgctgcacaatatccagcaaaccttcacgatgatgcgcgagttgttcattgtaatttttgcgcggcatgccggaaaacatgcagggcaccgaaattgccgtcgccgtcccgcaggaggtggttttcgggaaatagaccacattgtctttcgacagcagcggattagtatctcgtggatagcctgacagcgcgaagttatccgctcgggaagtttcgccaacgatcagaatagtcaggtgtttggtctgcggcttgtgcatcgcgggggtaagtgttgcgtcctcgcccagccggaccagcggcagattatccatacggtgatgaacatcataagacaggagggcgctgatgctgttcgacgggccaagggatttcaccagctctttattattgcgaaacagcgaggcgtaatctttataaaagcaggcggcgataagcaatattatcgccacagacgcgagaatattcacacagcgcatagcggcgctatgtacacgcgtacggctttttttgaatttcaccacaaaggcgaggatcgccatggcaataccggaaaggcctatggtcaaaattaactgcggcgtcatcagggcgaaggattccgctggcgtggtatccagcatattggcaatcatcgagcggtcaataatgatgccgtaggtccagatgaaatactgcgtggcggcgctgagcaaaataaacaccgcgatcaccagccgatccagccacagaaaagaagccagcgttgcgatgatattaatcacgctgaacgccaccagcggcatcgacagaaacaccgccagattgtaagccgagttaacgggtaacagggcccaggcctgacggtaataaatgaggttgaggaaaacagcaatataaacagaaaacagcagcaaaaaagtcaggcgactcattgcagggcggcgaagcggaatacggcgcatagtgaaggtcctgtgagaatataccaggcatgttcacagacaagggttaagccaaccttaagaacttaagaaagcgctgagtaaagtgtttcccctcgtaacaggcgaggggaatgctgtcagccaaggctttgcaccgcacgctccagcgccgcgcgcagcaggcggcggtcatggcggtagggcacgtcgctggcttccagcacgtcctggatcacgatgcggtctgtcaccgacgaaacgtccaccgtcgggccaaccaccaccgcgtcaataatgcgtttgccgacgtactgctccatcagcgccagcttgtcgttcaggctgaggctggcggcggcgacgctgagttctttgccaagattaccgatatagaccaccggagccggagtgcggcgcagcgcctgcgccagattgtcgagcagcagcagcggcagcaggctggtgtaaaaactccccggcccgattaaaatcaaatccgcttcggcaatggcctgcaccgcctcgcgggtggcctgggcgctggggaacagcatcagctcctgcaccggctgcgtcagctgatcgatattcacttcgccatataccgcatggccttcgctgtcgagcgccatcagatccagcggctgctccgacatcgggatcagaaaggcgtccaccttcagcagattacggatcaggttaatggcctccagcggccggacgctgagatgatccagcgctttcagcatcaggttgcccaggttatgccccgccagctcgccgttgccggtgaagcggtactcgaacatcgccgaggcgacgcttggctcggtgataagctggttaagacagttacgcatatcgccccaggcgatgccgccttcagaacgacgaatgcgtccggtcgagccgccattatcggtggtggtcacgatgccggttaaacgggagccgagcgaggagagggaagacatcacccgtcccagcccgtgcccgccgccgagggcgacaaccctgtcgagatccgcaagagtgcgattgcgcatagccagtccttatgtcgaaaaaatcacgttacgttacccgaaatacccctttatgacgatgtcacgtcggggggaagatgacacatatcaatgcaaggccgggattatcgcgtagtctgtaatgaaaatgcacgattatgtcgctatgtagttaattatatagcgctatgcaaggatggcggaacaggtcgtatcgcgatattatcgcctgagcttgctaactaaacacactctagcctctgcgcctacgtcttaatgatagggtgctttggccgtggcgaaccgccaccagggtgcaggaagaaatgactgcacctcccgtatctggaaaggtgtacatggcctcacaacttaccgatgcattcgcgcgtaagttttattacctgcgtttgtctattaccgacgtgtgcaattttcgttgcacctattgtctgcccgatggctacaagccgggtggcgtgacgaacaaaagctttctcagcctcgacgaaattcgtcgcgtcacccgtacctttgccgcgctcggcacggaaaaagtgcgtctgaccggcggggaaccctcgttgcgccgcgatttcaccgacattatcgccgcggtacgcgaaaacgccgctatccgccagattgcggtgaccaccaacggttatcgcatggcgcgcgacgtgcagagctggcgcgatgccgggctgacggcgattaacgtcagcgtcgacagccttgatgcccgccagtttcacgccattaccggccaggataaattccgccaggtgatggacggcatcgacgccgcctttaccgcgggctttgagaaagtcaaagtgaataccgtgctgatgcgcgatgttaaccatcatcagctggatacgttcctggcgtggatccagtcgcgtcccatccagctgcgctttatcgaactgatggaaaccggcgagggcagcgagctgttccgcaaacatcatctctccggcatggtgctgcgcgatgaactgctgcgccgtggctggatccagaagctccgtcagcgcagcgacggcccggcgcaggtgttctgccacccggactatgaaggcgaaatcggcctcatcatgccgtatgagaaagacttctgcgccacctgcaaccgtctgcgcgtctcgtccgtcggcaagctgcacctgtgcctgttcggcgacggcggcgtcagcctgcgcgatctgcttgccgatgacagccagcaggctgcgctggaagcgcgaatttcagaggcgctgacgcataaaaagcagacccatttcctgcatcagggcaataccggtattacgcaaaatctgtcgtatatcggcgggtaacaccgaataaggagatcctttatgagtcaggtcagtgcagattttatcccgacccgtatcgccattttaaccgtcaccagccgtcgcaccgaagaggacgatacttccggccactatctgcgcgacgccgcgcaggaagtcgggcatcacatcgtcgacaaagcgattgttaaagagaaccgctacgccattcgtgcgcaggtttccgcgtggatcgcctcggacgacgtacaggtggtattaatcaccggcggcaccggattcaccgccggcgatcaggccccggaagcgctgctgccgctgtttgaccgcgaagtggaaggtttcggggaagtgttccgtatgctgtcgttcgaagagattggcacctcgacgctgcaatcccgcgctattgcgggcatcgccaataatacgctgatttttgccatgcccggctcgacgaaagcctgccgcaccgcctgggaaaatatcatcgccccgcagctcgacgcacgcacccgtccgtgcaattttcatcctcatttaaagaaataaaccatgtctcagttgacccacattaacgccgcaggcgaagcgcatatggtggatgtgtccggcaaggctgaaaccgtgcgtgaagcgcgcgccgaagcctttgtcaccatgcgcccggaaacgttacagatgatcattgacggcagtcaccacaaaggcgatgtgtttgccaccgcgcgcattgcgggcattcaggccgccaagcgcacctgggatctgatcccgctgtgccatccgctgatgctcagcaaagtggaagtcaatcttcgcgccgaacccgaacatcaccgtgtgcgcattgagtccctctgccggctgaccggaaaaaccggcgtcgaaatggaagcgctgaccgccgcctccgtggcggcgctgactatttacgacatgtgcaaagccgtacagaaggacatggtcattggcccgctgcgcctgctggcgaaaagcggcggaaaatccggcgatttcagggtggatagcgatgattaaggtgctgttttttgcgcaggtgcgcgaactggtggcctgcgacgggctggacgttaaggccgaatatgcaagcgtagaacagctgcgtgcggcgctggcggcgaaaagcgatcgctgggcgctggcgctggagtccggcaagctgctggcggcggtcaatcagacgctggtggattttaaccacccgctgcgcgaaggcgacgaagtggccttcttcccgccggtaaccggaggttaagctgatggaaaatacccgtatccgcgtgggtcatgaaaatttcagcgtcggcgacgaatatcagtggctggccgcctgcgatgaagacggagcggtggtcacctttaccggcaaagtgcgtaatcataatctgggcgacagcgtcagcgcgctgacccttgaacactatcccggtatgaccgagaaagcgctggctgagatcgtcagcgacgcccgcgcgcgctggccgctgcaacgggtatccgttattcaccgcatcggggaattatggccgggcgatgaaatcgtgtttgtcggcgtcaccggcgcgcaccgcagttccgcctttgaagccgcgcagtttattatggattatctgaaaacccgcgcgccgttctggaagcgtgaagccacgccggaaggcagccgctgggtggacgcgcgtgacagcgataagcaggccgccgaacgctggtgacccgctttcgcagggatgtgttaaccttatagtctcttcacttaatcaggagttaatcatggacagatacccaggaagcggttcgattgtcgaggcgcgcagcgggctgcaaacctatatggcgcaggtgtatggctggatgacctgcggtctgctgttgaccgcctttattgcctggtattctgcgaataccccggcggtaatgatgttcgtcttctccagcaaaattacctttttcgggctggtgattgcgcagctggcgctggtgttcgtgctttccggcatggtgcatcgcctgagcgcgggtatggccaccacgctgtttatgctctattccgcgctcaccgggctgacgatttccagtatttttatcgtctacacctactcctctattgccagcacctttgtggtggccggcgggatgtttggcgcgatgagcctctacggttacaccactaagcgtgatttgagcggcttcggcaacatgctgtttatggcgctgatcggtatcgtgctggcttcgctggttaacttctggctgaaaagcgaagcgctgatgtgggcggtgacctatatcggggtgattgtgtttgtggggctgacggcctatgacacgcagaagctgaaaaacattggcgagaatatcgatacccgcgacagcactaacctgcgtcgttattcgatcctcggcgcgctgacgctgtatctggactttattaacctgttcctgatgctgctgcggattttcggtaaccgccgctgataataacagagccgggcggcacgttgtttgcccggcctacgttatctacagaacgcgtaggcccggatcgctgcgcgccaccgggcgatactaatcttacttcgccatcgccttctcgttcttcgcccgtagcttcttcgcccggctttccagcagcaggtaacacaccagcgccagcagcagcgggataaagtaatacagcatacggtaagcgagcagggcggcgataattgcccctttagacgtatgttcccccgccagcagcgcaataaacaccgcttccagcacgccgatacccgccgggatatgaatgatcacccctgcgatactgctcaccagcaggacgcccagcacgaagaaatagttcacttcctggcccagcagcagccagataatagcccccatcgccatccagttggcgctggagatcgccatctgcgccagcgcaaacttccacgacggcagcaccagcttctggcctttgatggtggcatggcgacgtttggcaaaggcgcagaaccacatataggcggcgataaacgccagcagcaccacgcccgcaatacgcagcgtaccttcgtcgatataccagtgggcgggcagttccaccacgccaaaggtgaagataatgccgccaagcagaatatagcccagccagttcgtggtgatactcagggagaaaatacgcgtgatggtgctgcccggcagccccaggcgggaatagagccggtagcgcatgccgataccgccaacccaggtgcttaacgtcaggttaaaggcatagcagacaaaggacaccagcatcacctgccgcgccgccagcttatgcccgcagtaggtgcgcgccagcagatcgtaacagccgtagagcagatagctcaccaccaccagacccagcgcaatcagcagcgtcgtgcggttatagttgcggatcacctcccagacatcttcccagttcaccgtgcgcgcatacaccaccagcagaactgccatggcgataaaaaacacccatgtcaggatttttttggcaagacgccacttcggatgcgattttgccatcagggttttacctcagagttttcgggagtgacacgatcctgggtttcgatttcaggctgtaccggcgcgggcacctgcgccagccgcggcgtatgggctggcaaccatcccaccagcgccgggaatttacgcaggaagtggaacaccaccacgttgatggccaggttccaccaggtgcgcttcggcgccatggtttcatccacgcgcttacagtcattagcgataatcgcgttgagattctcgcgtagcgtctggttaaactcgcggtcatgaatgatcaggttggcttccagattgagcgacaggctgagcggatcgaggttgctggagccgacggtcgcccagtgatcgtccatcagcgccactttgccgtgcagcgggcgacgccggtattcatacacctgcacaccgcctttcagcagatagttgtacagcagttccgcgcccactttcacaatcggcatgtcgggttcgccctgtacaatcaacttcacccgcacgccgcgccgcgccgcattgcgcatggcatgcagcagacgatagccggggaagaaataggcgttggcgatgatcacctcgcgtttggcattggcgagcattttcaggtagtgacgctcaatgtcgtcccggtgatcgtcgttgtcgcgccagacgaacagcgcctgcgcctcgcctggggtgcggttttcctccgccagatgacgacgacgctgctgccaccagcggcgggtttgcgcgttctgcggcaggttttccagttcaaattgcagaatatcctgcaccaccgggccttccacccgtactgcgtaatcctgtttggcttctggtccgtaatcggacatatgttcggcagagtagttaatgccgccgacaaaggcgatggtattgtcgatcaccacgatcttgcggtgcattcggcggaacacgttggtgcgcatgcccatcagcggagggcgcggatcgtaatagcggaacaccacgcccgcagacgtcagttgactgacaaattcgtcgctcaaatccggtgagccgtagccgtccaggagtacttccacatccacgccgcgctgcgccgcgcgcaggatcaccgcgtgcagctgtttgccgacctcatcctcaaaccagataaaggtttcgaggatcactttgcgctgtgcatgatcgattgcatcaaacaccgcgggataatattcgtcaccgttttccagaagctggatacggttcccttctcgccagccacatttcataaatggatctccgcgctcagcggcgcatgatcggacaaatgacgccagttgcgcagcggaagcgccgtgggcgcgctggcactggcatttttcacataaatacgatcaagacgtagcaccgggaaactaaccggaaaagtacgcgccggacggccatgcgcccgcgtaaaaatctcttccagtccggccttcgtttgcaggggacgatttgccttttgcagccagtcgttaaaatcacccgccaccagcaccggctcaccttccgggaaggcatttacccactcagccagcatatccagctgcgcctgccgatgcgcctcgcgcaggcccagatggacgcaaatcacgtggattggccggtcatattgcggcggcacaatgcggcagtagagcagaccgcgattttcgctgccctccaccgacacatcacggttttcatagtgttctatcgggtagcgcgacagcacggcattgccgtggtgcccttcagggtagaccgcattgcggccataggcaaagtcgctccacatggtatcggcgaggaattcataatgcgtggtatccggccagttctcgacgtgcagcgggtgcacttcatgcgcgcccatgacctcctggaggcagacgatatccgcgctgacggtgcgcaccgcatcgcgcaactcaggcaaaatgaagcgtttattaaatgctgtgaagcccttgtgcgtattaatggtgagcactttcaaagaaaactgtcgggtttgttgcgtcatttttatccttcccgcgtcactatcctgatgaaaataaagtgtagtccttgtcacaaaaagatgcggccttacggatttttccgtaaagtccggtactctcaatacagttagatatccgttaaggagataagccatgagatggcaacagcgtattcgtgtcgcaacaggcttaagttgctggcagattgtgttgcatttaatggtcgtcgcagtgctgataatgggctggatgagcaaggcgctggtgcatgtcggcctggggctgtgcgtggtctatggcgtcaccgtgctgctgatgctggcgctgcaacgtcaccatgaggcgaaatggcgcgaactgggggatttcctcgaagagctgaccaccacctggtattttggcgcggcgatgatcgtgctgtggctgctctcccgcgtgctgcaaaataacctgctgctggcgctggcgggcgtggtgatcctcgccggtccggcaatcatttcgctgctgatgaaagataaaacctcaggccactttacgacgaaacatcgcgtacgccgctgaacctgtcgtggccgttatcaccagtaacggccataaacttccccatacgatccccagactcgcatccttgagataaatttgcttggtaatgtcggtgaaatggcggatcggattcacccacgtcagattctgcaaccagacaggcatgttttccaccggcgacacatagccggagagcaaaatcgccggcatcataaacacgaatacgccgataaacgcctgctgctgggtggcgcagagcgacgaaatcaacagcccgaagcccaccagcgacagtccgtaaatcaccatggtgaaataaaacagcagcagcgatccggcaaaggggatctgataggcaaaaataccgatggccagcacgatggtggcctggaaggtggcgacgattaacgccggtaccgccttgccgacgaagatctgccaggtcgccagcggcgacaccagcagctgatccagggtgccctgttcccgctcgcgcgccaccgacagcgaggtgacaatcatcacgccaatggtggtgatcatcgcaatcagcgacggcacgacaaaccatttatagtccagattcgggttataccagttgcgcaccaccagttcgctgttattcggttttggccgatcccccagcaactcctgctgatagtctttgacgatttgctgtaaatagttggcggcgatctgtgcgctgttggagttgcgcccgtcgaggatcagctgcatcggcgcaggctggaagctatccagattgcgcgagaaatccgccgggaagcggaccagcagcagggctttttgctggtcgatggtcggcttgatctcctgcggactgttgagcatgaggacgtgcgtaaaggctttcgcccgcgcaaaacgctgggtcagctcgatggcatgtttgccgttgtcttcgttatagatggctatggtggcgttggtcacttccagggtggcggcaaagggaaacagcagcacctggatgagcaccggcagcacgagaatggcgcgggtttgcggctcacgcagcagcgattgcagctctttgcggattaacgtccagagtcggtgaaacatgtttgctccttaaaacgatcctgacgaccttgttggcccggtaagcgcagcgccaccgggcataatcaatccagccgccgtttggttttcatccacgtcaggccgataaacatcaccgccgaggccaccagaaacagcgtattgatcaccagcaccgtcgggatgtttcccgccagaaacaggctttgcagggtactggcgaaataacgcgccggaataatgtaggtcaccatgcggatggcggcgggcatactgtcgatctgaaagataaagccggacagcattaccgaaggcagaaacgcggcgttcagcgccacctgcgcggcattaaactggttgcgggtaatggtcgaaatcaacagccccatgccgagcgtgctcagtaaaaacagactggtgatcaaaaacagtatcaacagcgagccgcggtagggcacgcccagcacgaacaccgacaccagcatgcacagcagcatcgccagcatgccgagaaaatagtaggggatcagcttgcacaatagcagctcgccgcgcgtcacctcggtggagagcagcgcctccatagtgccgcgctcccactcccgcgccaccaccagcgaggtaagaattgcgccgatcaccgtcataatgatggtcaccgcgccgggaataataaaatgttggctgatggccgccgggttaaaccagtagcgcatctgcacgtcgatcagcggttcaaaggtttccccacgatcgctggcgcgctgggtctgccacagctgccagatgccctgcacatagccctgcacaaagttggcggtattcggctcgctgccgtcggtgatcacctgcaccggcgcatcatcgccggggcgcgccattttttcggcgaaatccaccgggatcaccaccagaccgcgaatgcgtcccgcctgcatcatttcaatcagctgtggacggctgttgctgatggtggcgtcaatatagggggagccggtcattgcatgggtgaaatccagcgcctcctcgctgcgctgctcaagcaaaacgccgacgcgcagcttgctggaatcaaggttaatgccgtagccgaagataaacagcaacagcagcggaatgacaaaggcgatcagccagctgctggggtcgcgcacgatctgccgcgtctctttcacgcacagcgcgcgcacccgccgccagcttatagcggaactactcattggcatgctcctcgtcccagtcgttgatcaggcggataaaggcctgctccatggtcggatccggctgcgcatcgtcggcggcctgcgctttaagatcgtccggcgtaccgctggcgatcagcttgccgcgatacaccaggccaatacgatcgcagtactccgcttcgtccataaagtgcgtggtcaccatcacggtgacgcctttttccaccatgctgttaatgtgcagccagaattcacggcgggtgaggggatcgacgccggaggtcggctcatccagaaacagaatatccggctcgtgcatcagcgagcaggccagcgccagccgctgcttaaagccgagcggcagagagtccgtcgcctgtccggccagcgttttcaggccgaacgcctcgctcatacggttgattttctcctcctgcgcccgcccacgcaggccatagacgccggagaaaaagcgcaggttctgttcaacgctcaggttgccgtacagcgagaatttttgcgccatatagccgagatgctgccgcgctttgccggagctgactttcagatccatccctaacaccagcgctttaccggacgtcggcaccagcaggccgcacatcattttaaaggtggtggatttccccgcgccgttcggcccgagcaggccgaagatctccccgcgtttgacgctgaaatccacgtgatcggtggcggcgaaatcgccgaattttttggtcagggactgcgcttcgatcaccgtttcgtccacgctgccagtaacggtgtgcagaatagcgccgagcggggattctgacgcccccgcgccgccgagcagatcgataaaggcatcctcaaagcgcggcgcggtttcagcgatctcaatgtccggcataccgggcgcctggcgaatatcgtcggcggtggcctcttttttgaggatcaggcgtaccgatttgccctggatcatgccgtcgctcacctgcggcagcttcagcgcgcgctgcaacagacgacggttattttcctgcgggctgtgcagcagaaaactgcgtccggcgatggtttgcgtcagcgcttttggctcgccctgatacagcagctcgccttcgttcatcagcagcacatcgcggcactgttccgcctcgtccagataggaggtgctccacaaaatcagcatgccgtccccggccagctcatgcaccatctgccacagctcccggcgggagatgggatcgacgccgacccccggctcgtccagcagcagcactttcggctcgcccaccagcgtgcaggccagccccagcttctgcttcataccgccggaaagttttcccgccagccgcccggtgaaggggccaagggccgtaaattccagcagccgggcaaaagtttgttttcgcgcttcgccggtgacgctgcgcagatcggcatacagattgaggttttccatcaccgttaaatcttcgtacaggccgaatttttgcggcatatagcccagcaccgcatgcagagcgcggtcgtcctggacaggatcgaagcccagcacccgcgcttccccctcatcaggcttcatcagcccggccagcatccgcatcagcgtggttttgcccgcgccgtccggcccgaccaggccggtgacgtagccggaggcgatcccgcagtccagccgcgccacggcgggcttgtccatcccggcaaagcgtttaaccaggccgcttaactggatgccgtcattactcatgcgccgcggcatcctggaaggtggcggtgatcggcatcccctggcgcaggttatcgtcggcatcggtgacgataatgcgcaggcgatacaccaggtcggtgcgcagatccggcgtctcgacagttttcggcgtgaactccgccgttggcgaaacaaagccgattttgccgtgatagggcttatccgggcggctatcggtatagagcaggatttcgcggcctgggcgcgcctcgccgaggctctgttcattgatataggcgcgcacccacaccgggcgggtgagggacagggttaacaccgtgctacccgcattcagcatactgcccggctccacggcgcgggtcaacaccgtaccgtcggacggcgcgaccagcgtggtgtcatgcagatccagctccgcctgggccagctgcgcctgtgcctgttcaaggcccgcttttgcctgggcgatttcctgcggccggttcccggcgcggaactggctgagcttatcctgcgccgatttcaggctggcctgcgcctgatcccgtgacgaacgggcattttccagatcgttggcggagatcacccggcttttccacagcccctgctggcgctgataaaagttttgcgcatagtcataggccgcgcgcgcctgattgaccgccgccaccgcctgggcgatctcctcatcacggtagcccgcaatggtcagatcgtatttcgcctgcgcggtggagacattggccttcgcctgcaacagcgcgttctcataaggggcgcgatccagcacgcccagcgtctggcccgctttcagccggtccccttcatcgacgttcagcgtctgtaaacggccgccgacgcgaaagctgagattcaccgtgcgaatatccacgttgccgtacagcgtcagcggctgatcctgacggctctgataccacagcgtgcccgcgccgataacagcgagcaccgccaccatcgccagcgcgataatcaccggttttttcatgactcctgactccttaacgttaatccttcgaggataagatcgagatggcagcagatgacttcatagatttgcgcgcattttccggcatcaaacgcctgccagcctgcgcgcagtaaaatggtttcccgtccgagacggaaggcgaggatctcgccgagcagggcgtgagtgtgcagaatcgtgcgcgtatccccggcgtcgcgcccggtaaaggcggcgatcaggcgcgttaaatggctatgtaagggatcgatcacctgctcatggatcaggtgataggcgcgggtaggggagagctgctcgcgggagataaatttgctcagcggcagggtttcatcttcggtcagcagctggatcatattgttgcaggcgcgcaggatcagctcgcggatggcggctttgtccggtgcgggctgcgccagcagacgctcggcggcctcggcatgggcacggaaattctcgccgataaagtcggcaatcgactgggcgcaggcgaggtaaagatcctctttcgaaccaaaatagtaggggatggcggcaatgttttgcccggcctgcgcggcgatctcgcgggtggtggcattcaggccatactcaccgaactgcgccagcgctgctttgatcagcaggccttttgcctgttcgcctttgctggttttcagggatgcattcatggcgtcattaaaaattaatcaatcgattgattaacattatgcctgttttttgaccttgtccagtacagtgaattattttgctgacaaccgccttcgggataatttatgcggtatgtcacaaaagctgctacactccgcctcttcatgacattgtggtttttgtcatccgtcacgttactgatctccctgaaaactacaccggtaacggtcggggcggttcggagttgttatgtcttttgatgaactgggtttaaaccctgagatcctgcgcgccgttgccgagcagggctaccgcgaacctactcctattcagcagcaggccattccggccgtgttgcaggggcgcgacctgatggccagcgctcaaaccggtaccggcaaaaccgcaggcttcacgctgccgttactgcagcacctggtgaacaacgagccgcacagcaaagcccgccgtccggtgcgcgcgctgatcctgacgccaacccgtgagctggcggcccaggtgggcgaaaacgtccgtgaatacagcaaatacctgaatatccgctcgctggtggttttcggcggcgtgagcattaacccgcagatgctaaaactgcgcggcggcgtggacgtactggtggcgacaccgggacgtttactggatctggaacaccagaacgccgtgaagctcgacagcgtggagatcctcgtgctggacgaagcagatcgcatgctcgacatgggtttcattcacgacatccgtcgtgtgctggcgaagctgccgaaaaagcgtcagaacctgctgttctccgccaccttctcggatgagatcaagggacttgcggaaaagctgctgcataacccgctggaaatcgaagtggcgcgtcgtaacaccgcctctgagcagatcacccagcacgttcactttgtggataaaaaacgcaaacgggaactgctgtcacagctgatcggccagggcgactggcggcaggtgctggtgtttacccgtaccaagcacggcgcgaaccatctggcggagcagcttaacaaagacggcatccgcagcgcggcgatccacggcaataaaagtcagggcgcacgtacccgggcgctggctgatttcaaatccggcgatctgcgcgtactggtggcgacggatatcgccgcccgtggactggacatcgaagagctgccgcacgtggtgaactatgaactgcctaacgtgccggaagactatgtgcaccgtattggccgtacaggccgtgctgccgccaccggcgaggctttatcgctggtgtgcgtcgatgagcacaaactgctgcgcgatattgaacgtctgctgaaaaaagagatcccgcgtatcgccgtaccgggctatgagccggatccgtccatcaaggcggaacctattcagaacggtcgccagcagcgtggcggcggcggtggacgcgggcagggcggcaatggccgcagccagcagccacgccgtaacgacagcgcagcgcctggggcacgccgtagcagcgagtcaaaaccagccggtgaaaaaccgcgtcgtccgcgtccgcgcaaaccggcggcccagtaaccggaacgccctctcctgcgggagagggaaaatccgcgttgtcactttgtcagcggatcgctaacatacgcttcactctgtgcggagcgctctgatgatcgataaacattctgccgtcccggtatatttacagcttgaacagtatctgacccgccgtatctgcgccggtgatttacgtccgggcgacgtcattccatcggaaaatgaactctgccagcagttttcggtgtcgcgcatgaccgcgcgcaaagccgtggattatctggtgcgtcagggaaaagtggagcgccgtcgcggtcagggcacctttgtcgcccatccaaaaaaaatcctccgcattccgttacctctcgatcgtcatctctcctccagcgaagccaccctcggtcttgatgatccggtgataaaccgcctgatctgcctgtcccgccagcctgcgcccggtgatattgccgacaaactgcaattgcaggccggggaagaggtctggtttatgaaacgcctgcgcctgctggatgacatccccttcgtgtttgagcagtcgtggatgttactcgccccgttttccgatctgagcgaagccgatctcaacgcttcgaaatacgcttacatcagccgcaagggacataccgtcgcccgctcagagaaagagatccgcgccgagctgccgtcccaggacgtgcgggatatgctcggtattaatcgtgacgaacccgtactacatgccacttccgtcgcctggcttgcggaaggcattcccttcgaagtttctgaaatctattacaaccaacagcattaccgcttcacgcttaccgctgaacggccgtaaataacggcgaatttgtgatccatctctggttataaaataagtgggctagacaactatacatgttaactggctatactcatggcaggtcttcgatccgtaaatcacttacttcaataaggatcacgctatgagtcgcgctggcgagtttttacaagatttaggaaaggcattaatgatgccgatttcggtgattgccgccgccgggatatttcttggccttgcagcggcattgcagaatccggcgattgtcagtgctgacatgatgaatgcgcagatgatgcagcacatcatcggttttattcgtaaggtggccggatcgctgtttgccaatttaccgttgctctttgccattgccgccgccattgggctggcgcgggatgaaaaacccacggcggcgctggcagcggtgatcggctttattacctttcacgtcggcgtcaatttcagcctgctggtgcagggcttaacgcccaccaccacctccgtggccgcctttgttgaaaaaggttatagccagaccgaagcggtgatgtattccgcggaattcgccagcacgctggggatattttcctatcagatgagcgtactcggcggggtgattgccggtatggtcacggtattactgcataaccgtttttatatgattaaactcccggcggccatcgcctattttggtggccgccgctttgtccctattattaccgtggtggtcctgccgctggtcggcgtcttaatgtcgttaatctggccggttattgccacggcgattattcatatcggcgaatttattggcgagtccgggccgttcggcacctttgtttatgcctttaccgaacgcattctgatcccgaccggcctgcaccatattcttaatgaaaccgtgcgtttcaccccggtcggcggcatggtgcatgtcgataacgaaagcgtgatcggcgcgctctctatcttcaactatgcgctggcgcatcctggcgcgctggcagatgacattacccgcgaagccacgcgtttcctggcgcagggcaaaatcccggtgatgatgttcggtttacccgctgccgcgctggctatttatcgctgtgcccgacctgagcataaacagcgggttaaagcgctgatgatggcgggcgcgctggcctcctttaccaccggtatcaccgagccgctggaattcagcttcatctttgtctcacccatcctgttcatattccacgccatcatgtccgggctctcttttgccggcgcgcagttgctggaggtgatgatcggcaatattcagggcggctttatcgactttatggtgttcggcgtactgggcggcacgaaaacccactggtggttcagtctgctacagggcgctatctgggcgccggcgtactacttcgttttcaaatgggtcattttgcgcaccaatgctagaacgccgggtcgtgaagatgaagagagcgtgcgcagcgtactggcaggggcaggggagccgtccggtgaaaccgcactgatcgtgaaaggtctgggcggcagcgagaatattcagcacgttgactgctgctttacccgtctgcgcgtgaaactgcgcgatatggcgaaagtggacgaagccgcgctgaaacagagcggagccagtgggtttattcgtacgacggagaacgatcttcaggttatttacggaccgcaggtggaaagcatcgccagcgccgtaaaacaaaatttaattcaacagacgcaataagagaactgatgatgaaaaacacttttaatatcgtattagttggcggtggttccacctggacgccgggtttattaaaagcattatgcaaactcaaggcgcgtctgccgctgaagaaactggtgatgtttgacgttaatgaagagcgccaggcggtcattggcgagtatgcgaaagtgctgttccgggaagaatacccggaactggaatttacctacaccacggataaagacgtggccttcaccgatatggatttcatcttctgccagatgcgcaccggcggctacgcgatgcgcgaaaaagatgaaaaaattccgctgagcctcggcgtgatcggtcaggaaacatgtggcgcaggcggcttcgcctacggtatgcgctcgatccgcgacatgatccagctggtggaagatgtgcgcgcccgctcaccgaaggcgtggatcctcaactataccaacccggcggccattgtcgccgacgcgctgaaccagcgtttcccggacgacgatcgcatcatgaatatctgcgaccagccggtgaacctgctgcgctcttacggtcgcctgctgggacgcaatccggaaaacttcgagccggtctattttggtcttaaccacttcggctggttcacccacctgtacgatgaaaacggtgtcgatctggtgccggaactgaaagccattatttccgacaacggctttaaaccggcggatgccgagcagcgcgatcagtcctggctggacacctacgccgccgtcgccgatatgctgcgcgatttcccggactatctgccgaatacctatttgcagtactacctctatccggaatacaaattctccaaactggatccgaattttacccgcgccaacgaagtgatgaacggtcgcgaaaaacgcgtgtttgaggagtgccgcacggcggtggcggaaggcaccacccaaaacgttaaagtcgtgcataacgacgcgcatggcgacatgattgttgagctggcggaagccatcgccttcaatctgaagaagaaattcatcgtcatgctggaaaacaacggtctggtggagaaccttgacgacgacgtgatggtggaagtggtggcggaaatcggcgttaacggcgcgcgtccgtatggcgtcggcaaaatccccaccttctacaaagggcttatcgagcagcagtttgcctatgagcgactgacggtggaggcctggtttgaaggctcttacaccaaagcgttgcaggcgctgaccctcaaccgcaccattgtggatgcgaaaaaagcccgcaaagtgctggatgcgctgatcgaggccaacaaagagtactggcctgaactgcgctaagcggagcgggagaaggtaacttctcccgtttttacgagccgccttccagaggcggcaaaaaaaggtactgcctgaacgctaaaaatgccacaatagtggctgtttatacagtgtttcaggtttcccgatgggcttatccgccgcgctaaaaacgcagattgccgcctggtacaaggcgctacaacaacagatcccggattttattccccgcgcaccgcaacggcagatgattgccgatgtggcgaaaaccctcgccggtgaagaggggcggcatctggcgatcgaagcgcccaccggcgtcggtaaaaccctctcctatttgatccccggcatcgctatcgcccgcgaggagcaaaaaacgctggtggtcagcaccgctaacgtggcgttgcaggaccagatcttcagtaaagacctgccgttgctgaagaaaatcatccccgatctgcgctttactgccgccttcgggcgcgggcgctatgtctgtccgcgtaatcttgcggcccttgccagcagcgacgccatgcaacaggatctgctggcctttatggacgacgagctgacgccgggcagcaaagaagagcagcagcgctgtgcaaagcttaaagccgatctcgacagctacaaatgggacggcctgcgcgatcacaccgatcagaacattgaagacgcgctctgggcgcggctctcaaccgataaagccagctgtctgaaccgtaactgccactactacaaggaatgcccgttcttcgtcgcgcgccgggaagtgcaggaagcggaagttgtggtggcaaaccacgcgctggtgatggcggcgatggaatctgaagccgtgctgccggagccgaaaaacctgctgctggtactggatgaaggccatcatctgccggatgtggcgcgggatgcgctggagatgagcgcggagatcagcgcgccctggtaccgcctgcagctggatctgttcaccaaactggtgtccacctgcatggagcagttccgcccgaaaaccacgccgccgctggcgacgccggagcggctgaatgcccactgcgaggagctgtatgaactgatcgcctcgctgaacaatattctgaatctgtacatgcccgcaggccaggcggctgagcatcgttttgcgatgggcgagctgccggatgaaatcatggagatctgccagcggctggcaaagctcaccgacatgctgcgcgggctggcagatctcttcttaagcgatctgagcgagaagaccggccagcacgacatcgtgcgtctgcaccgggtgatcctgcaaatgaaccgcgccctcggcatgtttgaaggccagagcaagctgtggcggctggcgtctatggcgcaggcgtccggcgcgccggtatcgaaatgggcgacgcgcgagctgcgcgacggccagctgcatctgttcttccactgtgtcggcattcgcgtcagcgatcagctggaaaagctgctgtggcgcagcgtgccgcacattatcgtcacctccgccacgctgcgctcgctgaacagcttcacccggcttcaggagatgagcggcctgaaagagaaagcgggggaccgttttgtggcgctggattcgccctttaatcatgtcgagcagggaaaaatcgttatcccgcagatgaagtacgaaccgctgatggagcatgaagagcggcacatcgcggagatggcgacctattttcgggaacagctggagagcaaagtccataaaggcatgctggtgctgtttgccagcggacgcgccatgcagctgtttctgacttttgtcaccgacctgcggctgttgctgctggtgcagggggatcagccacgttaccggctggtggagctgcaccgtaaacgcatcgacggcggcgagcgcagcgtgctggtcggcctgcaatcctttgccgaagggctggatctgaaaggcgattacctgacgcaggtgcatatccataaaatcgccttcccgcctatcgacagcccggtggtgatcaccgaaggcgaatggctgaaaagcctcaaccgctacccttttgaagtacagagtctgccgagcgcttcctttaacctgatccagcaggtggggcgactgatcagaagccatagctgtcacggcgaagtggtgatctacgataaacgtctgctcaccaaaagctatggcaagcgtctgcttaacgcgctaccggtatttcctatttcacaaccggccgtcccggacgttatagtgaaaagtaaaccaaaagcagaagcaaaacagagccgtcgccgacgacgctaatccgggcacaggaaggagatttcatggactatcgcaagatcatcaaagaggtcgggcgcggcaaaaatcacgcccgcgatctggattttgataccgcacgcgcgctgtacacgcacatgctgaacggcgaggtgccggagctggaaatgggcggcattctgatcgcgctgcgcatcaaaggcgagggcgaagcggaaatgctcggcttctatgacgccatgcagcagcagaccatgcgcctgacgccgccagtggcaaagccgatgccgattgttattccgagctataacggcgcgcgtaaacaggccaacctgacgccattgctggcgatcctgctgcataagctcggttttccggtggtggtgcacggcgtcagcgaagatcccacccgtgtggtgacggaaacgattttcgcgctgctcggtattgaggccacgcatctggcaggtcaggcgcaggcgaagctggacggtcatcagccagtttatattcccgtcagcgccctctgtccgccgctggaaaaccagctggcgatgcgctggcgaatgggggtgcgtaacagcgcccacacgctggcgaagctggcgacgccgttccccgaagacgccgccctgcgcctctccagcgtttcccatccggagtatgtgccacgcgtggcgaaattcttcagtgatattggtggacgcggcctgctgatgcacggcactgaaggtgaagtgtatgccaacccgcagcgctgtccgcagatgacattaatagacagccagggcgcgcgcgtcatccttgagcgccagtctgaagagcaaaccggcgtctcgctgccagacgccaaagatccacacaccaccgcgcgctggatcgagcgctgcattgtaggcagcgaagcggtgccgcaatcactgaaaatgcaaatggcctgctgcctgtatgccgcaggtcaggccgattccattgaggcggggctgacgcaggtcaacgcccgtttttaaggcaaaaaaaagcccgtccagggccggacgggcaacaagggtaataacactctggtattgcaaaatacaacatatgatgagggtaaaacgcaccggcgggcgggtagcccgcaggtgtaaagcattcagtcgattatttatagataaccgcggtgccgctcattttgttactggtgttagcggaagtaatgctgtaaccggtcgcgccagcttcagccgctttctgtgccagctgtgcttccagaccgtccagcgtggtcgcgccgtcggctgccacgacgccgattttgctcatattctgcgcctgttcagcagtcactgcctgggcggcaaacgcgccgaatgacagggtggaaagggcgatggcggcaacagcatatttaatggttttcattggtaatctctcgcagataattctgttaaggggacgatgttccgtcgatgtgataagtatcacagtattttgcgaaagataaaatcgaagagaattgacgaccttgttctaaaaaattgaacgatcgttaattaattgattagcaatatatttttcagatgaatgggtataaagccgggcaggacgacgcgacagcggcgttagcggcacgatttgctactttctgagcgattttttatggtctcccccgcaaccgcttgcgctgtcatattacgtcaggaaaggtcaacgtaactggctgtccttggaacctctgcgattatatcctgagttagcctgattttttaaatctttcttctgctggcaatttacgcacagacgcacgccggggatcgccttacgacgcgcgtccggaataggttcgccgcactcttcgcactccttcaggctttcgcccttcggcagatcgcgccgtgcacgtgccacggcgtcttcaacagtgctgtcgatttgatcctgcactgcgccatcatttgcccaaccggatgccatcgccttctccttctctctgtacataccttaagtttagaccatgtacagacaagccaggacgacaggcttagcgggcgtcggggcgaaccaggtcgaagcgctgggattcgtcgatggtgtagtaagccgacgggccgcccgcacgcagtaccggacgggctttagccgtctgataaatcccgttttccagcagggattcatcaatatgaataccaaccacttcgcccagcaccagccagctgtcaatcggcgtaccgtcggcggcggtcagttgaatacactgggacaggcggcattcgaaattgaccgggctttcggcgacgcgcggcacgctcactacctggcttgccaccggcgtcagaccggcacgcacaaattcgtcctcgtcgtggggcagggacgcggagctttcattcatccgcaccgccagatcataagttgtcaggttccagacgaactctttagtttcagtgatgtttcgtacgctgtctttccagccggtgctggagaagccaatgatcggcgggcgatagttaaagcagttaaaaaaactgtagggcgcgagattacgctgcccctggctattctgcgacgcgatccagccgatgggacgcgggccgataatggcattcagtggatcgtgcggcaggccgtgccccagtgctggctgataaaaatacatagttcacccgtttttacgattaaatcagaatagcgagcgtcacttatttaccgcgccgccgtcaacgggtatcttacgccgctgttgaaaggagaatgccatgactgcccagaagccgggattacacccgcgaaaccgccatcacagccgctacgatcttgatgccctttgtcaggactgcccggagctgcgtggctatattattgccacgccaacgggtgaggcgacggtgaactttgccgatcccctcgccgtgaaagccctgaataaagcgctgctggcgcatttctatggcgtcgcccactgggatattccgcaagggtttctctgtccgccggtgccgggccgcgcggattatattcatcatctggcggatctgctggcggaaagcgccgacggcgctgtgccgcgtcaggcgagcgtgctggacgtgggcgtgggcgcgaactgcatctatccgctgatcggctatcacgaatacggctggcgctttaccggcacggaagtcaacaacgaggcctttgccagcgcccaggcgattattaacggcaatccggggctgacccgcgctgtgcgtctgcgtcgccagaaagatcctgcgtctatcctcaacgggatcatccacaaaaacgaacagtatgacgctacgctctgtaacccgcccttccacgactcggccgccgccgcccgcgccggcaacgagcgcaagcgccgtaaccttggtcagagcagcgaggcgctgaactttggcggtcagcagcaggagctgtggtgcgaaggcggggaagtggcctttatcacgcagatgatcgccgaaagccaggcctttggtcgtcaggtgctgtggttcagctcgctggtgtcacgcggggaaaacctgccgccgctgtaccgcgcgctgaccgaagccggggcggtgaaagtggtgaaaaaagagatggcccaggggcaaaagcagagtcgctttatcgcctggacctttatggatgacgcccagcgtcgccgctgggcaaatacccgctttaaagcgtaggggcagcgggcggcggcagttcctgcggcgcggcagatggcggcgtggcaggctgcgccagcacctgataagtctgcaccggcgggcgtacccctgccagatcgaagtatttcttcaccatgctgtcgagcgcaaagcgcaccgtccactgcttgagcggctgcgtggtgaaggtcacgcgcagggtaaaggcggtgttggtcaggccgacgatgccgacaaaagtcggttcgccgatgatcagcccgcgaatatcctcccgcgccatcagttcccccaccgcatccttgagcgcctgattcgcgttatccgcatcttcatggcgatcgacatcgtagttagccacaatcgagccaatgccgcgcacaaagttggcgaaggtggtgatagatgaccaggggatgatgtggtacgcgccggtatcctggcgcacccccaccgaacggatcgacatgcgctccaccgtgccggttagtggcccgatggtcaccagatcgccggtgttcatcccgttttcaaactgaataaacaccccggtaataatatctttcaccagcgtctgcgaaccaaaagagatcgccagacccagcgccccggcacccgccagcagcggcgcgatgttcacgccaatctccgacagcacaatcatcaccgtgatggtgctgatcaccaccgccagcgcattacggaacagcgtcagcagggtacgggtacgggcgctcggcagcgggcggccgtgaatatcggaagacaggcggttttcgataagactggccagcaccgtccagccgacggcggagaagaacaggatcagcgcgatgcggatcagaatatccacggttttctcgcctgcgccgttatgcagccagttccagaaatcaaacagaccccaggcattgagcagcagcatgatcgccacgcagaccaccagaatacgcgccactttcagcgaggcggagatccagccattaacgcgcttttgcagctccggatagttacgttgcacatggggcgacagggtgatggtcttggtgagccagcgcgacaaaattcccgaagcaaaggcggcgacgctgatgatagccagactgtgcagcgacgcgctcatcataaacttcaggctgttgccgggatcgaacagcgagaagaagaacagcaccacgaagtaagcgctggccagccagtgccacaccagcgcaaaggcgcggataaagaggctgaaaaacgacagcgagcgctccgccagatggatgagattttgctggacggtgatcctgttatgaaagatcaaatacagcgcccagctggtgatgcagagcatgataatgacgttcgccaccgcgcccacctgcacattcacctgattggaaatgatgggcaccgccaccagcaggccatagccgatcaggctgcttaaggcgctcaggcgcagatgccagtattttgccgcctcatcctttaccgggaacgggcgcagatcgggaaagcgcgggcagaaaatcagccgcagtatggctttgaaaaactcaatcagcgcgaaagcgttcaggaacagcccctgctggaaggcgatagtgcggttgccgccgttgaggttatcgctcaacagctggccgacaaacagcgtcagggccagcagcatgatgtcgataataaacgcgcctatgatcatcgccggtagctgcaaccagttggcgtgctcgcggtttttacgccgcgcccaggtgcccattttgcggtacagcggcgagacgctaaaacgcaccacccagaagaagacgaacacgctcaccgccagcatcagaaaatgcgaggcggcgttgtaaaaggtctggggattaaacgctttatgcggcgaaccggtaatgttgcggtacaactgcgcgaaacgggaggccagttcatcgccgtaatggcgggtgacggcggtgacgttctccagcacggtagtttcttcgaccactaccggcggcgtgatagtcggcgcttgccctgtggctggcgcggcggccgcattacgtaactgaccgatcaactcctcccgcgaggcgctgttttccagcacatccgccagcgcgccataggcggcttttttttgctcggcatctggctcagcgggggtggtttcggccggggtggcagtagcgcctgacgtgacgccaggaattgtcgccgcgtgcagcggcatgaagaacaggctaagcagcaacaagatccacttcacggactcctcctgagaaaagcacaacaaaaggataagtatagaggattgcagggcggcgacgggaaatgggagaaatccaggcggggtggaaaacagccctctccggaagagagggccgggcagttacgacacgtgctgtaagaattcctgcagacgcgggcttggcggattttcaatcagcgcctgcggattgccgtcttcggcaatgcggcctttatcaatgaagatcaggcgtgaggccactttttcagcaaagccgatttcatgggtcacgatcaccatcgtcatgccttcttccgccagatcctgcatcaccttcagcacttcatggcgcagctccggatccagcgctgaggttggctcatcaaacagcatcattttcggcttcaccgccagggcgcgggcgatagcaacacgctgctgctgcccaccggacagctccgacgggtagtgatgcgcacgttcagcaaggccgactttcgccagcagcgctttggcctgcacttcggcgtcttttttgttcgcgccacgcacgcgcagcgggccaaacatcacgttttccagcgcggtcaggtgcgggaacagataaaactgctggaacaccataccggcttcctgacggatcagccgctcatccaccttcggatcgttcactttcagaccgtcaacaatcagatcgccgctggtgatctcttccagcttgttaatgcagcgtaagagcgtcgatttaccggagccggacggcccgataatcaccaccacttcaccctgtttgatgttcaaatcgatattgtgcagcacctgggtcgggccaaagtgcttggaaacatttttaaattcaatcacaggattttcatccttctttcaagacgacgcagaataaagctcagcaccagggtgatgatcagatagaagaccgcaacggcgctccagatttccagcgcgcggaagttgccggcgatgatctcctggccctgacgtgtcagttcggcgacgccgataacaataaacagggaggtatctttaatgctgatgatccactggttgcccagcggcggcagcatacggcgcagcgccagcggcaggatcacgtggcgaatggtttcgcggcgcgacagccccagcgccagacccgcttcacggaagcctttatggatagacagcacggcgccgcgggtgatctcggcaatgtatgcgccggagttgatcataatggtcacgacggcggcgctgaacggatcgatacgcaggtcgttaaacgccatgggcagcgcaaaatagatgaacatcacctgtacgacgataggcgtgccgcggatcacttcgataaagaccagcgcgatgtggttagccagccagccgccgaaactgcgggcgaaaccggcggcaagaccgataagcaggccgccagcgagaccgaggaccgagatccacagcgtcattttggcgccttctaagagaagcggaatggcaggccagatggcactccagtcaaactgcatgatgaattcctgtaaaccgtggtttaaaaacagcaggggcgaatggtcgcccctgaactaacttgttaaaacttatgattattatttaggctcggtgccgaaccattttttgtagatttcgttgtaggtgccgttctctttcagggttttcagcgcgccgttaactttgttacgcagatcgtcgctgcctttcgggaacgcgataccgtactgctgcgcttccagagaatcgcctaccgctttgaacttaccgttaccggcggttttgatgaagtagagaatgttcggcgtgtcatgcagcaccgcgtcggcacggttggtgcccagttccatataggcattgtcgatgttcgggaactgacgcagatctttggttttgatgttcgcttttgcgtagtcaacagagccggtaccgcctttcacggcaacgactttaccgtccagatcttttacgctcttcacgtcgttgttgtcggctttcaccatcaccagcagaccgctcttgtagtagccatcagagaagtcgatcgcttttttacgttcttcagtaatggtgatacccgccagcgccacgtcgacgtttttggtttgcagagccgggataatgccgctgaaatccataggtttcagctggtaatccagcttcagctctttcgccacggcagcccacagatccacatcgaaaccaacgtatttatcgccttgtttgaattcgaacggaacgaaagcagtatctgttgccacaaccagtttatcggcggcgtgagacgaaaccgcaaatgccagggtcagagcagccagggaaacttttaatacagacttcatagcatttccttttatatccacggggcgatcccctgagagaacctgtgcagtatgaaaaaatcgtgccaggtttacaacctgttgttttgtaaagacgtgtcatcgccagggtgcactaaaagcagcgcaacggcaacggaatgcaccatgatggggcgctattttagtgcagttacgccgggcaccgggagacgtctatttttaacgcaggaaatgggcaggaaacaatcttttattaacgattgtgtgaagtgattattacatctttttcacgattgacggcaggagtggaagaaaggatgcaccataaatgtgcaaaaccccccgccggggcgaggggtcatagcaaatcacaatacttattcgatattggattcaatgaaccacagatactgatccaggtcgcgtgatgcggcggtcagaatgtcagcggtgtcttcatcctgcgcttcgctgatggctttacgcacatcgtttgccactaccgcgtagcggtcggccagctctttcaggtgttcctgaacggaatgaatgtccagcgggtagcttttcagcggggttttgctgttgataacctgagtggtacccagcgcaacaccgcccagctgtacagcacgttctgccatggtatccagatgatccaccaggcctgtacggaagccatccagcatttcgtgaacagcgataaagtttgcgccgcgcatgttccagtgcgcctgcttggtgatcagagacaggtcaatgaactgggccacctgacgattcagcaactcgatagtcgctttcttatcgttatcagagacatcattgcgggtataaagcagatcggaagctttcgtttttaccagtttagcggtactcataatctcatatcctcttgatgtttatgtcccgggtaattactggaactaagtatagcagcggatcctggctttgcttttcgtctctgcctatcggtttaatagcgacaacgataggaaaaattaaatcctattaaatttcagtgttttgatggtttttttaggaatgattcttaattctgaccgggacggaagagtgtgaataaatattactgaaaataaagcgaaacagcgcaggaattattccgggcgcttcgcctggcgcccggaaatataatttaactgatatccactttctcaattttcgcttcacggcgcagcgtcagggtcgatcccatggacgccgtaatgatagcgagcagcgccagccactgggtcagcgtcagggtttccccgaggaaaaccatgcccgacagcgccgccagtccgggttccatactcatcagcgtaccgaaggtgcgggtcggcagacgggttagcgccaccatctccagcgagtagggcagcgccgtggagaggatcgccacgcccagccccagcggtaagaccgaccagtgccacagagcatcgcccgcctgccagacaccgaccggcacaaacaccagcgcggcgatcagcgaaccaatggccaccgttgccggaccgtgttcttccccggcacgctggccgcttagtatatagatagcccagcaggctcccgcgccaagggccagcgccgcaccggtcagatcaacatgtgagacatcctggccgaggggcagcagaaaccacagtccgagcaccgccagcgccacccagataaaatccaccgcgcgccgggacgcgaagagcgccaccgccagcggtccggtgaactccagcgccaccgcgatgcccagcggcaccgtctggatagataagtaaaagagatagttcatcgccccgagggataatccataaagcagcagcggcttgcgctgcgctttagtaaaacgtaagcgccacggcttgaagataaccacaaggatcagggtgccgagggccagacgcagggcggtgacgccgggcgcgccaattaacggaaaaagcgatttcgccagcgaagccccgctctgtatagagagcatggcaatgaggatcaccagtacgggcatccataccggcgttttacgggacaatccaggcatcctttctcctgtcaatttatgtcaaacgaagtaaaagaaggcagtgtaatggaaatacctgcccacggttgaaccttcgttgaaaaaaagtcgccgtaaatccgtacaataggccatagttgatggattaatcgccgtttgattaggattaatctggatgaatatgttgcgtttctcgcgtaaaaatagcgtcctgtgtgggaaaaccgctgcattttgaaagagatagtcagtgctggaaacgttctgttacaggaaaagagcccttagacaacgtaaacctccaggagtttcctgactatttttgatatatttaaaacttaggatttacttgaagcacatttgaggtggttatgaaaaaaattgcatgtctttcagcgctggccgcgattctggccgttaccgcaggttccgcagtagctgcatccaccgtttctggcggttacgctcagagcgatgcgcagggcgtagcgaacaaaacaaacggtttcaacctgaaataccgttacgaaaatgatactccgctgggctacatcggttccttcacttacaccgaaaaagatcgtaccgaagacggcgcttataacaaagcacagtactacggcgtgaccggtggtcctgctttccgtatcaacgactgggccagcatctatggcgtagtgggtgttggttacggtaaattccagcagcgcgaagatggcttcaaaaccgctgacaccagcgattatggcttctcttacggtgcaggtatgcagttcaacccgatggaaaacgttgctctggacgtgtcctacgagcagagccgtatccgtagcgttgacgttggcacctggatcgcaggcgttggctaccgcttctaatcacttctgtgatgataaaaaatccgcccacgggcggatttttttttgctctatggaaacgaatggctacggtcacagcgtttaccgcgttttggtctcaaaaatatccgtgcccagatgggtgtaatccactttctgcagtttgaaattcgtcacccaggtagtgccgcttttttgcgaggacataaaacggtatttattggtgatctcttttgcgctgatgccggtccactgtgagaaaaagttcaggaaatcattggccgagcgacgggctttgatcacgcgatgggtcttgtcatcgctggaaagcaccataaagggcacctggaagttctgctggaaggtgtcgccatgggccagatactgcacatctttgccgcgctctttaatggcaaggccatgatccgagaaatagaccatcgagaaactgtcccccgcgccctgcaactgcgcatagagtttgccgagcaattcatcggtctgggtgatggaatagaggtagcaggaggtctctttcgactgcacaaacaccttatatttaccttcggtgcgatcgcaggcctgagggtgagaacccatcaggtgcaggacgatcagctgcggctggctgcgcggcgtggacaacacctgggccgtcattttcagcagcgcctcatccttgacgtttttatccgcttcgaaatcgccgttcttcaggaactgcacttcatcggcgcgtttcgcgatgctggcgatggcggtatcgtattcgccaatttgtccctgattggagaaccaccaggtctggaatccggcgcggttcgccagggtgacgaagttatcctggtattgcggtttatcgtccaccacgcggttcagggtcaggccgagggatttttgcgtcgagccgctggcggccacgtagtcggtaaagaaggtgccgttaacctggctggcgaagggcgtgttattccagtagccaccaaaggcgcccatcgcgtcgcgtcgcacgctttcgccgatcaccaccacataggtatgatatttcggcttcacgcccagcactgtccaggtatctttcatgccggacagctccgccatgcgggtctgttcttcccgcacttcgcggttattcaccaccacatctttcacgaagcgcactaccggataaccggtgtctttcagatggaagccccagccgtagtagaggttgcttaccggctgcacgaacactaccgcgagacagaaggcgacccccagatgatcccatttaccccaggccggacgttccgccgctttgcggcgcacggcgatcacgccaaggccaaaaataaacaggcctatcacgtagttgtaccacgggaaaattgtcaggatctccgtggactcttccatattggtggagtgcagcgccagcagggtattaaagtttggcgcgccataagcctggccgaatggatagtaggacgccgccaccagggtacaaaggccgatcagcactttctgtacccgcggggcgtgacgccatagtagctgtaacaccagtgcaaaggccacggcatacagcaggctgaaaggatagccaagggcgtagttaataagtaaagactgcaaaaaataaaaacctgtccacgggctgatgttcagcccgcgcgcagcgagggtttcttttatgattaaattcatatgacactatcgcgaaaacgccatgtgctcaccctggcgtcgagggtcaaaacctgcgggacaatgcgtgaagaatgaggagggggccgtcatccgcaagccgcatttgtgcagggctgcgagaagatagagcgagccgccatgaaggtcaacaggcgtcagggctatgttttgcgataatggttacaaaaccgacaaataataagaaaattctatagaaacgatcagtatgacggggagatgtgacagaaaaatgaagcggcgtaccgcgacgccgcgttagcgtgaaggtttatcgtccggctgcggtttgctgtggaacatgtcacacaacagattaaccagcagtaaacgcactttaaaaggggagtgactgaacacggccatacatctcctgaattcgttcattagttacctcctgtccagataaaaaccattccgtccgtgaagggtgactgcattacatacagatatagcataggctatattttatagctatggctaatgcgttaattttttgtactcctcaggcgatggtttacaatggccgctcgcttagaggatgcggtattcgcgtcacgtcaatgaggaagcactatgagtcgtcgcgcaggtacgccaacaataaaaaaagtgacgcaactggttaatgttgaagaacatgtcgaaggatttcgccaggttcgcgaggcgcatcgccgcgagttaatcgatgattatgttgagttgatttccgatctgatccgcgaagtgggcgaagcgcgtcaggtggacatggcggcgcggctgggcgtttcgcagccgacggtagccaaaatgttaaaacgacttgccagcgtaggattgatcgaacagatcccctggcgcggcgtgttcctgacgccggaaggggagaccctggcgcagcaaagccgtgagcgtcatcagattgtagaaagtttcctgctggtgctcggcgtcagcccggataccgcccgccgtgatgcggaagggatggaacatcacgtcagtgaagaaactcttgagcgtttccgtctgtttaccctgcaacaggggcagaacgcagaatgacgctgcctttcgtgcgtgcgctggcccgcgaccgattctttcatctgttactgctggtgggcgtgctcctcagctttttcgtcccctttgccccggcgggctggggtaaagccatcgactggcacaccattattaccctcagcgggctgatgctgctgaccaaaggcgtcgagctgtcgggctatttcgatgtggtgggacgccgcatggtgcgccgcttcgccaccgaacgccgtctggcgatctttatggtgctggcggcggcgctgctgtcgacctttctgaccaacgatgtggcgctgttcattgtggtgccgctgaccatcacgctgaaaaaactttgtgagatcccggtcaaccggctgatcatcttcgaagcgctggcggtaaatgccggctcgctgcttacgcccatcggcaacccgcaaaatatcctgctatggggacgctccggcctgtcgtttgccgccttctgcgcgcagatggcgccgctggcgctggcgatgatgctgacattactggcgctgtgctggtttgccttcccgaaaaaagccctcaattaccatagcggcagccagagcgccgactggcagccgcggctggtgtggagctgtctggcgctctatatcgtgtttcttatttcactggagctgaaacaggagctgtgggggctggcggccatcgctgtcggttttctgatcctcgcacgccgcgtggtgctgagcgtcgactggacgctgctgctggtgtttatggcgatgtttatcgacgtgcacctgctgatccagctgccggtattgcagggggcgctgaacgacgtcggcaacttatccgcgcccggcctgtggctcaccgccattggcctgtcgcagtttatcagcaacgttccggccaccattttactgcttaactatgtaccgccggataagctgctcgcctgggcggttaacgtcggcggtttcgggctgctgcccggctcgctggcgaatctcatcgcgctgcgcatggcgcaggatcgccgtatctggtggcgttttcacctctggtcgctaccgctgctcgtctgggcggcgctggtcggctacggtctttttattctcagttagtgctcaattgtcagtttttcctggcaaatgtatagcaacctcctaactttagttaacggcgcacctgccgcgccgttaactgacaggaacgttgtaacgctatggctgagaacatgaacgcgtctgacgagacgcaaaaagacgacaataaaaccgacaataataacgaaaaagccgaacgcaaacgccccggcaaaaagccgattattattcttggcatcgtggtgatcgtcatggtggtcggcgcgctggtgtggtggctgctgacccgcaatgaagaaaccaccgacgacgccttcaccgatggcgatgtggtgactattgcgcccaaggtcgcgggctacgtgaccgagctgcgtgtgaaagataaccagcgggtgaagaagggcgatctgctggtgaccatcgatccgcgcgatacccgcgcccagcgcgatcaggcgcaggcccagctgggtctggcgacggcgcaactgcatcaggcgcaggcgcagctggcgctctcgaaagtgcagtatcccgcccagcgggatgaagcgcgcgcccaggtgctgaaagcgcaggcagatctggccaatgccgaggccgcgtaccgccgtcagcgcggcgtcgatccccgcgccaccacgcaacaaaatattgataccgccaacgcgcaactgcgcagcgcgcaggcccagctggccagcgctaaggcgcaggcggaagtggccgagcaggtgcagctgcaaattcgccagcaggaaactaacgtcgaagcgcgccagcgtcaggtcgatcaggcgcgggcgcagctggaaaacgccgagctgaatctctcctataccgaagtgcgcgcgcctttcgacggttacgtcaccaaacgtaacgtgcagactggcaccctggtgcaggcgggcagcgcgttgttctcgctggtgtcgccggacatctgggtggtcgctaactttaaagagtcgcagctggagcgtatgcgccccggcaataaagtcaccatcagcatcgacgcctggccggatatggagctggaagggcatatcgacagtattcagcagggcagcggatcgcgtttctccgcgttcccggcagaaaacgccaccggtaactttgtgaagatcgtccagcgcgtgccggtgaaaatcgtcatcgacaaagggctggatcccaacaagccgatgccgctgggtctgtccgttgagccgaaggttacgctggaatgaccgatcacaaccatgaaagctggaaacccgccagcaatccgtgggcggtggcgattgtcgtcaccctggcggtttttatggagatcctcgacaccactatcgttaacgtggcgctgccgcacgtcgccggatcgctctcctccagctacagcgaatcgacctgggtgctgaccagttatctggtggcgaacggtattgtgctgcccatctcagcgtttttaagccgggtttttggccgtaaacgcttcttcctgatctgcatcgtgatgtttaccgtctgctcgtttttgtgcggtatcgccactgaactgtgggaaatcatcctgttccgtatcttgcagggcttctttggcggcggtttgcagccgacgcagcagtcggtgctgctggattactttaagccggaagatcgcggcaaggcgttcggcctgtcatccatcgccattatcgtcgcgcctgtgcttggcccgacgctcggcggctggatcaccgacaactactcctggcgctgggtattctttatcaatatcccggtgggcatcatcacggtgctggcgatctatcagctgctggaagatccgccgtgggagcgtaaatcggaagaaaaactctccatcgactggacgggcattggcctgatcgcgctgggtctgggctgtttacaggtgatgctggatcgcggcgaagatgacgactggtttgcttccggctttatccgcacctttgcggtgctgacgctggtgggcattatcggcgctatctactggctgatttatgccaaaaaaccggtggtcaacctgcagtgtatgaaggataaaaactttgcggtgtcgagcctgctgatggcgggtatggcgatgatcctctacggcagctcggtggtgatcccgcagctggcgcagcaggatctgggctataccgccacatggtccgggctggtgctgtcgccgggggcgatactgatcgtgctgaccattccgctggtgctgaagctgatgccggtggtgcagacgcgctggatcatcgcctttggctttgcctgcctcgcgctgtcgtttttctggtcgcgcaccctgacgccggacatcgattttgaaaccctggtgctgttccgcagcgcccagtcgattggtcttggcttcctgtttgtgccgctgaccaccatcgcctttatcaccataccccggcagctgaacgccgacgccgcggcgctgttcaccatgttccgtaacgtcgcggggtcgatgggcatttcgctctccaccgccgccattaccgaacgatcccaggtgcacagcgcctatctcagcgaacatgcctcgccttttgacgagcagttccagcaggcgatccgcagctcagcagaggcgatacgcaatttcacctcgcaggtgggcgatcccaccgccattgccagcgggcagatgtaccagaccttaatcgagcagtcgcgctttctcgcctacgtggatgtcttcacattgctcagtctggtggccgttctgttgatcccattttgtttactgctttcgccggtgaaaagcgaaggcagcgcaggagcacattaagatgcacaggaaaactcatcccactttcaccctgctggcgctgttgctggcaggctgcgccgtcgggccggattatcagcagcccgccgccccggcggtcagccactggaacgatcagggcgaccgcaacgtgaagtcgcagacggcgtcccaggcggtcaatccccgctggtggacgaccttcaactccccgcagctcaacagcctgatcgagcgggcgatcgccgataacctgtcgttgcagcagaccgtgctgcgtatcgccggggcgcgggagcagatcaaccaggcgggcggggcattgctgcccgcggtaaacggcagtctgaaggccacccgtcagcagctcgggctggaaggggagctgaaatcccatgacgtttatggccagctgaatgacgtcgatcccgaattgcagggggcgcttggcaccctgacgcagccggtgaacctctatcagggcagctttgatgcccagtgggagatcgatctgtggggcaaagtgcgccgccaggtggaagcggcgcaggcgcagcagcaggcggccattgaacagcgcaacgacgcgctggtgtcgctggaagcggaagtcgcccgcgcctggctgcaactgcgcggcgcgcagagcattatcgccaccatgaacacgcagatcgccaccgcccaggaaaccttcacgctgacggaaaaccgtcagcgcgggggcctctcgccgcagctggatgtggaaaacgcccgcgcccagcttggcaaccttgaagcgcaactgccgcaatatcaggcgcaggagcggcaggcgatgaacgcgctggcgatcctgctcggcaagccgccgggcgcgctggacgcggaactgcgcaacccacagccgctgccgaaactgccggatctggtggcgaccggcattccgtccaccctggcgcggcgtcgtccggacgtgcgcgaagcggaagcgaatttacatgccgccaccgcgcagatcggcgtgtcggtggcgcagctgttccccagcctgtcgctgaccggccagtttggcctgcgcaacagcgaaaccaactggctcaccgactggagcagccatttctacagctttggcccgcaggtttcgatcccgattttccagggcggacggctggtttccagcgtcaaactggcgcgggcgcagcaaggggcggcggtgctcaactatcgccagacggtgctgagcgcgctcggggatgtggagaacgcgctggtcagttaccgcaccgatcagcagcgtgaagccggtctgagcaaaactatcaccgcgctgcaaaacgccttcgatctggcgagcgacagctaccggcaggggatcgccacctttatcgatgtgctggatgcccagcgccagttagcccaggcggaacagcagcgggcgcaggcgcgggtgcagaccagcctcgatctggtggcgctctataaagccctcggcggcggctgggagccataccagaacgtgcagatgcctgactacgccgtgtttggcgacgcgccgcgcggataactttcagaggattgggcaagaaacgcgcaggatcgccacattcgcataaccggcagggcgggtataactacagaacattcacggcagcatctttatgaggaaggttctatgcgataccagaaacttggcaataccggtctgtttgtgtcggaactgtgccttggcaccatgacctttggcggcgaagacgacatgtggggcaaaatcggcaagctcagtcagagcgacgcggatcgcctggtcggtagcgcgctggatgcggggatcaatttcattgataccgccgatgtgtactccgggggccgctcggaaatcatcaccgggcaggcgctgaaaaacctgaaggtgccgcgcgagaacgtcattgtcgccaccaaagtgttcggtgaaaccggcacggcaggagtgaactcgcgtggcagttcccgtcaccacattatcacaggcgtgaagcagagcttacagcgcctgcaactggatcatatcgatctctatcagctgcacggctttgatccggcgacgcccatcgaagagacgctgtacgcgctggataatctggtgcagcacggccatgtgcgttatatcggcgtctccaactgggcagcctggcagatcgccaaagcgctgggcatttccgaacgtttaggtcttacgcgctttgcctcgctgcaggcctattacaccctcgccggacgggaactggagcgcgagctggtgccgatgatgcagagtgaaggcgtcggcctgatggtctggagcccgctggcaggcggcctgttaagcggaaaatacagccgcgacgggcaggcggaagcgggcagccgtcgccaggaattcgacttcccgccggtgaataaagatcgcgcgtttgactgtgtggacgtgatgcgcaccattgccgacgcgaagggcgcgagcgtggcgcagatcgccctggcctggctgctgcatcagccggtggtcagcagcgtgatcatcggcgcgaagcgcgaagaacagttgctggataatatcgccgccaccggcattcgcctgagcgacgacgagctgcaacagctggatgcggtcagcgcgctgccgcgggaatatccgggctggatgctggaacgtcagggcgaataccgccgcaagcagctggctgcgcagtaatttattgcaattttgttacatccataacatatcatccataagagcattgccagcgccgtctgacccggcatcatgtcgcgaaagagaggggagtgatgctaatggtccgtgtcgtgctggtggatgatcatgttgtggtacggtcggggtttgcccagctccttggcctggaagaggacgtgtgcgtgaccgggcagttcagcacggctgctgaggcctggcccgcactgcttcagaatgatgttgacgtggcggtgctcgatgtcgccatgcccgatgaaaacggcctcagcctgctaaaacgcctgcggcaacagcggcctggctttcgcgccattattctcagcatttatgataccccggcctttgtgcagagcgcgctcgacgccggagccagcggctatctcaccaagcgctgcggcccggaagagctggtgcaggcggtgcgatccgtcggcatgggcggccactatctgtgcgccgatgccctgcgcgccctgcgcggcggcgaaccctccggtaaagtgctgaatattctcaccccccgcgagcgggaagtattcgatctgctggtcaagggcgacagcgtgaaagagatcgcctttaagctcgaactgagccacaaaaccgtgcatgttcaccgcgccaatgtgctgggcaaattacagtgcagcagcaccattgaactggtgcattttgccctcgaccaccagttgctgacggggcactgatgtcgtcagcgtcccggcgttttatggtgctgtcgctgtttatcgtcctggcctggggaccgggctggctgatgctgtggacgctgagtttttacctcacccataacggccagcaggcggtgctgtttctgccgcagggcgtgtttctggcgctgctgattttgctgtcgcgccgcttctggccggcgctgttactgccgttgctggcgatgattttctggctgcacagcgaacagttgctcactggttacaccatgctggccgcccccttaatcgcgctaccggtggcgcgtgtggcgcactattactggcaccgttttcccctctactggcatcgcctgacgctgctgctgacggcggtcaccgcctgcgccctgctgcaaaccctgctgctggccccctttctggaaagtaaggcgacgctaatcggtcttgccagcttcaccggcggcgtgctgctgacgccgttcgtctacctgatttttgaatttctgcgccagcagcatcgctatcatttgcttgggctggacaccagtaatccgccgctgcgcacctcgctgattatctggtgcagcctgttttttattatcggtattggcacgcagatggtgctgtcgccggaaatcgaacggctgctgctgatcgtggtgtttctgcctaacgtcatcatggcgtggaaattcggctggcagggcggggtgctggcggggctgcttggcagcatgatgatcaccatcgcccgtcaggtgggtatcggttttggcgatctgctggagctggagattttcctcgccacccaggcgctgctcggcatcgggcttgggatcgccatcagccgccagcaacatctggcgcaaaaccttgatcgctatcgccagcggctggaggtggagttacaggcgcgccgcgcgctggcggagaagctgatccacagcgaagaggacacccgtaaaagccttgccagggagctgcacgatgagatcggccagaacattaccgccattcagatccagtcgcagctggtaaaacgcagcgcgggcagcagccaggcgctggacgccgccagccagattaacgatctggcccggcgtattcacacctccacccgccagctgttgcgccagctgcgtccgccggtgctggatgaactctcctttcgcgaggcgctgcaccatctggtgaatgagttcgcctttgccgagcgcggcatcatctgccgctttgattaccggctcagcgcgccgccggaaaacgaaaccctgatttttaccctttaccgcctgttgcaggagctgctgaacaacgtctgcaagcatgcgcaggccagccgggtgagcattgtccttgagccgcgcgacgggcagatctggctgacggtcgcggataacggtatcggcctaccggccgggcagtcccctggcttcggcattcaggggatgcgcgagcgggtgcatgcgctggggggcgatctggtgctggagtccgctcagggaacacgcgtaactgttaacctgcccacacttttgccacaaaccccccgctaaccaggaaaaagtcttagtcagtgcggactttctctcatcccctttttcgttcgctttcatatagtcagtgccaccggaggccttatgcaggaactgtcagccactgccattagccagcgctaccgccgtctacgcccgcgtttattgctgtcgatggtggtgggttacgcggccttttacctgacgcgcaaaagcgtcaattacgtgctgcccgcgctgcaactggatctcagcttaagcaagagtgatatcggcctgctgggttcgctgttttatctcagctacggcctgtcgaagtttgccgccggcctctggcacgacagccacggcagccgggtatttatgggcatcgggctgtttgccaccgggctgttaaacgtgctctttgcgtttggcgattcgctgccgacgctgctgttcatctggacgctgaacggctttttccagggctggggctggccgccatgcgcgcgcctgctgacccactggtattcgcgcaacgagcgcggcttctggtggggctgctggaacacctccatcaatattggcggggcgattatcccgctgatttgcgcctttgccgcccactggtggggctggcaggccgcgatgctgacaccggggatcatcagcatggcgctcggcgtgtggttaaccatgcaactgcggggcacaccgcaggaagaggggttaccttccgtcggggagtggcggcaggatccgctggaattacgtcaggagcagcaaagcccgccgatggggctgtggcagatgttacgcaccaccatgctgcaaaacccgatgatctggttgctgggcgtctcttatgtgctggtgtacctcatccgcatcgcgctcaacgactgggggaatatctggctggcggagaatcacggcgtcaatctgctcagcgccaatgccactgtgatgctgtttgaagtgggcgggctgctgggggcgctgtttgccggatggggatcggatgtgatgttcagcgggcagcgcgcgccgatgattttgctgttcacgctcggcctgatggtctccgtcgccgcgctgtggctggcgccggtgcaccattacgcgctgctggcgatgtgcttttttaccgtgggcttttttgttttcggcccgcagatgttgattggtctggcggcggtggagtgcggtcacaaaggggcggcgggttccattaccggttttctcgggctgttcgcctatctgggagcggcgctggcgggctggccgctgtcacaggtgatcgaacgctacggctggtcggggatgttcaccctgctgtccgtcgcggcggtgctgatgggtttattgctgatgccgctattaatggcgggcattacggcttctaacacgcaaaggataaaaacatgaaagttaccctgctctctacactggttgccaccggtatcgcgcttgccacgttaagcggcggcgcacaggcgaaaggccgtctggtagtctattgcagcgccaccaatgaaatgtgtgaaaccgaaaccaaagccttcggcgacaagtatgatgtgaaaacctcgtttatccgcaacggctccggcagtacgctggcgaaagttgatgccgagaagaaaaacccgcaggcggacgtctggtacggcggcaccttagatccgcagtcgcaggccggtgaaatggggctgttgcagccgtataaatcgccaaaccttgagcagatcatgacgcagttccgcgatcccgccaaagtgaaaggcaacctgtcgtcggcggtgtatgtcggcattcttggcttcggggttaataccgagaagctgaaagagaaaaacctgccgatcccgaaatgctggaaagatctgaccaaaccggaatacaaaggcgagatccagattgccgatccgcaaagttccggcaccgcctacaccgcgctcgccaccttcgtacaactgtggggcgaagatcaggcgttcgattacctgaagcagcttaataccaatatctctcagtacaccaaatccgggatcgccccggcgcgtaacgccgcccgtggcgaaacggctatcggcatcggcttcctgcatgactattcgctggaaaaggagcagggcgcgccgctggagctgatctcgccgtgcgaaggcaccggctatgaaatcggcggcgtcagtattctgaaaggcgcgcgcaatgccgacaacgcgaagctgttcgttgactgggtgctgtcgaaagaggcgcaggagctggcgtggaagaagggcaagtcctatcagatcctgaccaacaccacggcggaaacttcgccgaactcgctcaagctcgacgatctgaagcttatcagctacgacatggacaaatacggctcaacggatgtgcgtaaggcgctgatcaataaatgggtcagcgatgtgaagatggggaaataaccccacgacggtcactgccgggtggcagcgttaacgccttacccggcctacaactttcccaacaccggaacacttatgtcacacactcttgcactccatcccgcgaaaaagcgggatgcggtcttcctttggctgtttttaggctggctggcgttcgcgctgctgccgagctggagcctggattatggcctgtttgaatccacggcggacgaaattcttgatgcgtacgcctggtcgcatcttaacgtcagcctgctgtggtacctgttccccagcctgttgctgctgcgcccgttcagcgcggccagccgcgatcaacgccgtcgccactggtttgacgccggctgggcgctggcctgtatggcgtttatcgttatcagcgcgacgctcgccgggcgtgggctgggctatgccaccatcgtgctgttcatctcccttggcgcgatcatgacgctggcgttgacccgccttgaatggctgagcggcgaccgctttgtgattggctcgctgatcgccattatcgcgctgatcggcatctttatcgtctggccgagtatcgccatctttattccgatgttcaccaccgacagcggggaattcgcgccgctggcctttatgacggtgctgtcgcaggcgcatatcgtgcaggtgatcgtcaactcgatcctgctgtcgatggcggtgggcgtgggctgtaccttcttcgggctggtgctggcgatctacaccacgcgcatcgcccggcgcagcgccattattggccgtattttctctattctgccgatcgttacgccgccctttgtggtcgggctgggggtgacgctgatgatgggccgctccggttatgtcaccgagctgatggtcgactggttcggcctgaccaacactaactggctgtacggttttaccggtatctggatcgcgcaggtgctggcctttacgccgatggcctttatgatcctcgatggcgccatcaaaaccattcatccgtcgctggaagaagcctcttataccctgcgcgccagccgctggcagacctttaacggcgtctttgtgccgctcttgaaaccggcgctggcgaacgcctttttagttgtcatcgtgcagtcgctggcagacttcagtaacccgctggtgctgggcggcaacttcgacgtgctggcgacgcagatctatttctatatcaccggctcgcagctggattatcaggccgccagtacgctgggcgcgttcctgctgctgttctcgctgctggtgttctgcatccagtatatgtggatcggtaaacgctcctacgtcaccgtctccgggaaatcctaccggggcgacgtgcagccgctgccggtgacgctggtgtggggcgtgatggcgctgctggcggtgtgggtggcgttcaatgcgctgctgtacggcagcattttctacggcagctttaccgtcaactggggcgtggattacaccctgacgctggataactttatcaagctgttcggtcaggggatgagcgatggcgcatggccgtcactgctcgatacgctgctgtacgccggtattgccgcacctattaccgctatttttggcctgctgatcgcctgggtggtggtgcgccagcagttccgcggcaaaaagactatcgagttcaccaccatgctgtgctttgccgtaccgggcaccgtggcgggcgtttcttatattctcgcctttaacagcgcaccggtttacctgaccggcaccgcggccattgtcattatctcgatggtgatgcgcaacgtgccggtgggtattcgcgccgggatcgcggggctggggcagatcgacaaatcgctggatgaagcttccctcagcctgcgcgccggatcactacgtaccattacgcacattctgctgccactgctgcgcccggcgatcctctcggcgctgatctacagctttgtgcgcgccattaccacggtgagcgccattgtgttcctcgtcaccccggacacccgtgtggctacggcctacatcttaaaccgtgttgaggacggcgagtacggcgtggccattgcctacggctcgatcctgattgtggtgatgctggcgatcatcttcctctttgactggctgatcggtgaggcgcgtatctcccgttcaaaagctaaaaaccaggcgtaaatttatgactcagaaacattttgttgagctgcgcaacgttggtaaaacctttggcagcaatgtggtgattgaaaatatcaatctggcgatcccgcagggggagatggtgacgctgctcggcccgtccggctgcggtaaaaccacggtgctgcggctggtggcggggctggaaaagccgacttccgggcagatttttatcgacggtgaagacgtgaccgacagttcgatccagcagcgtgatatttgtatggtgttccagtcctacgcgctgttcccgcacatgtcgctgggcgagaacgtcggctatggcctgaagatgctcggcgtgtcgcgcgcggagatcaaaacccgcgtcaaagaggcgctggcgatggtggatctggacgggtttgaagatcgctatgtggatcagatttccggcggtcagcagcagcgtgtggcgctggcgcgcgcgctgattttaaagcccaaagtgctgctgtttgatgagccgctcagtaacctcgacgccaacctgcggcgcagtatgcgcgataaaattcgcgagctgcaaaagcagtttaatatcacgtcgctctatgtcacccacgatcagagcgaagcctttgcggtatccgataccgtgctggtgatgaacaaaggccacatcatgcagatgggctcgccacaggatctctatcgtcagcctgcctcgcgctttatggccagctttatgggcgatgccaacctgttcccggcagcattctccgcagatcatgttgatatttacggttaccggctaccgcgcccggcgcagttcgccaccgtgggaagcgggcaggtgggcgtgcgtccggaggcgatcaccctcgggcagcacggcagcgaaagccagcgctgtgtgatccgtcatgtggcctatatgggaccgcagtatgaggtgattgttgcgtggcatgggcaggagattttgttgcaggtgaatgcgacgcgattgcagccggacgtgggggagaattatttcctggagatccatccgtatgggatgtttgagatgcgggaggcgggttaataagggtggcttttagtggaatgttccgttcaatggaatgttcggtttagtggaatgttccgttcactttgcgttccgtgtcaggcgtaacaccgctgacggtgaacgtgctaagggggccaccgcggcccccttagcaatccccgcggccccgcaaagaaaccggtgctgcgcactgcgctcacctcccgaccgtctgcccgcggtcggctctattcggcctcctgcctcatttcgcctctggccgccatccatggcgtccagcccttgtcatccggcctccggctcgccggtttcagcggggactcaacccctcgcgttaatatctctgttttttataaagcgactgagtggctttgtgtttgtctgaacttacaggaactgctgagttaatttatttagaaatcatgaagtgtggggggagcccgggggtgcagggggcggcggcgactggccgccccttgcgcgctctcgccatccggtgttccgttgttccgcaatattaataagagcgcaacctaccatcatcaataaaagcgcaacctgccgcatgcaagagatcattacgcgatctttacggcgctggtcacaaaaccagcaccctctctttgcctgccttatccgcatccgctatatgactagtcatataaattaaatgactttacataatcaccagcggagatcagatgatgactaaatccttaccggcgggttttttgtggggtaactcggtatccagtatgcagacggagggggcgtggaacgaaggaggaaaagggccgtcggtttacgatattcgcgaagccagcgaatttgcctccgactggaaagtggcaaccgactcctaccatcgttatgccgaagatttcgacctgatgcaggatctcggcatgaactgctaccgcttccagatcgcctggagccgcgtctgcccgcagggcgacggagagttcaacgacgagggcatcgccttttacgatcgttttatcaacgacctgctggcgcgcggcatcgagccgatgatctgcctgtatcacttcgatatgccgctggcgctggcgcagacgtacaatggttttaccgatcgccacgtcatggaggcgttcgttcgctacggcaaaaagatgatcgactgctttggcgaccgcgtgaagtactggctgaccttcaacgagcagaatatctaccatatgccggaggcctttaaggttggcggttatctcgaaggcgaaaaaacgctgcgcgagctgtaccagatttcgcatcacgtgatgatggcccacgtccgcctcacacactatctgcatgacaccaaaccggggcagctgatgggcggcatgctggcgcatcagctgatctatcccgccacctgtaagccgcaggatattttctgcgcccagcagtatgacgaattcctcaaccagaacctgctgcgcgtctttgccggtcagggctacagcccggcggtgatggcggtggtggagcgcgaaggcttcggggatattttcctcgacgaggatctggaagagatcgcccgggtgaaaaacgactatatggcgttcagctactacgccagtaaaacgctggacagcgatgccatccctgacgggacgccggtgaactattacctgttgcacggcgataaaaataacccgttcctgaaggccaccgaatggaactggcagatcgatccgctcggctttcgcaccattatcacccgttattataacgactggcggctgccggtattccccattgaaaacggcatcggcgtgatcgaatcctgggacggcgtaaaccccatcgacgaccagtaccgcatcgactatcaccgtgagcatttgcaggcgatgaaagacgccatttttgaggacggcgcgcaggtgattggctatctcggctgggggctgattgacattctcagttcgcagggggacatgcgtaagcgctacggcgtggtgtatgtgaaccgggaaaaccacgatctgaaagatctgaaacgggtaccgaaaaagagctacgcctggctaaaacgtgtgatccacagtaacggcgacgagatgtgatcccgcctgccggaccgttttgtgactgattgaagggaaggtatctgcgatgtctgatgcaaacatgaaaccgaatatgcagtcgtttgttgatcgatttgttgagttctccgcccgtatcgccaaccaggtgcatctgcgctcgctgcgcgatgcctttgcggcggtgatgcccattttcattcttgccgggctggcggtactggtgaataacgtggtgtttccctgggtgatggacggggagctgctcacgcgctttaaagtgtggggcgatgtcattatcaacggcacgctgaacattgcggcgctgttgatcgcgccgatgatcgcctggtcgctggcgcgcaacaaaaatttcgacaacccggtctcggcagtggtgatcgccttatccagctttatcattatgatgccgatccagctcgacgtggtgccggtgggcggcaagacgacggtaaccgtcggccagatgctgtcgttcgccaacattggcaccaccgggattttcgccggggtgatcatcggcctgctgtccaccgagctgtttatccgcattgccgggatcaaaaagctcgatatttccctgggcgaaaacgtgccgccggcggtgagtaaatccttttccgcgctgctgccgaccatttttacgctctccactttcgccatcatcgccgcgctgctggcgaacgtgctgcataccgatctgatccatctgatcaccacgctcatccagcagccgctgcgtctgatcaacaccagtctgccgggcacgctttttatctacagcttcggcaactttctctttacgctggggatccatcagtcggtggttaacgccgtggtgctggagccgttcctgctgatcaataccaacgaaaatatgatcgcctttgccaacgggcagccgatcccgcatatcatcaacaatatttttgtgccgacgttcggcatgattggcggcaccggcagcacgttgtcgctgcttatcgccatctttctgttctcgcgccagaaggcggcgaaacaggtggcgcgtctgtccatttcgccgggactgtttaacatcaacgagccggtgattttcggtctgccgattgtgtttaacattccgctgatgatcccctttgtgctcttgcctgctatcgggattttctttgcctggatctgcaccaccctcgggttgatgtcgcgctgcgtggtgatgatcccctggaccacgccgccggttttaagcgcctggctggcgacggcgggggactggcgggcggtggtcgttcagttgataatcatcgtctttggtgtattcttctacctgcctttcctcaagatagccgagcgagtggccttaaaaaacagtgggatagtcgaataataaaaggaacgggcaatgtcggcgaaatacgtttctatcgcgcgggaaattaagcagcgcatcatgagcggacagtattctgccagcgagccgctgcccgatcagttcgctctggcggcggagttcagcaccagccgcatgactatccagcaggcgatacgccagctgatcgtcgaagggctggtgtatacccgtcaggggcagggcacctttatccgcaagaatttccttcagctctcgcaatgggatctgcccggcagcgactatttcggcgcgaccaaaacctgggaaaacgtcggcaccgtcaccagcgagatcatccgcttcgatttacgctttgccgatgaaaaagagcaggcctcgctgctgatcgacgccgatgcgccggtctatgacttcgtgcgcctgcggctgcttgacggcgaaccggtctcgctggagtttacgctgatgccggtggcgctggtgcccggccttaaccgcggccatctgcaaagttcagtgtttcgctatgtgcaggacaccctggcgctgaaacttatgggttcgtaccgcgtggtgcgcgccctgaagccgaacgccgaggataaacgttacctgagctgcgacgacaccgatccggtgctggaagtggagcaggtggtttatctggaagatggcacgccgctggagtatgcccactgccattatcgctacgatcatggcggcattatcatggtcaatcacggataaaaaaaagcgatggtttcccatcgctttttttgtttactgccggggcaggatcagttcagacgaaccggcataccggagcggttttcaatcgcctgctcaacaacggcctggtcaacgtcagcctggctggtcacgctctgcacgcttttggtgagggtgatcggtacgatttcgccgccttcaaactgcgcttcggtggtggacagcggattgtgcacttccacataacggctgccatccggctcggtggtggctttcaccggctcatcgataaactgaacgcgggtgccgaccggcacgttctggaacaggaacttaatgtcttcgttacgcagacgcacgcagccgtggcttacgcgcaggccgataccaaagttggcgttggtgccgtgaatggcatacagacggccaatgtagagcgcgtacagacccatcgggttatccgggccagccggaactactgcgggcagcgggttgccggcggcaatatattccgcatgcattttggcggtcggcgtccaggtcgggccggcttttttacgctcaactttagtagtccagttgatcggcgtatctttgcctaactgaccgataccaatcggcagcacgatcaccgtgttggtgcctttcgggtagtagtagaggcgcatttcggcgctgttgatcacaatgccttcatgaacggtgtccggcaggatcagctgctgcgggatattcagtacgctaccgcctttcggcaggtaagtgtccacgcccgggttcgcttccagcaggttagacaggcccatctggtattgcgccgcaaagtactccagcggctgctggttcccttccggaatggtgatgacctggttctggccaaccagacggctgccgtcggttggcagtggataagttactgcagaggcagatttgcaaaaccctactaccgcgaaagccgccgctaaaatcgttgttaatttaattttcatgttgtgcgaggtatctttgccactggccatccggccgttgagttaaagtcttaatggagatgggagcgcattatatgtgcattcccccgcgcatggaattcagatgtgtacgaaatcacatttttttctgaaagctacagtgtagctgcttatcacggtgcgcgatttcaattcggaattgtggcataatgcacggtttgtcacacatttttaggataacgccgtgttagttaccagcaacgtcaccatgcagttcggcactaagccgctgtttgaaaacatttccgtcaaatttggcggcggcaaccgttacggcctgattggcgccaacggtagcggaaaatccacctttatgaagatcctcggcggcgatttagagccgacgctgggcaacgtctccctcgatcccaacgagcgcatcggtaagctgcgtcaggatcagttcgctttcgaagagtacagcgtgctcgacacggtgatcatggggcataccgagctgtgggaagtgaagcaggagcgtgaccgcatctacagcctgccggaaatgagcgaagaagacggctacaaagtggccgatctggaagtacagtatggcgaaatggacggctactctgccgaatcccgcgccggtgagctgctgctcggcgtgggcattccgctggaacagcactacggcctgatgagcgaagtcgcgccaggctggaaactgcgtgtgctgctggcccaggcgctgttcgccaaccctgacattctgctgctcgatgaaccgacgaacaacctcgacatcgacaccattcgctggctggagcaggtgctgaacgaacgtaacagcaccatgatcatcatctcgcacgaccgtcacttcctgaacatggtgtgtacgcacatggcggatctggattacggcgagctgcgcgtgtatgcaggcaactacgacgaatacatgaccgctgcgactcaggcgcgtgagcgtctgctggcggacaacgccaagaagaaggcccagatcgccgatttgcaggccttcgtcagccgctttagcgccaacgcctccaaatcccgtcaggcgacctcccgcgcccgtcagatcgacaaaatcaagctggacgaagtcaaagcctcaagccgtcagaacccgttcattcgctttgagcaggataaaaaactgttccgtaatgcgctggaagtggagcagctcagcaaaggcttcgataacggcccgctgttcaaaaacgtcaatctgctgctggaagtgggcgagaagctggcgatcctcggcaccaacggcgtgggtaaatccaccctgctgaaaaccctggtcggcgatttaacgccggacaccggcactgtgaagtggtcggaaaacgtgaaaattggctattacgcccaggatcacgaatacgagtttgaaaacggcatgaccgtcttcgactggatgagccagtggaaacaggaaggcgacgacgagcaggtggtgcgcggcattctgggccgtctgctgttcagtcaggacgacatcaagaaacaggtgaaagtcctctccggtggtgaaaaaggccgtatgctgtttggtaagctgatgatgcagcgcccgaatatcctggtgatggatgaacccaccaaccacctggatatggaatctatcgaatcgctgaacatggcgctggaaatgtaccagggcacgctgatcttcgtttcccatgaccgcgaattcgtcagctccctggcgacccgcgtgattgaaatcacccctgagcgtgtgatcgacttcagcggcaactatgaagattacctgcgcagcaaaggtatcgactgattttgcccctcactctgctccccgaactgatggggagcagtgcttcatatttatattataaataactcacttcttattattcgccccctgaatatatatttccctgaagccgtgaaataaaagaaaatctctttttctttaaatttgcgacagctcacaaatatgcatttaatttcgtcataacccgctttatcacggccccgctacgttgacaccccatttcaggaggagtaattttccgcgtcatgggaccgataccacggaaagtcaaatgaacggaaacattaacacactgcttcgggaagtttatgccgggcgtttcaccgactcacattatgaaaaattaacggcctgtattgagaaataccggccgcttattactcaaagccgtaaacagaaatgggatgaaagcgatgtggtgttaattacctacgccgatcaatttcatcatgaaaaggctaagcccttagcggtatttaacgatttctattataaatggtttaaatctgttttctcgcatgtccatttattaccattttatccatggtcgtctgacgacggcttttcggtaatggattatcaccgcgtcgctccggaagcaggggagtggagcgatattgccgaattaaacaaacaggcgcggctgatgttcgattttgtctgcaatcatatgtcggcaaatagcgaatggttcaacaattatctgcaacagaagccaggctttgagaatttctttctcgccatggatccgtccaccgatttatcggcggtgacccgcccgcgcgcgctgccgttattaacgcctttcacgctgcatgatggctcgcagcgccacctgtggaccaccttcagcgacgatcagattgaccttaactataacgagccggacgtgctgctggcgatgatcgaggtgctgctgcactatctggcgcagggggcggattacgtgcgcctggatgcggttggcttcatgtggaaaacgccgggcaccagctgcattcacctggagaaaacccatcagctgatcaaactgttccgcgccataacagacgaggtcgcaccgggtacggcgatcatcactgaaaccaacgttccccataaagacaatatctcttatctgggcaacgggcgcgatgaagcgcacatggtgtatcagttctcgctgccgccgctggtgctgcatgccgttcaccgtcaggatgtcaccgcgctgtgccagtgggcgcaggggctgaagctgccaggtcgcgacaccacctggtttaacttcctcgcttcccacgatggtattggtcttaacccgttacgcggcattttgccggaagaagaaattctgcacttagtggaacagctgcgtcaggaaggcgcgttagttaactggaaaaataacccggacggcacccgtagcccgtacgaggtgaacgtcacctatatggacgcgttaagcgcgcgggacagcaccgatgatgaacgtctggcccgtttcctgcttgcccatgccattctgctgagtttccctggcgtgccggcgatctatattcagagcattatgggatcgcgtaacgattatgacggcgttgaacgtttaggttataaccgcgctattaatcgccagaaataccatcaggatgatattgaaagtcagctacaggccagcggctccctgcggcatcgtgtttatcacgctttatccagaatgattgtgctccgccgccagagcagtgttttccatccggacagcgcgttcactatcaatagtctcacgccgcaggtaatgcaaattacccgtaccgctaaaaatggcgagacgctggaggcattatttaatatcagtaacgccgaacaaaaaataaaagtccacagtacaggctttgatttaataagtgaatgtcctgtccctcatgcggaattgaccctgcgtccgtggcaggtcatgtggatcaaaaaacaataaaggaacatcttatgtttaaagcaaaagtcgtgctgttatcagcactggtgtcgtgcgcccttatttccggctgtaaggaagaaaaaaagacggtcgccattgaatttatgcactcctccgttgaacaggagcgccaggcggttatttcccgcctgatcgagcggttccagaaagaaaacccggacatcaccgtaaaacaggtgccggtggaagaagacgcctttaacaccaaaatcattaccctggcgcgtaccggcgcgctgccggaagtgatcgaaaccagccacgactacgccaaagtgatggacaaagaacagctggtggatcgtaaggccatcggcgaagtgatcgccgccgtgggcgagcagaatttctatgacggcgtgctgcgcatcgtgcgtaccgaagacggaacggcctggaacggcgtgccgatcagcgcctggctacagggcgtctggtacaaaaaagatgtgctggcaaatgccggtctgagcgagccgcagaactggcagcaactgctggaggcggcgcagaagctcagcgatccggcgcagaaaaaatacggtatcgcactgccgacggcagaaagcgtgatgaccgagcaggcgttctcccagtttgcgctctccaacgacgccaacgtctttgacgccagcggcagcatcacgttcaacacgccggaaatggaacaggcactgggaatgtaccgtcagctggcggaaaccaccatgcctggctccaacaacgtcatggaaattaaagacgcctttatgaacggtgccgcaccgatggcgatctattccacctacatccttcccgcagtgtttaaagagggggatccggccaacctcggctttatggtgcccactgaaaaatctgccgcggtgttcggcaccatcacctcgctgaccatcagtaacggccagtcggctgacgaaaccgccgccgcagagaaattcgtcacctttatgcataaagctgaaaacgaagcggagtgggtaatgatgtcgcccggcgcggctttcccggccaacaaaggcgtcaccgacaccgcgctgtggaaagacaacgaggtgatcaaggcctttggtcagctgccgtatgacctgatcgcccagtatccgaatatgaaagtcttcggctccgtcggcgataaaaactttacccgcatgggcgatgtcaccggatccggggcgatcaaccgggcggtgcataacgtcacggtaggtaaaaaagatctcagccagaccctttctgaagggcaggcgaagctggaagaacttgtaaaacaacgttaatcaaaggatgtgaattgcagttatgaaaaggttgttttcaggtcgttctgatatgcctttcgccatgctgctactggcccccagcttaattttgctggggggcctcgtagcctggccgatggtatctaatattgaaatcagtttcttacgcctgccgctaaacccgcgcatcgacgcgacttttgtcgggctggaaaactatatccgtatcttaagcgatccgggtttctggcattcattgtggatgacggtctggtacaccgtgctggtggtggcgggcagtaccgtgctcggtctggcggtggcgattttctttaaccgcgaatttcgcctgcgcaaaaccgcgcgttcgctggtgattttgtcctacgtcacgccgtcgatttcgctggtctttgcctggaagtacatgttcaacaatggctacggcatcgtgaactatctgggcgtcgatctgctgcatctctacgatcgggcgccgctgtggttcgataatccgggcagcagctttgtgctggtggtgctgttcgccatatggcgctacttcccctatgcctttatctcctttctggcgattttgcagaccatcgataaatcgctgtacgaagccgccgaaatggacggcgcgaacgcctggcagcgttttcgcatcgtcacgctgcccgcgatcatgccggtgctggcgacagtggtgacgctgcgcaccatctggatgttctacatgttcgccgacgtttatctgctgaccaccaaggtcgatatcctcggcgtctatctctacaaaacggctttcgcatttaatgacttaggaaaagcagcggccatttctatcgtgctgttcgtcattattttcgcggtaattttgctgaccagaaaacgggtgaatctcaatggcaacaagtaaacgtaccctcagccgcatcgggttttacgtcgggctggctgcctttctcatcatcacgctgtttccgtttttcgtgatgctgatgacctcgttcaaaggcgcgaaagaggcgatttcccttacgccgacgttgctgccgcagcagtggacgctggaacactatatcgacatttttaatccgctgattttcccgttcgtcgattacttccgtaacagcatggtggtgtcggtggtgtcgtccacggtggcggtgtttctcggtaccctgggagcctatgcgctctcccgcctgcgctttaagggccgcatgaccatcaacgccagcttttacacggtgtacatgttctccggcattttgctggtggtgccgctgttcaagatcatcaccgcccttggcatctacgataccgaaatggcgctgatcatcaccatggtgacgcagacgctgcctaccgccgtgttcatgctgaaaagctacttcgacaccatccctgatgagatcgaagaagccgcgatgatggacggccttaaccgcctgcaaattatctttcgcatcaccgtgccgctggcgatatccgggctggtgtcggtcttcgtctactgctttatggtggcctggaacgactatctgttcgcctcgattttcctctccagtgccagcaacttcaccctgccggtcggcctgaacaccttgttcagcacgccggactatatctggggacgcatgatggcggcctcgctggtgaccgcgctgccggtggtgatcatgtacgcgctttctgaacgttttattaaaagtggactgaccgccggtggcgttaagggctaaggcggcctgattttaacaggagactggtatgaagaagttagtggcgaccgaaccgcgtgttgcggcgctggtggagtatgaagatcgcgccgtggcggagaacgaagtcaaaatccgcgtcatgttcggtgcgccaaaacacgggacggaagtggtggattttcgcgccgccagcccgtttatcgacgaggaattcaacgctgaatggcagatgtttaccccgcgcccggcagacgcgccgcgcggtattgaatttggcaaattccagctcggcaacatggtggtgggcgaggttatcgaacgcggcgcgcaggtcaccgactacgccattggcgatcgggtatgcggctacggcccgttatcggaaaccgtcatcatcaacgcggtaaataactacaaactgcgcaaaatgccgcagggcagctcgtggaaaaacgccgtctgttacgatccggcgcagttcgccatgagcggcgtgcgtgatgccaacgtccgcgtcggggatttcgtggtgattgtcggcttaggcgcaatcggccagatcgcggtccagctggcgaaaaaagccggggcctcggtggtaattggcgtcgatcctattgcacaccgctgtgatatcgcccgccgtcacggggcggatttctgcctcaacccaatcggcaccgacgtgggtctggagatcaaaaagcttaccggcaaacagggcgcggacgtgatcatcgaaaccagcggctacgccgatgcgttgcagtcagcgctgcgcgggctggcctacggcggcactatctcttatgtcgccttcgccaagccgtttgccgaaggcttcaacctcggccgcgaagcgcatttcaacaacgcgaaaattgtcttctcccgcgcctgtagcgagccgaacccggactacccgcgctggagccgtaagcgcatcgaagagacctgctgggaactgctgatgaacggctatctcgactgcgaagagctgatcgatccggtagtgaccttcgccagcagcgcggaaagctacatgcagttcgtcgaccgtcacccggaacagagtatcaaaatgggcgtcaccttttaaggtaaaggattactgaacatgaaaatcggaacacagaaccaggccttcttcccggaaaacattctggaaaaatttcgctttatcaaagaaatgggcttcgatggctttgaaatcgacggcaggctgctggtcaataatgttgacgcggtaaaagcggccatcaaagaaaccggtctgccggtgaccaccgcctgcggcggctacgacggctggatcggcgactttatcgaagagcgccgtcttaatggccttaaacagatcgaacgcattctggaagcgctggcggaagtgggcgggcaggggatcatcgtcccggcggcctggggcatgtttaccttccgcctgccgccgatgacctcgccgcgcagcctggcgggcgatcgcaaagcggtcagcgactcgcttatttatctggataaggttgcggcgcgcaccggcaccacggtttacctggagccgcttaaccgttaccaggatcatatgatcaacaccctggccgacgcccgtcgctatatcgtggaaaacgatctgaaacacgtgcagatcatcggcgatttctaccatatgaacatcgaagaagacgatctggcgaaagcgctgcacgacaaccgcgatctgctgggacatgtgcatattgctgacaaccatcgctatcagccgggcagcggcacgctgaacttccgcgccctgttcgatcagctgcgcgccgataactatcagggatacgtggtatacgaagggcgcgtgcgggcagaagatccgtgtgcggcttaccgtcagtcactggcctttttgcgcacctgctaagaggttctctgtgatgagtgcaaccacgactttaccgctgcgcgtcgccattatcggcgccggacaggtggcggataaagtacatgcttcctactactgcacccatgacgctgtgaaactggtggctgtctgtgacagccgcctgtctcaggcgcaggcgatggcagagaagtacggcgcgcatatagaggtctgggaagatccccgggccatgctcgacgcggtgaaacccgacattgtcagcgtctgctcccccaaccgttttcattatgatcacgtgatgatggcgctggctgccggttgtcatgtgatgtgcgaaaagccgccggccatgacgccggagcaggcggaagccatgtgcagcgccgcccgccgcgccggaaaagtgctggcttacgactttcaccaccgtttcgcgctggatgcgcaactgctgcgccagcaggtgatcgacggcgcgctgggcgaggtgtacgtcactaccgccaccgcgctgcgccgctgcggcgtgccgggctggggcgtcttcaccaataaagccctgtccggcggcggcccgctgatcgacatcggcattcatatgctggacgcggcgctctacgtgctggggttcccggcggtcaaacgcgtcagcgcccacagctttcagaagatcggcaatcgtaaaaacagcggtcagtttggcgagtgggatccggcgagctacagcgtggaagacgcgctgttcggcaccattgaatttcataacggcggcatcctgcggctggaaacctcgtttgcgctcaacatgaccgcacagtcgatcatgaatgtgaccttctgcggcgataaggccggggcgacgctgttcccggcccaggtgtacaccgacgagggcggcgagctgaaaacgctgtttgcccgtgaacaggccgatgacaaccgccatttacgcagcatggacgcctttgtacgccacgtgcagggcgaagcggtgcccatcgccgacgccgaacagggacgcatcgtgcagcagctggtggccgcgctctatcaggccgccgaaacagggacaagtgtggaattatgatcaagctttcgacgctcaggcatacggaatgcagtctgcatagcctgaacaaatacgcctcgctgatgaccaccggcaacggttatatgggcgtccgcgccagccatgaggaaacctgcccgctgcaaacccgcggcatgtatcttgccgggctgtaccactgcgcgggtaaaggggaaaccagcgaactggtgaacctgccggatctggttggcgtgcagatcgaactcaacggcgagatttttaccaccgcaggcggcgagatcggcgactggcagcgcgaactggatttcgccaccggcgagctgacgcgttcgctgatctggcgctcgcccaacggcgcgcactaccgcatcagcagccgccgttttgcctctgccgcgcagctgccgctgttcgccatgacgctcaccatcacgccgttaaaccgcgacgcccgcgtgtcgctggtcaccggcattgacgccacccagactaactgcgggcgtcagcatctggatgaagtacagctgcgcgtttttggcgaacactggttgcagggcatctacgccacccaggacggcgcggcggatgtcgccattaccagctggtgccgggtgagcggggcggcgagcacctgctttaccgcaaaaaaccgccagcttctgcaacacaacgtggcgaatgtcgcggcgggcgagagcatcacgctggaaaaactgagctggatcgcctggagtgatgaccgcgcccggttgccggaatcgctgagccagcaggggcgggccgagcttgagcgctgcgttgcacagggttatgacgcgctgcgccacgcatcggacaccgcctggcaaagcttctgggcgcgcagccgcgtgcaggtaatgagtcaggatccgcgggatcagcaggcgctggattacgccctgtatcatctgcatatcatgacgccgggccacgacgagcgcagcagtattgcggcgaaaggactgaccggagagggttacaaaggccatattttctgggataccgaagtcttcctgctgccgttccacctgttcagccagccggacatcgcccgtcgtttactgcgctaccgctggcacaatctgccgggggcgcgcaaaaaagcgcggcaaaacggctggcagggcgcgctttttccgtgggagagcgcccgtagcggcgacgaagaaacgccggaattcgcggcaatcaatatccgcaccggcgtgcggcaaaaagtggcgtctgccctggcggagcatcacctggtggcggatatcgcctgggcggtggtggcctactggcacgccgcccgcgaccactgctttatggcgcacgaagggcttgaactgctcatcgacacggcgaagttctggatcagccgcgcggtggaggtgaataaccggctggagatccacgacgtcatcggccccgacgagtacaccgagcacgtcaacaacaacgcctacaccagctacctggcgcattacaacgtggcgcaggcgttacattttgcgcgtcagttcgcctgtggcgacgaggcctttgtgagccaggcggaacgttttctgcagcgtttgtggctgccgcaaccgcaggcggacggcgtgctgccgcaggatgacagcttcctgcaaaaaccggttatcgatctcagcgcctataaagcgaaagcgggcaaacagaccattctgctcgattactcgcgtgcagaagttaacgagatgcagatcctcaagcaggcggacgtggtgatgctgacctatatgctgcctgagctgttcaccccggcgcaatgtctggcgaacctgaacttttacgaaccgcgcaccattcacgactcgtccctcagcaaggcgatccacggcatcgtggcggcgggctgcggcgacaccgacaccgcctaccgtttctggcgcgaaggggcggacatcgacctgggggacgatccccacgcctgcgacgacggtattcatgccgccgccaccggagcgatctggctcggcgcgatccagggctttgccgggctgtcggtgcgtcatggcgaactgcatctgtcaccgcgtttaccccggggctggcagcagctcgacttcccgctgcgctggcagggcgcgtcgctgcacatcactctcgacgcgcagcagatccgcattcgcagcactgccccggtcaggctgtatctccatcagcagccgctgacggtggacggcgagctgacctgtgcgctgcgcgatttttatttacccacgaccgggaccgctaccacggaggggcgctaagccatggcacagcaactacaggccgtcattttcgatcttgacggcgtgatcaccgataccgctgaactgcattttcacgcctggcgacaggtggcgaaagaggtggacatcgacatcgacgaaacctttaacgccaccctgaaaggcatcagccgcatggaatcgctgcggcgcattctggcgcacggcgggcgggagcaggattttaatccggcggagtgcgcggcactggcggcgcgtaaaaacggcatttatgtcgattcactgcgccagcttactccgcacgccgtgctgccggggatcagggcgctgctgaccgaactgcgcagccgcggcattcccgctggcctcgcgtccgtctcccttaacgccccggccattcttcaggcgctggagatgacggatctgtttggcttttgcgccgatgcgtcgcgcatcagccgctcgaaaccggatccggagatctttcttaacgcctgcgccgggctgggcgtcgacccgcaagcctgtatcggcgtggaagatgcgcaggccggtattgacgccatcaatgcctgcggcatggcgtccatcggtattggcgacaccctgaagcacgcaaccttgcgtctttcctctacggaagaactgacgtggccgcgtttatcagcattctggcaacacagaaagtaaggacacaaaatggcacaactctcgttgcgacatatccagaagatttatgacaaccaggtccacgtggtaaaagacttcaacctggagatcgaggataaagaatttattgtttttgtggggccgtcaggctgcggtaaatccacgaccctgcgcatgatcgccgggctcgaggagatcagcgacggcgatctgatgatcgacggcaagcgcgttaacgacgtgcccgccaaagcgcgtaacatcgccatggtgtttcagaactacgccctgtatccgcacatgagcgtctacgacaacatggcgttcggcctgaaaatgcagaagatcgataaggcgattatcgacgagcgcgtcaactgggcggcgcagatccttggcctgcgcgattacttaaagcgcaagccgggcgcgctctccggcggccagcgtcagcgtgtcgccctcgggcgcgccatcgtgcgtgaagccggggtgttcctgatggacgaaccgctctctaacctggacgccaaactgcgcgtgcagatgcgcgcggaaatcagcaagctgcaccagaagctgaacaccaccatgatttacgtcacccacgatcagaccgaagccatgaccatggcgacgcgtattgtgatcatgaaggacggtattattcagcaggtgggcgcgccgaagacggtttataaccatccggccaatatgtttgtcgcaggatttattggctcaccggccatgaattttattcgcggcaccatcgacggtaaccagtttattaccgaaacccttaagttaactattccgcaggataaattaagcgctttacaggccagcggttgtcagcataaagcggtggtaatggggatccgtccggaagatatacatccgcagcatcatgaagaaaattgtgttgccgcgcgtatcagcgtggcggaattaactggtgcggaatttatgctgtacagcaccgtcggggggcatgagttagtggtacgtgccggagcagttaatgattatcatgctggagataatatcaacattcacttcgatatgaataaatgtcatttctttgacgcggaaactgaacaggctatttaactggccgcttaactatataaatatatcgccggatagattcatccggcatgacatttttatttttctaaggaatgaaaatgaaaatcttactgagccgtgccgccttgatcctgtgcgccggaacattctgcgcgcaggcaactgaaaacaacgactggcagtttaatattggcgccatgtacgaaagtgaaaacgtcgaaggtcagggggaggacatggacgggctgtatgaaccgtcggtctggttcaatgcctctaaaggcccctggcgcgtggcggtggcttattatcaggaaggcccggtggattacagcggcggtacgcgtggcacctggtttgatcgtccggaactggaaattcactaccagtttattgaccgggaagatttctccctcggtctgaccggcggcttccgtaattatggttatcacttcaaggatgaacataatgaagatgccggtacggcgaatatgcagcgctggaaaatcgccccggactggaacctgaagcttaacgacgcctggagttttggcggctggctggcgctgtaccagtttgccaacgatctcaacgccaccggctatgcagacagccgcgtggaaacggaaaccggctttacatataaaatcaacgataccttctcggtagtaaccaactactatctggagcgtggttttaacatggacagcgggcgcaataacggcgagttctccacccagcaaatccgtgcctatttaccgatttcgttaggtaataccaccttaacgccttacacccgccttgacctcgaccgctggtcaaactgggactggcaggatgatattacccgcgaagatcatgacatgaaccgtctgggtatgctgtacgcgtacgatttccagaacggcctgtccatgacgctggactatgcgtttgaatggcaggggcatgacgaaggcagcgacgacaagttccactacgtcggagtcggcttcaactacgcgttctgagattgatcgtcagagtggcacgcctgtgccactcttttcatcaggtgccctcaaataatggtcgttgccacaatcacatttcgcgggcagggcttgccggaaatcagcttaaagatcagatcaaagctctgcgcgcctagttcctgggacggcacgtcaataccgccgggcggcgggttgagaataaaagaaagggtttcgttaaggtagcccaccaccgtcaactgctgcgggatacggatgttttgctctgccgccgcgcgatagacgctcatcagcttcaggctgtcggtggcgaagatcgcgtcggggcgtgtgggcaggctcagtaaggcacgggcggcgtccagcgcgctctcctgcctgtagccgccgtcgatgatccactcatcacgcagcggcaactggctggcccgcaaactggccttaaagccgttaacccgatcgatggaaacgtgatagctcagcggggcgtgaatacaggcgatatttttatgaccgcctttaattaacgcatcggtaatggcgatactgtcgtgatagttatcggtatccaccgaatagacgttttcaaactggccttccactttgccgatcaccaccaccggaataccgtgcttatcaagctgcgccagaaataactcattcgccggagagctcagcataataatgcccttgatcatcttctgcatgattttgctttcgcatttttgcagttcatcggcggggcttaacgacgtctgtaatataacgtcaaaacctgcatcttccgctttttcggtaatggcatgtaaggcttcagagaaataaggattaccggcagtggtttttgtcggccgggtataaataaccataatggcgtcaaagccggatgaggtcagcgcacgggcggctttattgggatgataatttagctcgctcatcgctttaagaactttatccctcgcctgcggcgaaatattggtttttttattgagtacccgcgagacggtagattttgaaacacccgccacgcgcgcaatatcataaatggtaggggacataaccttacaagttccattaatagagttacatcgtccatcttacgggagataaggcgggcaagacaaacattaagtggttaattgatgaaatgcatcactgtacggtcagccttactctcagtgaatgattacccggcggaatatcctctccgccgggtaaggggcagattaatgaaccggagaaatatgcatcgcggcggtggagatggcaccggcaaacaccaacagcccgcagccgccgtcggtgaaagcgttgtcgtcgtcatcaatcacgctaagccggagatgatccaccgtggcttcaatcagcctgccctgcaggcgaatatcaaaagcgatctcgcgctcaaaaacgaaggtacgcggcgcttcggccagaaccttaaccttatcgtcgcgcacccgtatcagctggagcttttcatcagcggtgaggcgcacggcataataacggcgcatcccctggaagcggaacgccagcccgccgtagtcgcccaggtgcagggtgagatcgcactggatgcggtagtcgcgccactcgcgggtgccgtggatcaacaccccttcgtcccgttcgctggagatacggatacgatccggatagtgccgggaaagtaaatccgcgccgttcacccaggatcgccaccagaaatcgcttttgcctgccggtttacgcagggtgagctgcggcgttccgtcccagcgcagggtatccatcagcacccgtccggcagagggggccgtcagcgcaatgcccacctcggcaatcggctgaccctggcagtccggcagcgtcatggcgagcgtgatcccgccgcctggcggcaacggctgcggttcgccgtagtaaagttgccgttcactgttttcgtcatacacccggtagcagagccgcaccatgacggtttgccggttatccggcggcgcaaacagcgtggcgcgcaattgctgacccggataaaccagcggcgtcgccagcagatcgtaactggcgtagctcagcatatcggccacttccggcggcgaaaaggtgagggtggtgacgcaggcgggcgcgtccggcggcagggcggggtaatcaaggcacagcatattccggccctgatacgccgcattgcccacctgtaccgacggtgtcagggaacggaaaccctgcacgctgccgggcagcgagaagtgaaactgtgcgccatctttacggggcgccgggcgcggcagcccggcgagctggtgaccaagatcgtacagatcatcggtaatgcgcacggcgttattaatggaaaaaccgccgtccgccgaggagatgagcaaacgatccgccagcggcccgcgccagtccggcccggcgtcaatgcccgccagtccggtcatgatccccgacagacagccgacattaccggcgttgcagtcggtgtcccggccggaggtattgataatgcactgcgcctgctgaaaattatcaggggcatagagcatcgccatgatcatcagggcgtgattaggtaccatcgggcagttgccggggtagttgtcgtaaccgtactgcgcgtcgatcttctcgcgggtgaggtgccagtcgccgtcctcccggtgccagcggcgaacgtcggcgatcatacgggcgatttcacagtcggcaggaataaacgacaggcccacctccagcagctgctgaatatcactacagataaaagcctgggcttccatggctgcccacagcatcgccgcccataccgcttcgccatcgtgactgacgctggcggctttttgcgctaaggaggcggcaagggcgggctgaccgggcgcgaccagcgcccagccatcaataaatatctgtgagccaatctgttcggcaatggttttgccattggtagaggccgcaccgcttaacggcgcgggaatgccttttttgaggttaagccaggccgtctgctcggtggaattcccgttgccgccccaccataaaatggtgcgcttatcgataatgtaattcagccagcactggccgatctgttctgcggtgagcgtatccgcaagcccatagtcttccagggcgcggataaaggtaaaggtaccggccacgtcgtcatccgccaccaccagcgggcggtcgaatttatcatgcacgtagtaatcgacgtggccaagccggtcgacgatctcctgatagcgccagccttcaaacgggcgtcctaagtagacgccgattaatttccccagcacgcccgcgtacaggcgctgataatagtctgccggtaaggccatcatttcctccctgattgataagttgcgacatccgttgtgcgctgtcaggagtggggcgaatcagccaatgcgccactcactggtcgccacgccgttcacccacagctgccgtttttcacctgccggtaacgacacctgcaacgcttgccaggcgggattataatccccgcgccgggtgatattcagtgatatggatccggcatcgcagctcatttcccacgtcagccacagcgcattaccctcctggtaaccccaggattcaccgtcatcctcaaacagcagcccggaagttttaccgacgcctttcagcgggtacagtttcagctcgcggctggtatccgcgcaggcgtcaacgtgagtgatgcgctcgctcagcggcagtcccgccccggcgcgtaccagcagcggcagtttttccagcggcgcgtcgagcgtcacccactgaccgccgctgtaccagtcgccgctgtaaaaatcgtaccagccgctgtggttatccggcagccacaggcggcgctggcgctgacccggttccacgacgctagccaccagcagatcgcggccgagcataaaatcgtcgcactcggcgaaggtctgcgcgtcatgctcatgatcgagaaaggtcggacgcagcatgggctcgtcatcggcatgggcctgccacaacagggtgtagagatagggcagcaggcgatagcgcagttcgatggcgctgcgtatcgctggcgtcaccgccgggtacatccacggctcattcaccgtgcgatcgtcattccatgagtggatggtgaaacgcggatgcatcacgccgttctgcacccagcggacaaacagctcggcatccggtttatcgccggaaaacccaccgacatcatggccgacgttaaacagtcccgacaggctcatgcccacgcccatgcgcgtgttatagcgcagcgtatcccagttggtgcggttgtcgccgctccaggtctgcacgtagcgctgcatcccggcgcagccggagcgggagatcagatacgggcgcttgtgcggcgcgaaccgctgctgggcttccattgaggcgcgcatcattaacagcggcatcaccgggcggatatgcttaatggcgatttcgcgcccgaagccgtgacagcgcgcttcgccgtcccagacttcatactcgttgttatcgttccaggtggaatcaatacccatctccaacagttgcgtggtaacgccgttctgccaccaggcgatggtctttggatgggtaaaatcaagatgcgatccttcgtcatcccagaagctggagcgctccggcgcgtcgctttcggaatcgcggataaacagcccctgctgcgccacttcctcatagcgcgggtgatcctgcaacagacagggtttgatgttggccgccagcttaatgcccgcctcatgaaatgcgccggacatcaccttcggctgcggcactttgtcgtagttccagttaaagacgtagcgcttgttattgatggaggtatagccggacgacagctggaaagaatcgcagggaatggcgtgctctgcgcacaggcggataaaattcatcagctgatgctgggcatccggcgcgtcggtgtagtgcatggtcgaaccgctgtagccgaggctccatttggggccgaacagcgttttgccggtcagacgcacaaaggctttggtgacgtccagcacccgtttaccggtaaagacgtagtaatcaatatcgcccgcttccgcctgccagcggcgataggcggtgtgatagttgtcgatctcattacccagatcgagccagcagctgctgaggttgtcataaaacaggccgtagctgacgtcatcccggcgggtaatggtaaaggggatatgcttgtacagcggatcggtgctgacggcgttatagcccatcgcatccagattgcgcatctcaaaacgcctgccgttgcgctgtaaatccccggctttttcgcccaggccataaaagcgttcagttttctcacgacgcagatagtgcgccacgccgtcgccgtgggcattgagcagataagcgctggtgggacgatcccccgccagccactgccacgcgcctgcgtcatcgcgataatgccactccagccacagcggctggtggacggtgacgcgcatggcggcgctctcgaccgtcaggctgtcatcagtgcgggagagcgtccaggccgggcagctaaaaccgctcagatcgtcccgggcgcggccttcccaggggacgtcctgcgccggggcgatgctccaggttctgtccagcgccagttcgcctttgcgtttcaccagtacgcgaaacagcgtctcttccagcacgtacaggcacagcttgtgctgcccgtcgaccagcaattcaaggtggtggtcagactgcgtgtgcagcgtccagtttttcaacgttttcatatcgatttacatccactatcaggcgcgtttagcgcgacgttcagcaataaatgccaccaggaaaaaagcgccgatcaggtcaaagaatcccatggcgacaaacagcgggttgaagccgatcttgtcggcggtgacgccaatcagcagggagaacaggaagctggcgatccacgcgcaggaaccgcgcatgccgttgaccgtcgccatctgccccttgtcgaaggactccaccaccagcgcgctcagcatgcaggagatgatctgatggccaaaaccgccaatggagatcagcgcgatgataatgatcggatcgcgggtgagggtgacgacagccagcgagatcatcagaaacgcgcctgtcaccgaactggcaacaatagaattgatgcgcgcgcagccaaaccagcgggtataaagtttggtgagatagccgctggcgatactgcccagatcggcggcgaggaacggcagccaggcgaacatggcgatctgtttcagatccatgccgtgctctttcgccagatacagcggcacccagaagctcatcaccgcccaggccggttccgccataaaggccggaatggcgatgccgtaaaaccgtttatttttggagacggttttcagcgcggtaaagaagggcagtttttcggtaagcggctcattatcctgctgaatatgcgccagctcctctttgctcagattggggtgtttatccgggttgtggtagaacgcccaccacagcaccacccacagtaatgccagaccaccggtaaacataaaggcgccctgccagccgaaagaggcatgggcaaaatagataatcggcggggccagcatcgcgccaattgaaaagccaacccccgcccagcctgccgccaccggacgttctgatttcgggaaccactccccgagggttttggcgttggccggtgtcgccgccgcttccgcaccccccataaagaagcgcaggatcgccagctgcagccagcttccggccccggcatgtaaaatacaggccagcgcccagagggcagcgcagatcataaagcccagcttcaggccgatgacatcaatcagccagccacagagcggctgaaaaagggtgtaggcgagctggaacgcgccaacaatgtacgaatactgttctgtggtaatgccgaggctgtcttttaactccggagccagaatacccagcgagttacgggtgatgtagttgacggtgacgccgagcaaaaacagcaccagcacccaccagcgaagattcttgatgatgcgtcgcggcttgccgaccgcgatgtcgttattaatgtcctgactcataacactctccgaaggacggtttgtaggggtatctgtttgatacttatggttttaattacagagttattacacaactagtatggaagttgtgcgtcctgttgagattatgaaaattcattgccgggtaatagcggattttgtgcaagttttctcagtaatttgccttacatccggcgaaaatcacatccagcacagagatagcgtgaaagcacgcttatgaaaattctttcatttaacgaacgggcgcagatcacaaaatggacaaaaagctcagaatcgccgaaatcgctgcccgtacccggctgtcggccagtacggtatcgcgggtgctggcgggaaaagccaataccagcgaaaaagcgcgggcagcggtgctggcctgcgcccgtgaactgggcgtgatggacggtatggccgccggacggctgctgctcaacagtctgctggtgttcgcgccgcagcgggcctttgatgagcgctcggacatcttctattaccgcgtcatccagagcatcagcaaagcgctggcgccgcacgaggtacacctgcgttactgcgcgctggaggagaacgacagcgatgccaacctgtttctggcaaaaatgaatgacagtgacacccaggcggcgatcctgctcggcatcgacgacgaacatattcacgatctggccgccgatctggcaaagccctgcgtgctgatcaacagccgggaccggaaaatgcgcctgcccgccatcgccccggatcaccggctgatcggcgaatttgccgcccgttacctgttcgaaatgggccatcgccacgtgatgaacgtgctctgcctgcggcgctacactatggagctgcggctggcgggcattcgtgacgcctggcgcgcgcagaacctccgcttcagcgataaccgcgacgtgctgctggtgcagagtttcagcgcccgcgaagcggaagatcgggtaggggaatggctcgacgcccagcccgcgaaaacgctgccgacggcctttctgatgggcggcgattttctggcggcgggcgccgtgaaagcgctgcaaaagcgtggtctgcgggtgccgcaggacgtgtcggtgatgagtatcgacggctttaacctggcggcgatccaggaggtgccgctcactgcggtacacgttccgcgcgacgagttgggagaagaggcggtgcatttgttgcagcagcggctgatccgccctgacgggccaaccggtacgctgttacttaacggcaggctggcggtgcgggagtcagtgcggcggatacgcccggacaaaaggcgcaccgccgtggaaagggaagggctgtatgatgattaaaccggcatgcccagcgcgcgcttgccgtgctcgttcagatcgtccagcgtaaagcgatccgcccagttggtttcatagtcttcgcgcgggaagtcgcccggcgatgcgcctttttccagcgccgctttaacgcgtttcgcataggcgaggtttttctcgcacagcggcgcggcaggaatgtacatcacgttgccccagccctgctgatcggtgaccggcgcgaccgagtggatcacatcgcagtgccaccagaccgaatccccggcctccagcgccggaatgctggtcagcgcctcaatgagcagcggatgccactgggcggaaatcggcagcacgcgacctggcgccacgccgcacagctcgtcgtccggcacgtcgtcaagcagcggacgcagcagcacatacgccatcgcttccgggattggcaccacatgcagcaagccctggccgggcagcatatccgacagcgccgtccagccctggaaggtacggaacaccgagcatttggtggtgttatcgacggtgtattcttctacttcggtacggtgcgcggcattccacggatcgtactgctccggtttgccgttaaatacggcggcgaacacctgctgataggcaggcagcagccagcgctcgagcgcgccggaatccgtgtgcgcccccagccctttcgaggtggtgcccggcggacggcggcggatgcggtccgggtaaatcacgctgacatccggatcaaaccactgtttgccttcgctctcaaaggtccacaggcggtttaaaaaagactgcacctgcgccatttcactgctctgccgcgcctgcatctgcgcctgcgaccaataaatcgggtagatctccgggcgggaggcctccagcgtgccgaagaagctgtcgcccggtcctttgtacacctcgtcaaaatggttgcgatcgagatattccagcatcgaacggtcccagcccagcgcctgttcacgtgggaagtggcctttgatcactgcgcagccgcggcgttttacctcctcgcgctgcgcctcgctgagggtgccgtttttaatatcggcaaaagggatcaccggccacaccggttcgccgcgggctttcagggcgttgatttccgcgacgcgggcggcaatacgctcgcttaactggttaaataccgcctgcacgtcgccgatttgcgcgcgcagcgcctgcttgagttgacggatcgccgctttgtgatcggcaggcagcgtttcgctggcaaaggttacagccataatgacctcacttttctttcattcgaaagtaaaataacttacacatgctaatttaagttaaaaaaaagttaatgcaagtttaaaaacttgatgaggtgcacaaagcgggaaaagtgcgatgccagcgcaggacgcaccggcatcagaagggtcaggccgtgaaggggccagtaccgtcgagcaccgcctgaataacgttcagcgcgccctggtgattgttatcatccgtgcgatggcgggcaatggctttaatggcgtcgccggcattgcccatggcaaaggagtaatccgtcatacgcagcatttcggcatcgttgccgctgtcgccgatggtcacgcattcccccggcgatatgccccagcgtttcagcaggcgggtaatgccgttagctttgtgcagaccgggaatgatcagatcgacaaagccaaagccgctggtgacgggcttcatgatgccgtcgagagagacatgcagcgcgtcaataagttgcggaatgtcgctatccggcaggttgagggagaacttaaacattttatcgtcgatgtcgtgataatcgcgcaccggtttcagacggtgataatggtgcgacatcagttcgacaaaggcgtccggggcgcgatcgctcacataagcgctctccagcccgcaggcgacaaagttcagccctttgtccttcagcagctcgccgagcacgatctgatattcatggcgggtcagctcgccgtggaaaagttgctggccgtgttcatagaccagcgcgccattttcggagacgaatgaaatacgatcctgaatttccgggaagaaggagatgagctgataatactggttgccgctggcgaccacgaattcaataccgcggcgctgtagttgctcaaactgtgccagaaaacgatcgcgatcgtaggttttggcatcatcaaggaaagttccgtccatatcggtgacgataactttaacggtcatgcattgcgctcctgaatgtaactgcgaccagaaacattctaataacaatatgagcagaagcacaattttatttcattcgaaagtttgcccgtcgttatcaaacgggtaggcccggtaagcgaagcgccaccgggcaagggggattacaacgtatgttcggtacgggcgataatatcgtcctgcgcatccggcgacagggcggtgaagaacgccgaataccccgccacgcgcaccaccaggtcacgatactgatccggatgctgcttcgcggcgattaacgtctcgcgcgacacaatgttgtactgaatatgccagcctttatacacttcaaagaaggtgcgcagcagcatcatcagcttttggcggtcgctgtcgttttccagcgtcgccggattcagcttctggttcagcaacacgccgcccaggatcgcctccgtcggcagtttacccaccgagcctattaccgccgtcggccctaaatggtcggtaccggaagccgggcttgcgccttccgccagcggggtatgggctttacggccatccggggtcgccatggttgcggcgccaaaaggcacgttggcggaaatggacgaggtaccggcgtagtaattaccgccgatcggaccccggccatagcgcggattgtgatactgcttcagctcctcaatgtaggtctgataggcgcgcgccagcagcagatccacgctgtcgtcatcattaccgtatttcggcgcgctgttgatcagacgctgacgcagctgctcgtgggtcagcccttcgtaatcttccgccaacgcttttgccagttcctgctgacctatcgccccctgatcgaacaccagctttttcaccgccgccaggctgttgccgaggttggcgatccccacctgcaaaccggaaacccagtcatatttcgcgccgccctgtttgatgcttttcgcgcgttcgatgcagtcgtccaccagcgccgagcagagaatatcgtgcacgttctcctccagcatggtgtccaccacatactcgatctcaatggatttgcgcgtgtagtagcggatctgcgtgtcccaggcgtccatcacctgcgaaaagtcgctgaaattgcctttcgacagcgccagttcctgcggcaggaatactttgccgctggtggcgtcccgtccgccttccagcgccgccagcatcacgcgggcgaagttaataaagctcatgccggtgcagcgatagccccacttgccgccgacggcggtttcgatgcagccaatcgccgcataatcgtaagcgtctgccggttcgatcccgagcttgataaattccgggataacgatctcatcgttattgaacgccggcatgccgaagccgcagcggatcacctgcacgcaggcgtcgaggaaatcgttgctcatccccgcgtggtaacgcacgctgaggttcggctgggtggagcgcaggcggccgcaggattcgaggatcgcataagagagcgggttcactgcatccagcggcttaccgttgaccagtttctgaccgccgatggtgacgttctgatacagcgggctaccggccgaggctttggagtgcgagccggaacggattttgttcacttccagcagcttcagccagcaggcatgcagcagttcgatggcgtcttcccgcgccaggctctggtccagctccacgtcacggcggtaatacggatacagatactgatccatgcggccaaaggacaccgagtgaccgttagattcgatctgcaaaatcaactggatgaaatagcacagctgcagggcctgccagtacgttttcggcggctgatgggcaatgacatcgcagttttccgcgatcgccagcagttcgtcgcggcggctttcgcgggtttctgcctgcgccatgttacgcgccagatccgcaaagcgtgcgatatgctggctgacggcttccagcacaatatcaatggctttgaggaactgctcgccgtgcagatcttccagcaccgtcagattgatgcgcgaacgacgctcggcgactttctggcgcagcccgtccatacccagctccagcaccagcgggaagttcaccgccaggtgcgcatcgccggaggtcatattgccttcggctttaatgatgccggtctccagcagtgatttttgctcgtcggtaaacataccgtagcagcgatcctgtaccgtctggccgcgccaccacgggcagatttcatgcagcacgcgcttgttctcttcgctgacggcaaaccctgcgcccggacgatcggcaagatcgtcgatctcgttttctatccaggtcaccgtatattccgggaagatcggcgcggcgcggaccatactcgcctggttgccgacaatcaactcatcatgcttgatccagatggtgcgttccgccagatgatgggcgagggcaagggcgcggcgcaccgggatcggcttatccatatgctgctgataagcctgggtatagtgcagcgcgcgctcggtgcagaccggcggtttggtgatggtgatcagcgcatttttatgcgccttgatgcggtcagtcagggtatcgagacgtaaagtggtcataaggttatcctcgtaacgtggcggtcagcccgcattcgcgcgcgtagtcttctgcaaaagccagcagatccggggcgtcgagcggtttgtctggcgcggtgtaggtctggccgagcaggtgatacttgttcatgcccagcgtgtggtacggcagaaaatgaatatcgcggacgttgagttcgtcggcggcaaaacgggtaatggcgcggatcgacgtctcatcggcgttaaaaccggggatcagcggcacgcggatggtcaacagcttgcccttgcgggcgaggcgtttgaggttctccatcacccgttttgccgagccatcggtccaggctttgaatttctcgccgtcgacatgtttcaggtccgcaaggaacagatcgacattatctaaagagggctcaacgtagtgccacggcacatgcagacaggtttccacggcggtatgaattcccgcttcatggctggccttaaacagcgcggcggccagcgcaggctgcataaagggttcgccgccggagagggtgatgccgccgccgctgcgatcgtaaaagggtttatcgcgcaggacggtggtcatgatctcatctactggttttgtttcgccgcagacggtcagcgcctgggtcgggcagcatgccgtcagcgcgtccaggtgcgcgtcattaagatgctggcgatggatcagcagaccgttcagcgcgcattcaatcaccgtgggggccgcctgctggcacagttcgcagccgtcgagacacagccggtcgtcgtagagcagatcgcgtttcagcgaacggctttccgggttctggcaccagcggcagccgagcgagcagcctttaaggaacactacggtacggataccggggccatcgtgggtggagtagcgctgaatattgaatatcatgattgtgcctcatcttgcgtacgaagattaaatgactttcgaatgaaagttattttgacgccgatcaagtatcattcaggtagcctgaggtaaatttcagcgcatgctacatctcacattttgaaggtcatatcatggaactctatctcgatacctccgacgtcgcggcagtcagacaactggcgcgcattttcccgctggcaggcgtgaccactaacccgagcattgtcgccgcgggtaaaacgccactggaggagctactgcccgccctgcatgacgcgctgggcggcaagggccggttattcgcgcaggtcatggcgaccaccgcggaaggcatggtggtggatgcccgtaaactgcgcagcattatcgcggatatcgtggtgaaggtgccggtcagcgctgaagggctggcggctataaagttgcttaaggcggaaggcatccccacgctcggtacggcggtgtacggtgcagggcaggggctattaagcgcgctggcgggggcggaatatgtcgcgccctatgtgaatcgcgtggatgcgcagggcggaaacggtattcagacggtgggcgatttgcagcggttgttaaccctgcatgcgccaggcgcaaaagtgctggctgccagctttaaaactccgcgtcaggcgctggactgcctgctggcgggctgtgaatctattacgctgccgctggacgtggcgcagcagtttatcgccgctccggcggtggaggcggctatcgcgaagtttgaacaggactggcagggagcgtttgggcggctggggctgtaaattgccgggtggcgctggcgcttacccggcctaccaaacctgaatcgccgggtggcggctgcgcctgacccggcctacggggacgaatgcgacgaatttatgtaggcccggcaagcgcagcgccgccgggcatagcggctaagattgcccgcacacctcgcatccggcatggcgcattaatttcatctcgcggaactggcaggtcatggcgtcgtacatcacgattttcccggcggcgggcgtgccataatgcgccagcagcttgatggcttccatcgcctgtaacgaaccaatcacccccaccagcggggccatcacgcccgcttccacgcaggtcagcgcattctcgccgaacagacggctcaggcagcggtagcacggctcgcccggctgccaggtgaagacgctgatctggccttccatgcggatcgccgcgccggaaaccagcggcactttcgcctgaaaacatccggcattaagctgattacggaccgcaacgttgtcggtgcagtccagcaccagatcgtgggcggcgatctgcgcgttcagggcgtcgtcgtccagctgcgcgttgagcagggtaaaggagacgtgcggattgatacgcgccagcgccgcgcgggccgactctactttgggctcgccaagcgtggcgtcgctgtgcagcgtctgccgttgcagattcgagagggagacagtatcaaaatccagcagcgtcagatggccgacgcccgccgccgccaggtactgcgccgctgcgcagcccagcccgccaagccccaccaccagcacccgtgcgcctttcagccgctcctgaccgtcaaagtcaaagccgcgcagcacgatctgccggttgtagcgcatcatctcgccatcgctcagttcaatggacattacagccctccgaacagatgattaaacggctccacctcaacccattctcccgcttcgacgttctgtcgctccgcttccagcacgataaaacagttgccctggctgaaggagctgaagatatgcgagccctgatgcccggtggtgctgacggttaattcgccctgttcattgcgggttaacaggccgcgctgaaaatcgaggcggcccggtgattttttcaggcgggtggcggtgcgcacgcgcagacgcgtcggcagcgcgctgtcatttttaccgcccagtttcgccagtagcgggatcaccagctgatagaaagtcactgccgctgataccggattgcccggcagcccgcagaaccagctctggctcagcttgccgaaggcgaaaggtttaccgggcttgatcgccagcttccagaagccgatttcacccagctcttcaagcagcgttttggtgtagtccgcttcacccacagatacgccgccggaggtgatcaccaggtctgcctggctgtccgcggcaataaaggcttcccgtaaccgggcgggatcgtcaggaataatgccgaggttgatcaccgtgcagccaagctgctccagcattaaatgcaccgccagccggttagtatcgtagatttgtccgtcgcccagcggctgtcccggcagttgcagttcatcgccggtggaaaacagcgccacgcgcactttacgcaccacgtcgacgctggcgatacccagcgacgccagcactggcagttcggccaccgtcagcgtctgcccggccttaaacaccacctcaccggcgcggatgtcttccccgaggcgacggatattctgcccggcgcgcacctcgcgggtaaaacgcacgcctgcgtcgctctgttcggtttcttcctgcatcaccaccgcatcgcagcccgcaggaacgggcgcgccggtcataatgcgcacgcaggtgccgacaggccacacatcgttaaacggctgcccggcaaaggcctttcccgccaccggcaggggcgcgcccgccgccagatccgtcagccgcacggcgtagccgtccatcgcggagttatcaaagccggggacattcagcggcgaaaccacgtcatgcgccgtgacgcgcccgaaacaggccagcagcggcagcgtatcgtacgcggtgatcggggtaataacggacagcatctgagacagcgctgtctccagcggcaaaaggcctgcggaaaactccatgtgtgctcctgactggcaatctgaacgtgcattcaaaacgcctattatggcagaaaacccggttcggctgaatgtaatcaatatgtgccttaccggtcaggttgctttacttcgttgatttgactttctatagtcaaaattcatgcctgttttcaggcactcaatcagtaagaggtcagaggatggtcgcacgtgcttgagtcagacgccagtgaagtgctgcgggtcagtaaactgaatattcgttttccggacgaaggcggcacgtcgcacgtcgtgcgggatctctccttttccctgaaacggggggaaaccctggcgattgtcggcgaatccggctctggtaaatccgttacggcgctggcgctgatgcgtctgctggcgcagtccggcggcatggtcagcagcgatgagcttcgtctgcaacgccgaagccgtcaggtggtggatctgaatgggttaagtcatgctcagatgcgcagcgtgcgcggagcggatatggcgatgatctttcaggagccgatgacctcgctcaatccggtgtttaccgtcggcgagcagatcgccgagtcgatccgcctgcatcaggggctggggcgcgatgccgcgctgaaagaagcccggcgcatgctggagcaggtgcgtattcctgaggcggacgccattttgtcccgcttcccgcaccagctctcaggcgggatgcgtcagcgggtgatgatcgccatggcgctctcctgtcgcccggcggtgctgatcgccgatgagcccaccaccgcgctggacgtgactatccaggcgcagatcctgcaactgatcagcgtgctgcaaaaagagatggcgatgggggtgatttttatcacccatgatatgggcgtggtggcggatattgctgaccgggtgctggtgatgtaccagggcgaagccgtggaaaccggcagcgtggagcagatcttcaacgcgccgcagcatccctatacgaaatccctgctggcggcagtgccgcgcctcggtgccatgcgcggcagcgatctgccgcgccgtttcccgctgccgtcccgcagcgccgcagtattgcccgacaccggaaacggtcaggacacggtggtggcgggagagcccattttgcaggtgcgggatctggtgtcgcgttacccgatacgcagcggcattctcaatcgcgtgacccgcgaagtacacgcggtggaaggcgtcagctttgatctctggccgggggagacgctgtcgctggtgggggagtccggctgcggaaaatccaccaccgggcgcgcgctgctgcggctggtggcctcccagggcggcaccatcacctttaacggtcagcgcatcgacacgctgcccgacagccagcttcagccgctgcgccgggatattcagtgtattttccaggatccctttgcctccctcgatccgcgtaaaaccatcggctactcgattatggagccgctgcgggtacacgatctgctggatacgcaggcctccgagcgccgtctggcctggctgctggagcgcgtcggcttaaagccggagcacgcctggcgctatccccatgagttttccggcggccagcggcagcgcatctgcattgcccgcgcgctggcgctcaatccaaaagtggttatcgccgatgagtccgtctcggcgctggatgtgtctatccgcgcgcaaatcatcaatttgctgctcgatttgcagcgggaaatgggtatcgcttatctgtttatctcccacgacatggcggtggtggagcgcatcagtcatcgcgtggcggtgatgtatatggggcagattgtggaaattggcccgcggcgcgcggtgttcgaaaacccgcagcatccctatacgcgtaagttaatggcggcggtgccggtggccgatccgggtcaccagcggccgcagcgggtgctgctctcggacgagatgccgagcaacatccgcaaactgggcgatccgccgcgccgcgtgcagctgcaacaggttgcgccggatcacctggtcgcacgcacaacaccaggcagcacttcatctgcattttaatgacaataatattcccggacagacagggaaactcaggagattaacatgacacaatttgttgcgcggaaatggcaggttgcgctcggcgtcgcctctgttcttgctgccgcaccggtgctggccgcgaaagacgtggtggtggcggtggcctctaatttcaccaccctcgatccttatgacgccaacgacaccctctcacaggcggtggcgaaatccttctatcaggggctgttcgggctggataaagagatgaagctgaaaaacgttcttgcggaaagttataccgtgtcggacgacggcctggtctataccatcaaactacgtcagggcgtgaagttccaggacggcaccgattttaacgcggcagcggtaaaggtgaacctcgaccgtgccagcgatccggccagcagcctgaagcgctataacctgtataaaaatatcgcgcagaccgaagccgtggatccgtcgacggtaaaaattaccctgaaacagccgttctccgcctttatcaatattctggcgcacccggcgacggcgatgatttccccggcagcgctctctaaatacggtaaagagattggcttccacccggtgggcaccggtccttatacccttgatacctggaaccagaccgattttgtgaaggtgaaaaaatttgctgattactggcaaaaagggctgccgaagctcgataccatcacctggcgtccggtagtggataacaatacccgcgcggccatgctgcaaaccggcgaggcgcagttcgccttcccgatcccctacgagcaggccgccgtgctgcaaaaaaacagcaagctggagctggtggcaagcccctccattatgcagcgctacatcagcatgaacgtgacgcaaaaaccgttcgacaacccgaaagtgcgtgaagcgatcaattacgccattaaccggcaggcgctggtaaaagtggcctttgcaggatacgccacgccggcgaccggcgtgatcccgccgacgctggcaaatgcgcaaacctatcagccgtggccttacgatccggcgaaagcccgtgaactgctgaaagaagcaggctatccgaagggtttcagcaccacgctctggtcgtcgcacaatcacagcactgcgcaaaaagtcttgcagtttactcagcagcagctggcgcaggtcggcatcaaggcgcaggtcacggcgatggatgccggacagcgtgcgtcggaagtggaaggcaaggggcagaaagagagcggggtgaggatgttctacaccggctggacggcgtctaccggcgaggctgactgggcgctgtcgccgctgttcaccacgcaaaactggccgccaacgcagtttaataccgccttctacagcaatccgcaggtggatcaggatctggttgcggcactgaagaccaccaatccggaagagaaagcccgcctgtataaagcagcgcaggatacgatctggaaagacgctccctgggtaccgctggtggtggaaaagctggtgtcagcgcataacaaagatctgaccgggttctacatcatgccggatacaggcttcagttttgacgatgcggatttgaaatagtgagaatgccccttttgtttgcaaagaaggcagggaaaaggggcatcggattcagggtagaacatgcttaactattttctcaaacgcctgctgggtcttatcccgacactgctgattgtggcggtgctggtgtttttatttgtccatctgctgccaggcgatccggcgcggctggtggcggggccggaggccgacgcgcaggtggtggcgatggtgcgccagcagctcggccttgaccagccgctgtatgtgcagttctggcattacattacggacgtattacggggggatttcggcaactcaatggtgtcacgccgtccggtggccgatgagatcgccagccgctttatgccgacgctgtggctgacgctggccagcatgagctgggcgatgctgtttggcctggcggcggggatctccgccgccgtctggcgtaaccgctggccggatcgtctcggcatggcgctcgccgtcaccgggatctcctttccggcgtttgccctcggtatgctgctgatgcaggtcttttccgtcgaactcggctggttgccaacggtgggcgctgacagctggcggcactatattttaccgtccatcacgctgggcgcggcggtggcggcagtaatggcgcgctttacccgcgcctcttttgtcgatgtgctgaacgaagattacatgcgtactgcccgcgctaaaggggtgagcgagaagtggatcatcctcaagcatggtctgcgtaatgccatgatcccggtggtcaccatgatgggcttacaattcggctttctgctcggcggctcgattgtggtggagaaagtcttcaactggccggggctggggcgtttgctggtggactcggtggaaatgcgcgattacccggtgatccaggcagaagtgctgctcttctcactggaatttattcttatcaacttagtggtggatatgctttacgccgccattaacccggctatcaggtacaagtaaggatgcgacttttaaactggcgtcgtcaggcgatattaaaggccatgcccggtctgaaaccggaccatgtgcgtacgccgtggcatgagttctggcggcgatttcgtcagcagccggtcgccatggcggcggggctgtttgtggtattactgattgtggtggcggcgattgccccctggatcgcgcctttcgatgcggaaaactatttcgactatgaccgcttaaacgacgggccttccatgctgcactggttcggcgtcgattcgctggggcgcgatattttcagccgcgtgctgaccggagcgcagatctcgctggcggcgggcgtcttcgcggtgctgatcggcgcggcgatcggcaccgtgctggggctgctggcgggctattacgagggctggtgggatcggctgatcatgcgcctgtgcgatgtgctgttcgcctttccggggattttgctggccatcgcggtggtggcggtgatgggtagcgggatggcgaatgtgatcatcgccgtggcggtgttttccattccggcctttgcccgtctggtgcgcggcaatacgctggtgttgaagcagcagacctttatcgaatcggcgcgcagtatcggggccagcgatgccaccattctgttcagccacattctgcccggcactatttcgtcgattgtggtctatttcactatgcgcatcggcacgtcgattatctcggcggcgagcctgtcgtttctgggcctcggcgcgcagccgccaacgccggagtggggcgcaatgctcaacgaagcgcgggcggatatggtgatcgcgccgcacgtggcgctcttcccgagcctggcgattttcctgacggtgctggcgtttaatctgttaggcgatggtctgcgggatgcgctggatccgaagataaaagggtagttacccctcaccccggccctctcccacagggagagggtgaattcagcactggacgatcccctctccctgtgggagagggttagggtgaggggagttaaacccgcgtaccccacagatcgtactcgtcggcgttttccactttcacgcggatcacatcgcccggcttcacgttagtttcgccgttcaggtacaccgcgccgtcgatttccggggcgtcagccatgctgcggccaatcgcgccttcttcatccacttcgtcgatgatcaccatgatttcgcggcccactttctcctgcagacgttcagcagagatctgctgttgcagctgcataaagcggttccagcgctcttctttgatctcttccggcacctggtccggcagctcgttagcggttgcgccttcaaccgggctgtatttgaagcagcccacgcgatccagacgcgcttcggtcaggaaatccagcagcatctggaaatcttcttccgtttcgcccgggaagccgacgataaaggtcgagcgcagggtcagttccgggcagatttcacgccactgtttgatacgcgccagctggcggtcaacggagccaggacgcttcatcagcttcagaatacgcgggctggcgtgctgcaacggaatatccaggtacggcaggatcttgccttccgccatcagcgggatcacatcgtccacgtgcgggtaaggatacacatagtgcagacgtgtccagacgcccagcttcgacagctgttcgcacaggctgaccatgctggtcttcaccggctcgccgttatagaaaccggtgcggtgcttcacgtcaacgccgtaggcggaggtgtcctgggagatcaccagcagctctttcacgcccgcgtccaccagacgtttcgcttccgccagcacgtcgccaatcggacggctgtccagatcgccgcgcatcgacggaataatgcagaaggtgcaacggtggttacagccttcggaaattttcaggtaagcgtaatggcgcggcgtcagcttcacgccctgttccggcaccaggcttaagaacgggttatgcttcggcttcggcacatagtggtgcacgtgttccagcacctgctcatagctgtgcgggccggtgatttccagcaccttcgggtgcacttcgcggatctgatccactttcgcgccgaggcagccggtgacgatcaccttgccgttttcagtcagggcttcgccgatggcttccagcgactcctggaccgcgctgtcgataaaaccgcaggtgttcacgatcaccatatcggcgtcgtcgtaattaggcaccacatcgtaaccttcagtgcgcaactctgtcaggatgcgttcagaatccaccaggtttttcgggcagccgagggagacgaagccaatacggggttgttgcatgctcatacgctcacaaagtaaacaggaaaataaaaaccgggcgattttacacgggttttgggcggcgctctacttctgattcgggagggcgaaggttttaacgggttaatgcacggtaaaaaaatgttaacaagactacaattattgatctggtgcatgtatctggctaaaaagtgaacttaagataaatttacaccctgtttgataagtgagaggaggaaggcgatgaacgttgacaggcttcagctccatctgatggagaaactgacccacgccagactcgaactggctgcttacgtccagcttcttaaggcgaaaggctatatgtcggtcagcgaaagtaatcaattacgtgacaacttctttaagcttgccactgaaatacgcgatctggcggagcagccatctgccccctggacccgtcatgagtgggaagcgttgcgacttgcggagggcgcattgtcctctgcggcggtttgcctgatgagcggccatcacgacagcccgacctttatcgcggttaatgccgataaacttgaccgctgcctgaatgccctgaacacctgcattgatgggctggacgagcatacttccctcgaagaggcctgatccccggggggaggcgactcccccttcagtttgctgaagttaaagcttttgtaaaagtcaaagcgcagccgtcctgactggctaatctttatccagtgcgattaaaggagagcaatatgcgccgttcccccctgctggtcattcctgccctgttattgagcacatcaatatttgccgcccctgcgccggtcaaggttgatgccctgcaaaccaaacttgatcacccctggtcactggcgtttttgccggataacaaaggcatgctcattaccctgcgcggcggccagttacgccactggcaggaaaacggcggcctgtcagatccgataagcggcgtaccccgcgtctgggcgaacggccagggcggattactggatgtggcgctggcgccggattttgccagttcccgccgcgtctggctgagctacgccgaagccgacagcgacggcaatgccggtacagcggtaggctacggcaaactgagcgacgatcttaagcggctggagaatttccagacggtgttccgccagacgccaaaactctccaccggcaaccatttcggtggacggctggtgtttgatggtaaagggcatctgtttatcgcgctgggggaaaataaccagcgacccacggcgcaggatctggacaaacaccagggcaaactggtgcgcttaaccgaggatggtcaggtgccggaagataatccgtgggccggtaaagccggtgcgcggccggaaatctggtcgtatggcattcgtaatccgcagggcatggcgatgaatccctggagcgatgccctgtggcttaacgagcacggcccgcgcggcggcgatgagatcaatattcccgaacgcggcaaaaactacggctggccgctggcgacccacggcattaactacagcgggctgaagatcccggaagcgaagggcgagatcgtggaaggcaccgagccgccgatcttttactggaagcagtccccggcggtaagcggtatggcgttttataacagtccgactttcccgcagtggcagaacaaactctttatcggcgcgctgaaggacaaggacgtgatcgtcatgagcgtgaacggtaataaagtcagcgaagacgggcgcattctcggcgatcgcaatcagcgtatccgcgatgtgcgcgtcgggccggacgggtatctctatgtgctgaccgatgagtctgatggcgagctgctgaaagtcagcccgcagacctgatttgcgcgccagcagtaccggcgcgcagggaaggttaacgcatcacgcgtttcaggatgcggttggcctgctgttcaaaatcgctggccgcctcctcgacgctcattttgccgtagtcgagcttttcacgtacggcggtaaagagcgcgccaaactgcatatcttccatatagggggtggcgacaaagttattcggcagggcgtaggactgcaacagcccggcgatcaccggatcgctgtccagcaaaatgcctttttcccgcagcagtttatccgccgcctgactcaaaggcgcgccgcgctccagccccaccgggatcacgccttccggctcgttcaccagaaagttcagcagcagcgccgcctcttttgggtgcttcgtggtacggcctatcgagtacatgatcgccgttttccggaactgtccggcatctttcgcccctggcaacagtggataggggcctggcaccagatcggcgggatttttcagcgtcacgctctgcgacgggtagagcacgttccagttatagctgcccgcccattcgccctccatccagggtttcagctcataaatcggcgtgcttttcgcgccgtaggaggccagcactttggtatcgggcagtacatggttatccaccagctttttatagaaaccgaatgccctggtaagatcggcccgatcccaggccagacgttttctgtttacgtcgatcatcggcttttgatcctgctgatacatccacgaaaacaccagcaacatacagtcctgctcgccgacgtagatcggataggcgttatcgccgagcttttccttaaataccgtccctgccgccagcagttcatcccagcttttcggcagcggcagcccggccttctgccagctggcctgattgtaatagaagcccattacgttggtggacaacggcagggcgttgagcttgccgttgaccgtggtggtggccagcgcggcaggggaaaactggtttagatcgagcgtacccgcaagctgattcagatcgtaaaagccatcgccttttctggacattagcgtcagccagttccagttggtctggatcagatcggcttccgttccgctgttgatctgcgtggtcagccgtgagaagtagccttcccagccggtatattccgctttcaccttaatatccgggtacttcgcttcgaaagcctgcagggcggcgagcgtcgcctgatggcgatctttgccgccccaccaggagaagcgcagcgtcaccgcatcggcgctgaacgcgggggccaccgcgctggcgcagcaacaggcaataaggagaggtaagagtcttttcatgattcactcctcattaccgaaggcgtactgctggatctgctgctggcgggcggtcaggcgtttgacaaggtgcatctcctgctcgcgccagggttcgccttccggcgtcagcacatcgtgaaaccacagcgactgcggatccggatgggttttattcacccccggccacggcagccaggtctgggttttgccctgcaccagcccccagtgataacagccggtctgatagaggctgaacagcggcaactgctcgctgaacacgcagccggtatgacgtgaaagccactcggtgcacagcacgggccggtcgtactgcgccagcgaatgcaggatctccagctgcatcatggtcggcgcgtaggcgtgataagtgatgatgtccgactgctccagcgccgcgatatcaatggggtgcagaaaggctttgtttgccgccacgtccgcatgccatgcgccaatggtgagcggctgaacgggatccacatcccgcgcccagtcaaacgcgcgatagaccagctccagcgcaaagccctccagcgcctcgtcatattcggcatattcgaccggcgagacgaacagcccgcggttgccgggttcgttatagagatcccagatagtgatgcgatcatcgtcgccaaagctgccgatcaggtcgcgcacgtaggcttcgacgcgcggccactggcctggatccatgacgattttgcgtccggggctggccgccgcctggctgttatgcaccgccggtctggggggcttttgcggcccggtgaacggctcatcgcctgaaaaagcgcagtcatccatcagcgtcagcatgactttcagaccgtggcgggcggccaggctgagaaaggtatcaatacgcgacaacaggccatcgcggtcactttcccagacgataaacggcagattggtgcgcagactgttatagccgtagcgctccgcccagcccagctcctcatcaatggtgatcggatcgaaggtgtccgcctgccacatctccgtccagtttaccgccgtgcgcggcagataattaaagccgcaggcccagccgtgttccttataccagccttttgcctgctcactactccagcgtgttctcatgacgtcctccctggttgaatattattagctaatatttattagtgcgcgcagatagtgagcgtttttacgtcccgatactgttattccattcacaaaacagcgatccggaagaaggagcctgatgtggtatagtcaggcggggcttgaggacgaaaaatgcagaagaaaaataaaattaccatgggcgatattgcccgcctggcgggcgtttcccaggcgacggtatcgctggtgctgaataacagccgcaccatccggttaagcgacgccacaagagagcgcgtgtttgatgccgcgaaaacgctgggttatcagaagctggcggtgcagcaccgcccggaagggcaggaggaagtggcgctgctggtgagcggtatgcccggctacgatccctttggcgatgcgctcagtgaagccagcgcctgtgcctggcagcacgatacgctgttgtcagtgtacgattacggcgaggacagcgagctggcgcggcatatcctgcgtcagctggccagccgccgttgcgccggggtgatttttgcaagccccgtgacgcgcccctttgatttctcgccgttcgagggcgtgtgcgattttccggtcgtgctgcttaatcagtacgacgaacagcgcccactgctgcccacctttttacccgacgatcgcgccaacgcctgccagataacacagcatctgctggatcagggggtcacccgtatcgcccatatttccggtgatgaatggatggatgccagcaaggaacgtctcgaaggctatgagcagacgctgcgccacgccgggatcgaaccggatgcggcgctggtgcataaaaccgactggtcgctgaacgcgacttttgccgccacgctggaactgatgcagttgccgcagccgccgcaggcgatcttctgcgccagcgactggatgacgctcggctgctatcaggcgctcgccacgctggggaaacgtattccggaagatgtgctggtatgcggctacgacgatcagcgcatttcgcatcagctgacgccgatgctcaccagtatacagctggcctataacgaactgggcagaatggcggtggagtatctgtgcgccggggaagatgccgcggcgcacattaagctggtgggaaaattgcaggttcgcgccagcagtcagcgcatcaggtgatcgggatcatcaccacgctctgcaccgtcgggcgctcgcacagctgctgataccagcgcgtcaggttcgggcgcggcgtccaggcggtgtgcacattcagcaggctgtaaacaaagggcgcgagggcaatatcccccagaccaaactccttgccggagaaccacggcgtgctggccagcgcctcgtcgaggatgccgagcaggccatcacaatcggcaatcgcctcgtcaatggctgcccgatcgcgctgctccggcggggttctcaccagtcctttaaggatcacgctgtggcggggcgccagcgtagtcgctgaccagtccatccacttttccgcctgcgcacgggcagccggggcgtcgatccataagcgtccctgaccatactgcgcggccagaaaacgcacgatggtattggattcccacagcacgctgtcagtttcgtcatcgcgcagcaacggcaccagaccgttcgggttcatcgccaggtattccgcatcatgattcagaccgtactgtaaaccggccagaatttgcgtgtaaggaagttcaagctcttccagcgtcaggcggacttttttgacgttggtggaattatttcggccccacagggtaatcatataaattccttctcggtggacagcgggaacgcgcgccaggcacgtctgatcctctatgttgaaataaatttaacattcaggcaacgacttacaaaaaaaatcctccacttgcggcgtcgatcccgtaatttgcataaactttaaaaaactttaccggttaatgattggtttccatgcctgagtacgttattactcaccgtttattgcgaagcggtgacgtgacgcgatttgttttgaatggatacacgggtggcatttatgacgcatttcgctttatccctgcgcggcctggcggcgggctctgcgctattatttcttttctccccttcgctgtatgcggttgaacaggttccggcggcaccggcagtggatgcccgcgcctggatactgatggactatgccagcggtaaagtgctggcggaaggcaacgccgacgagaagctcgatccggccagcctcaccaagctgatgaccagctatgtggtcggacaggcgctgaaggcgggaaaaattcatcttaacgatatggtgacggtaggcaaagacgcctgggcaacgggcaacccggcgctgcgcggctcgtcgctgatgttcctcaagcctggcgatcaggtgccggtttccgaactgaataaaggcgtgatcatccagtccggcaacgatgccagcatcgccatcgccgactacgtggcgggcagccaggattccttcgtcagcctgatgaacaactatgcaaaacggctggggctgactaataccacctttaaaaccgtgcacggtctggatgcgccagggcagttcagtaccgcccgggatatggcgctgctcggcaaagcgctgatccacgatgtgccggaagagtacgccatccataaagagaaagagtttaccttcaataatattcgccagccgaaccgtaaccgtctgctgtggagcaccaacctgaatgtcgacggcatgaaaaccggcaccacggaaggggcgggctataacctggtggcctccgcgacccagggcgacatgcgcctgatttcagtggtgctgggcagtaaaacggatcgcatccgctttaatgaatctgaaaagctgctgacctggggcttccgcttctttgagaccgtcacgccaattaagccggatgcgacttttgtcagcacccgcgtgtggtttggcgacagcaaagaggtgaagctgggggcaggcgaagccgggtctattaccattccgaaaggtcagttaaagaacctgaaagcgacctggacgctgaccgagccgcagctgaccgcgccgctgaaaaagggccaggtggtgggcacgatcgatttccagcttaacggcaaagtgattgaaaaacggccattgctggtaatggaagcggtggaagagggcggtttcgtcagccggatgtgggactttgtgctgatgaaattccacgagtggtttggcagctggttctcgtaaccggaccggtttttttgttgccgggtggtggtcacgcttacccggcctacggaacatgtgtaggcccggcaagcctgcgccgccgggcaactcaacccgcactatgcgtctgaatacatcaacgtgatctgtttcgctttcgccagcgcgcataacgcctcgtccgggcggcggtcgctgacgatggcgtcaaaagcgtccagatcgcccatacgcgccgggcgcactttatcaaacttactgtgatccaccaccagcacatgatactgcgcatgggccatcgcccagtgcttcaccggtaactcttccagattgaaacaggtcgctccctggaccgggtgcacgcccgccgctgaataaaatgccagatccgggcacaggttattcagcgtctcgttaaagttcagcggtttaaaaatcgcattgctggcgtggaactcgccgccgcagaggatggcccgacacaagggcttttcctgcaacgccataaaagtattcagcgagtagcaaatggcggtaaagggcagatcctgaggaatggcgtcaatgatccagggcgtggtggtaccgcagtcaaaaaataccagttggtgcgcctgcaccagcttagcggcatattgcgcggccagacgcttttcatccaccaggcgggttttctgatcgcttaacagatagtggctggcggtacgcggctccagcacgatataaccgccaagcaggaccacaggcgcattgcgggcgccgagatcgcgacgaatggtcatttctgaaacgcctaataacgccgccgcctctttcaggtgcagcttgtcggtacgcttcagcgcctgtaacaacaggcctaaacgctcgtcacgtttcgtttccataaatcccctggcatgatgaaaaccccgctcgctgcggggtgctcaatcttacctgtgccggcaggcttagtcacgcacccagcctttgcggatcggcagagcaaaacagacgcggtaagcccgttgcagggcggcgtataacgactcgccgaacgcctgccacagcatctgcgccgtcagacagccgctgatgcccaccagcaaaccgcccagcatatccagcggccagtgcacgccgagatagacgcgcgaccaggcgatcagcagcgccacgcccatcatcgccacgccggaccagatgcggtgccagaacaaaaacgccagcgcaaaggtaaaggcgacggtgccgtgatcgctcggataggaatcatccggcgcgtgatgcaggaagttatagcccacgccctcgacaaacggacgatcgtgggggaaaacgtgccccattacccaggacaccacaaggctgacgacgatcgccagcgccattttaaccactaactgccgctgggcaggcccccacagccaaagcaccacggccagcagcggcacgatgtggatcagatcgcgggcaatgagaatggctgcctggatcagccaggcgggggagtccggcgtcgcattcatccaggcgaacagggtataattcagatcttccagcatcgtattgtcactcttttgccgcaggctacctgtagtggcgcgttgaaaaagggatcaccttaggatcaccgccttcgccggtaaaccagttttgtcttagttgtccggcgcttgtgagcaaccggaatgaacactctgcgataagagcatgccggagcccgcttaaaccgtggcaaaatagcccacgggaaaacggcggttaatgccgtaaaatgtgcgaaactttgtgcaggtcgcaaaattcgctgttacagggacggcgcattcattacactttgcgcgatttttcaggataaaaaatttcatgccaaaccatgctttacctggccgccgtttaggacgccaggcgttgttgtttccgctctgtctggtcctgtacgaattctcaacttatatcgcgaacgacatgatccagccgggcatgctggcggtggttgagcagtacaacgccggcattgagtgggtgccgacctccatgaccgcttatctggcggggggaatgtttttacagtggctgctggggccgctgtcggatcgtattggccgccgcccggtgatgttaaccggcgtggtgtggtttatcgtcacctgtctggcaaccctgctggcgcaggacattgaacagttcactatcctgcgctttttacagggtgtgagcctgtgctttatcggtgccgtgggctatgccgccattcaggaatcctttgacgaggcgacctgtatcaagatcaccgcgctgatggcgaacgtggcgctgattgcgccgctgcttggcccgctggtgggcgccgcctgggtgcatgctgcgccctgggaggggatgtttgtgctgttcgcggtgctggcggctattgcctttttcggtctgcatcgcgcgatgccggagaccgccacgcggctgggggagccgttatcccttaacgcgctggggcgggattataaagcggtaatgaaaaatggccgcttcgtggcgggtgcgctggcgacgggtttcgtcagcctgccgctgctggcgtggatcgcccagtcgccgatcatcatcatcagcgccgaaggcatgtcgagctacgagtacggcctgttgcaggtgccgatttttggcgcgctgattattggtaacctggtgctggcgcgcctcacctcgcgccgtaccgtgcgctcgctgattatcatgggcggcgggccgattgtgggtggtctgctgctggcggcggtggcaaccgtggcgtcatcccatgcttatttgtggatgaccgccgggctgagtatttatgcctttgggattggccttgccaatgccggactggtgcgcctgacgctgttcgccagcgacatgagtaaaggcacggtgtctgctgccatgggcatgctacaaatggcgattttcaccgtcggcattgaggtcagcaaacacgcatttctggcagggggtaacggtctgttcagcctgtttaatctggcgaacggcttgatctggctggtgctgatggtggtgttcctgaaggataaatccgtcggtaacgcgttgtcataggctgttaaaactgtaagcccggcaagcttgcgccgccgggcaaatcaggactaattctcacacggctgattttgtggctcaggtttcgccaccgcgcgggcaaccagcgcggcaatgatcaccagccccagcaccaccatcatcgcgctgcgcagaccatagtgctcgccgaggaagccaagcagcggcggtcccaccagaaacgccagatagccggtggtggcgaccacgctgacgcgcgtcggcgcatccgggccggtatcgctggcggcggaaatggtcagcgggaagccgagtgatgcccccagtccccacaaaatcaccgacacgcccgccacccaggcgctgtccacaaagatgatcaacgcgatgcccagtgcgcccatcaacgcactggcgcgcaccaccgcgacgcggctgtagcggtcgataaaccagccgccggtaaagcgtcccacggtcatacccagcgtaaagcctgtatagatgagcgagccggaggtcgggctgaacccgtgcccgtccaccatcagcagcggcagccagtcattggcggaaccctccgcaaaggccatcgccagcaccaccacgccgatcagcatcagctggacatcgcgataaaaaggcacgcctttcccgccctgaccgttctcctcagcggagcccttgccggtgccgtccggtatggcagtgatggcgataataatcggcataatggtggccagcgccgccagcagaatatgcagattagcgctcacgccgagcgccgtcagccccatgccgacgcctgcgcccgccagggtaccgaggctgtagaagccgtgcatcatcggcagcacggttttatccagcgcctgctccactgccgcgccttcgacgttgatcgccacttcggcagagccgaggctcgcgccaaatactgccagcccgcaggcgaacagcagcggcgacgcgaaccacagcgccacgcttaagataatcataccgaccacgctgaaggacatggcggtgcggataacgctgcgggtgccgaagcgcttaaccagccagccggaggagaggacgccgctcatcgagccgacggacaaaccgaacagcaccacgcccatcccggctgtagaaacagacagggtgtcgcgtatcgcgggggtacgcgtggcccaggaagccattaacaggccgggtataaagaaaaacataaataacgcccaggtgcggcgttgcagtgccttgcggggcgagtgcgtcagtgcgttcatgcaaaatctccgttgtgaagcaaaagtgtacggcattctgcaaaagagggtaaacccgcaatgttaattattattgaaccgttgccgggcgtttttccgcaggcgcaaagcgggttttaccgtgcgcatgctcgccgccgccctgtccacgcttaagctgtatcacttcgccacgctgccaggcatcggcaccgggggcgaccgggtgcgcatccagatcgcggcgcgattcgcggatttctttcgtattcacgtcaaaaaggcgatcgcgttcggcaagcagggcgggatcaagctggccgtcagcggtaaagcccatcatcagcgccggaatgcccagcggcagggttttgtcgcgatcagtgtgccaggtgtgccaggttttaccgtaggtattaacgattttgcccatcagcgctttttccgcaggcgcaggcaggccaggaccaatcaggctgccggacatcacttcatgccggtggctgtgccagagctttttctcttcaggcggaagggtattgaacagccgctcgctgataatgtattccacgcccatgagtttggcatcgcgggtattaccgtcgtaaatcactgcctgcatcacgtcttcgtttaacacggtgacataatggtgcgcttccatctgtccgttctgatcgccattataaaaatgaaatccgtcgagataagtattgatggcgtcgatcggcggcctggactgcatcacgctggcaccggattccagcagctgcaatttaccggaggtttcagcgccaggcgcggtgacttttgatggtgaactgctgccgccgcagccggaaagaaccagggcggtaaggatgtacagggggaatttcatgtcagctccgtaagactgttcagggtctaataaccttagacggtaatgggatttacggcaggagagtgatgaagaacatggcatcattagcgtttctttataattatgtgagatagctttcagcttttttgtgttgctcaataatatgtttccgaactactttccgataatacagcgtcagtatcgcgctgattgccagccaaaataaacctgtttcaaacgtactcagtgcggcgtagagcacggttttgctcttctcaaaatttgtaatctctttcgaaatgtaccgggtatgttcctttttcctgaacatgtcgcaaatgaaacccgtcagatccgcagacagtctgcttcgctgcgacagggtgttaaccggtgtctggtcacattgctcagtcgttacggctaaggaatgaccggaaaatagtgatgccgattttgcactgtcatgggttaaataaaagaattcattggtgggcttatacaccagcaaagtccagttctgcggtgtaagcagggttttaatgtgcatagcggagagatatgacgccgaacccgcgccaaagatgataagcagaaaaccaaagaatagatcggttcgggtatttttcgggatcgtctttaagggaaggctgacataaaagagccgtagcggccatgccggaatacctgcctgcaaaagaaattccgatttgcctttaatgggagccgtaagaaactttcttatcagaaggaatgcagcgtaaataccaccaattaagctgaagatgccggtaagtgtacccaccggagaggtaataaattcgttggtgataatatctgcgacagaatcaaaactcttcatagtgcctccttgcctggtaatgaaggtgtccggaagaggggggacgcgcctgaggttcaggttatcttgtcacaaatttcaggcaataaaaaacccatcaaccttgaaccaaagatggcggggttgatgggctccacaaaatggggacatcaaagaaaagcagtggcaatagttatgactggcgctttgcggaaaagttctcgcgaaagcataaataatttgccactccggtcaggttgagacttatcctagccccggccagataatgatgatcagcgtaccggcaagggtcagcagcacgttggcgatggcgtaggtcccggcgtagcccagcgcggggatgttactgcgcgcggtgtcgctgatgatttccatcgccggggcgcaggtgcgtgcgcccataatggcgccgaacagcagggcgcggttcatgcgcagcacataagcgccaaacagaaaacagatcaccaccggcaccaggctgaccagcaaacctgccgccagcatctggccgccgacagcgccaagcccgtgaccgatgccgctccccgcgctcagcccgacgcctgccataaataccatcaggccgaactctttcaccatattcagcgcgccctgggggatgtaaccaaaagtcggatggttagcacgcaggaagccgagcatgatcccggcgaacagcagaccggcggcgttcccgatgccgaagctgaaattgctgaactggaaggtgatcatgccgatcatcagcccgacgataaagaaggcgcagaaggccagcagatccgtgacctggctgtgaatggagataaagccgatgcggtcggcgatagttttcacccgtcgcgcgtcgccgctcacctgcaacacgtcgcccttgttgagcagaatgttgtcgtcaatgggcatctcaatctggctgcggatcacgcggttaaggaaacagccgtgatcggtcagctttaactgcgccaggcggcgacccacaacgttgtggtttttcaccacgatctcttcggtgacgatgcgcatgtccagcaggtcgcggtcaaacacctctttaccattacggaagctcggatcgagacgcgcatgggcatccgggtagccgaccagcgcgatctcatcgcccatctgcaataccgcatcgccatccggcgcggccaggatgccattgcggcggatgcgctcgatgtagcagcccgtctggcgataaatgcccagctcgcgcaggtttttaccatcggcccaggccaccagctccggccccacgcgataggcgcggatcaccggcagatagactttgcggctggcgtcggtatccaggccgcgctcgcgggcgatttgctgggcgctggtctgtaaatcctgatgttgcagtttaggcagataacgcgcgccgacaatcaggctgaccagtccaatcaggtaagttaatgcgtagccgaggcttaaatgatcgagcgcggaggaaagttgcccgctgtccatacccgagtggcgcagcgtgtcgccggcacccaccagcaccggcgtggaggtcatggatccggcgagcatgccggccgtcaggccaatatcccagccgaataatttacccagaccaagagcgataagcagcgcgctgccgaccatcaccagcgccagcatcagatagtttttgccgtcgcgaaagaaaattgaaaaaaagttgggtcctgcttccacaccgacacaaaaaataaacagcataaagcctaaattgagcgcgtcggtgttaatcgcaaaatgctgctggcccagtaataaagaaacgactaaaacgccaatggaattacccagttgaatggagccgaggcgcaattttccgaggcaaagcccgagagccagtaccacgaataataacagtatgtaattcccatttaacaaatctgcgacgtttatattcacggagtctaacttcttgtttacttgtaagctgttgaaagaaataataaattgcgctaatgttttgcttaaggccagacgttaattaaaacaaattcactgaccaaaaatagcctgcaaacataatcaggccgtagtttagtcttattaagaaaccacggctagtcagaatcgtgcatgtaagtgggtgggtaatttggcaaggattgctgcatagctttatctgaccgggcgttccgaaggaacgcacgaggcgcttgatagaggcagtgtcaggaggattgtttgaaatctaaacgtggttgggcaagcgcgttttgctgctttctgctgtttattgtggtgtgtctgtcactggcgctgaagatgaaaggggcgtttcgcgcgtctggtcatccggagctgggcctgttgttttttgttatacccggtgccgtcgcaagctttgtatcccgtaagcgtcaggtactgttgccgctgatgggagcgatgctggccgcgccgctgtgctttgtgctgatgcgcatggttatcgcgcaggagcgtgaattctggcaggagctggcgtggttattcagtgcggttttctggtgcgcgctgggggcgctgtgctatctgtttgtcagtagcatgatgagtaaaaaggggcggagttaacgccccttttttattactgttaagcgaacaggccaagattggctctggcgtacgcttcaaaatcagtgcagccgccaatgtgtttctgatcgaggaaaatctgcggcacggtttctaccggcttaccgacggttttttccagatcggctttagtaataccttccgcgtgaatatccacgtagcgatagttaaaatcatcgcgctcagcagttaatttttctgccagttctttagcgcgtacacaatacgggcatcccgggcgaccaaaaattacagcgaacatacactctccttaatgcttgaggcctgacggcgaatgaaaccatcatgacgactatggtcaggcagggaaagcaggttttacctgttggtctgataccgtaaggctatgtttcgccaaaagctgtcagataatttcatctataatctcatccttttttacccggagagatgtaatgaccccgactattgacctgctgcttgctcatcgttccattcgccattttaccggtgagcccattacccgggtgcagcgcgatgccattattgccagcgcacaggcggcgtccagctccagctttttacagtgttcttccattgttcgcttaaccgatccggcgctgcgtgaaaagtttgtcaccctgaccggcggacagcagcatgtggcgcaggcggcggagttctgggtgttctgcgctgatttcaatcgccacctgcagatctgcccggacgcgcagttaggcctggcggaacagctgctgcttggcgtggtggataccgcgctgatgggacaaaacgccatgacggcggcggaatccctgggtcttggcggcgtttacatcggcggtatccgtaacagcattgtggaggtcacggaattactggcgctgccgaaacatgtgctgccgctgttcggcctgtgtcttggctggcccgcggataacccggacgtgaagccgcgcctgcctgcggccatggtggtgcatgagaatcgctaccagccggtggatgatgctttacttgcggcctatgacgatgaactggcggagtattatctgacccgcggcagcaataatcgccgcgatacctggagcgatcatattcgccgcaccatcattaaagaaaaccgcccctttattctcgattatttgcatcagcagggctgggcaacgcgataaatcacgttcatcctgcgcgcgcctgcgtgtattatacgcaggcttttccaggtcttgtcagagaggtgcagggtgaaaattgccatattgtcccgggatggaacgctctggtcgtgcaaacgcctgcgcgaagccgcgatacgtcgcggtcatctcgtcgagatcctcgatccgctgtcctgttatatgaatatcagtccggcggcgtcgtccattcattataaaggccgtcagctgcccttttttgacgccgtgatcccgcgcattggctcggccatcaccttttacggcaccgccgcgctgcgccagtttgaaatccttggcagctttccgctgaatgaatccgttgccatcacccgcgcccgggacaagctgcgctcgctgcaactgctggcgcgccagggcattgacctgccggtgaccggtatcgcccactcgccggatgacaccagcgatctgatcgacatggtgggcggcgcgccgctggtggtgaagctggtggaagggacgcaggggatcggcgtggtgctggcggaaacgcggcaggcggcggaaagcgtcatcgacgcctttcgcgggctgaacgcgcatatcctggtgcaggagtatattgaggaagcgaagggaacggatattcgctgcctggtggtgggcgatgaagtggtcgcggctattgaaaggcgggccaagccgggggatttccgctctaacctgcatcgcggcggggcggctacggtggcgaacattacgctgcgcgagcgggaaattgccattctggcggcgaaaaccctcggcctcgacgtggcgggcgtggatattctgcgggcgaaccgtgggccgctggtgatggaggttaacgcctcgccggggctggaaggcattgaaaaaaccaccggcgtggatatcgccgaccgcatgatcgcctggatcgagcgccaggccacgccggatttctgtctgaaaaccggcggctgagcggtttatcgacttcggcaatggtatggatcggcatttttgcgtaagctaatggccgcataattttttaagaggtagcacattctatggattcactcgtcgttcccggtctggacacgttacgtcagtggcttgacgagctgggcatcagtttttatgagtgtgatacctgccaggcattgcatctgccgcatatgcagaatttcgacggtatttacgatgccaaagtcgatctggttgacgacattattctcttctcggcgatggcggaagtgaagccctcggcgctgctgccgctggcgtcagatctgtcggccattaacgccagttcactgacggtgaaagccttcctggatatacaggatgataatctgccaaagctggtggtttgccagtctttattcgccgcgcctggcattacttttaaacagttctcctggtttatgcgccagagcgaagaacagatttccatggtgatccttgaggccagcgcgcatcagatgctgtttaccagcgaagaagaggatccgaacgccgacgccgcgccgcacaattttcttcactaagcgcccctgatttaaacgcagtcgctgccatggcggctgcataattcctcgttttattctgcttttaactattctttaaagaatatttcaccccacttcaggccgtttcggcttatcacatagactgatcgtgcataaaaaattagtaaaaggcgttttttaatctgacctatagcctcgaaccctggctacagttattcttgcggggcttcaatagcatgcagcgtctgccggataattcaaattatccgttgcagcggtgagtgacaaactatgcacgattcttgcatagcgtaaaggcgacgatttagttcgaatgttaacgaactttccagaaggaatgagatatgaccaccctgaataaaaaatggctgtctggtctggttgcgggtgcactgatggcggtcactgccggcaccttcgccgctgaacaaaaaacgctgcatgtctataactggtctgactatattgcgccggacacggtagcgaatttcgaaaaagagacgggcattaaagtcgtctacgacgtgttcgattccaacgaagtgctggaaggcaaattaatggccggcagcaccggttttgacctggtggtgccgtccgccagcttccttgagcgtcagctgaccgctggcgtgttccagcccctcgacaagagcaaactgccgaactggaagaacatggatcctgaagtgctgaagctggtggcgaagcacgatccggaaaacaaatatgcgatgccgtacctgtgggcgaccaccggcatcggttttaacgtcgataaagtgaaagcggcgctgggcaaagacgtgccgatcgacagctgggatctggtgatgaagccggagaacctggaaaaactcaaaagctgcggcgtggctttcctggatgccccggaagagatttttgccaccgtgctgaactatctcggcaaagatccgaacagctcgactgcctctgactacagcggggcggccaccgatctgctgctgaaactgcgtccgaatatccgttacttccactcgtcccagtatattaatgatctggcgaacggcgacatctgcgtggccatcggctgggcaggggatgtctggcaggccgctaaccgcgctaaagaagcgaaaaacggcgtgaacgtctcttacatcattccgaaagagggcgcgctggcgttcttcgacgtctttgcgatgccaacggatgcgaaaaataaagacgaagcgtatcagttcctcaactatctgatgcgtccggatgtgattgcccacgtcagcgatcacgtgttctatgccaacggcaacaaagcctccacgccgctggtgagcgcggaagtgcgtgacaatccggcaatctatccgccagcggacgtgttcgccaagctttacaccctgaaagtgcaggatccgaaaatcgaccgcgtcagaacccgtgcgtggaccaaagtgaaaagcggtaaataacgtcatttgaaacagttgcccggtggcgcttcgcttaccgggcctacaagatcgcaggaccgtaggccgggcaagcaaagcgccgcccggcgatacgcaccatgccggtgcgtttgcactcatatttgttctatgccggagagcaccccgtgaatgaggctaccccccgcccacaggcgaagtcccgcaaggcgttgacgccgctgctggagatccgaaatctgaccaaatcctttgatggtcagcacgctgtcgatgatgtcagcctcactatttataaaggcgagatctttgccctgctgggggcgtccggctgcggtaaatccacgctgctgcgtatgctggccggttttgagcagcccaccaccgggcagattatgctcgacggcgtcgatctcgcccatgtgccgccgtacctgcgcccgatcaatatgatgttccagtcctatgcgctctttccgcatatgacggtggagcagaatatcgcctttggcctgaagcaggacaagctgccgaaagcggaaatcgccagccgcgtcgccgaaatgctcagcctggtacacatgtcggaatttgcgaagcgtaaaccgcatcaactttccggcggccagcgtcagcgtgtggcgctggcgcgcagcctggcgaaacgcccgaagctgctgctgctggatgagccgatgggcgcgctggataaaaaactgcgcgaccgtatgcagctggaagtggtggatattctggagcgcgtcggcgtcacctgcgtgatggtgacccacgaccaggaagaagccatgaccatggccggacgtatcgccatcatgaaccgcggtaagttcgtgcaaatcggcgagccggaagagatttacgagcatccgaccacccgctacagcgccgaatttatcggttccgtgaatgtctttgaagggctgctgaaagagcgtcaggaagacggcctggtgatcgactcgccggggctggtgcatccgctgaaggtcgatcccgacgcctcagtggtggacaacgtgccggtctacgtggcgctgcgcccggaaaaaatcatgctctgcgaagatccccctgccgatggctacaacttcgctttaggggaagtggtgcacattgcctatcttggcgatctgtcgatttatcacgtgcgcctgcacagcgggcagatgatcagcgcgcagttacagaacgcgcaccgctaccgcaaaggcttaccgacatggggcgatgaagtacgcctgtgctgggatgccgacagttgtgtggtactgacggtttaaggagcggcgatgagtatacctgaagcaccggctcgtgctggcaagccgggcggttttacgctgtggctggcgcggatgcagatgaggcacgggcgcaagctggtgattgccctgccatacatctggctgtgcctgctgtttctgctgccgtttttgatcgtattcaaaatcagccttgcggaaatggcgcgcgcgatcccgccttataccgatctgatggcatgggaagacgggcagctcagcctgacgctgaacattaataacttcctgcagctgaccgacgatccgctctattttgaagcctatctgcagtcgttacaggtggcggcggtttccacgctctgctgtctggcgattggttatccgctggcgtgggcggtggcgcacagcaaaccctcgacgcgtaacatcctgctgctgctggtgattttgccgtcctggacctcgttcctgatccgcgtttacgcctggatggggatcctgaaaaacaacggcgtgctgaataacttcctgctgtggctcggggttatcgatcagccgctgaccattctgcacactaatctcgcggtctatatcggtatcgtgtatgcctatctgccgtttatggtgctgccgatctacaccgccttaacgcgcattgattattcgttggtggaagcctcgctcgatctcggcgcgcgtccgctgaaaacctttttcagcgtcattgtgccgctgaccaaaggcgggattattgccggatccatgctggtgtttattccggcggtgggtgagtttgtcatcccggaactgctgggcggcccggacagcattatgattggccgcgtactgtggcaggagttcttcaataaccgcgactggccggtggcctcggcggtggcgatcatcatgctgttgctgctgattgtgccgatcatgtggttccacaagtatcagagtaaaggcacgggagaccacgcatgaacaacttaccggtagtgcgctcgccgtggcgtattttgatcctcgtgctaagcttcaccttcctgtacgcgcctatgctgatgctggtggtttactcgttcaacagctcaaaactggtgacggtatgggcagggtggtcgacccgctggtacggcgagctgttccgtgatgacgccatgatgagcgccgtgggattaagcctgacgattgccgcctgcgcggcgaccatggcggtgttcctcggcactatcgcggcggtggtgatggtgcgtttcgggcgttttcgcggctcgaacggctttgcctttatgatcaccgcgccgctggtgatgcccgatgtcatcaccggtctgtcactgctgctgctgtttgtagcgctggcccatgccatcggctggcctgcggatcgcgggatgctgaccatctggctggcgcacgtcaccttctgtacggcttatgtggcggtggtgatctcggcgcgattacgggagctggacaagtccatcgaagaagcggcgatggatctgggcgcaacgccgctgaaagtgttctttatcattacgctgccgatgatcatgccggcgattatttctggctggctgctggcctttacgctctccctggacgatctggtgatcgccagctttgtctccgggccgggcgcgaccaccttaccgatgctggtgttctccagcgtgcgtatgggggtcaatccggaaatcaacgccctggcgtcgatcatccttggcgtggtgggaattgttggttttatcgcctggtatattatggcgcgggcagaaaagcagcgagtgcgtgacatccagcgtgcaagacgcggctgatggcactaaaatctcgttaagaacgcaatgccgcgcctgtcgcggcatttttttcgcagggaagataacgcattggatttaatgagcaaaagaccagggatgcatgcccggctcaacgtcccggcgctggtacaggtggcggctatcgccatcatcaccacgcgctgcgttgacctgatcatgctcttcgacctgctgggcgtgcgcggcgtggtggactttgtccgtcgcagcgcgcagacctgggatctgacgctgatttttctcggcagtctggtgctgctgtttgtcgaattttactgtgcgttttccatgggcaaagggcgtaactgggcgcgctggctctatctctgctcgcagattgtggcgaccggttatctgtgggcggcatccctcggctatggctatccggaactgttcagcatcgccggcgaatcgaagcgcgagatcctgcactcgctgtttatgcaaaaactgcccgatctgctgatcctttttctgctgtttgtgccctcgccaagccgacgctttttccatctgcgttaacggtggtacaatcccggccccgcaaattttaaggttttcatcatgcagtgcgcactctatgacgccgggcgttgccgatcctgtcagtggatcgaacagcccgtcgcccgacaactcgatgccaaaatggacgacctccgcacattgctggaaggtatgcccgtagccgggtggtgcgcaccggtaagcggcccggagcagggctttcgtaataaagcgaaaatggtggtcagcggcagcgtggaaaaaccgctgctcggtatgctgcaccgtgacggcacgccggaagatcttaccggctgcccgctctatccggcctcgttttacccggtctttgcggcgttaaagccttttatcgcccgcgcgggcctcacgccctacaacgtggcgcgtaaacgcggcgaactcaaatatctgttactcaccgaaagccagcaggacggcggcatgatgctgcgttttgtgctgcgctccgacgccaaactggcccagttgcgcgcagcgctgccggaattgcaggcgcagctgccgcagctgaaagtcatcaccgcgaatattcagccggtgcatatggcgatcatggaaggggagcaggagatttttctcaccgggcaacaggcgctggccgagaactttaacggcgtgccgctgtggatccgcccgcagagtttcttccagaccaacccgcaggtggcggcaagcctttacgctacggcgcgggactgggtgcgggcgctgccggtgacgcatatgtgggatctgttttgcggcgttggcggtttcggtctgcactgcgccacgccggaaatgaagctgaccggtattgagatcgccccggaagccatcgcctgcgccagagagtcagcccgggcgctggggctgcaaaacatacagtttcaggcgctggattcgacgcgtttcgccaccgcgcagggggaagtgccggaactggtgctggtcaacccgccgcgtcgtggtatcggcaaagcgctgtgtgattacctgagccgtatggccccgcaatttattatctattccagctgtaatgcgcagacaatggcgaaggatttgcgcgaactaccgggttaccgcatcgagcgtgtgcagctgtttgatatgttcccgcataccgcgcattacgaagtgttgacgttattggtacgggagtaatgccgggtggcgctggcgcttacccggcctacttaatgatgttttccctggcccggcaagcggagcgccgccggggggaaagggcatcttactgcgggaaccactggtcgctgattttctgataagtgccatcggttttaatggctttcagggcggcgttcagtttttccagcagggctttattatccgggcgcacggcaataccgaggccggtgccgaaatactgcggatcggtcactttcggcgtggcggtgcccagctgcgggttggttttcagccattcgttcaccaccgcggtatcaccaaacacgccgtcgatacgaccatttttcagatcgataatcgcgttctggtagctgtcataggccacggttttcacttccggatgctgatcctggaggtatttctgatgcgtggtgccgttttccatgccgatgcgtttacctttcagctcttcaaaagatttaaacgcgccttttttggcaatcaccaccgctgagttggcgtagtacggctcggtaaaggccacctgcttgctgcgatccggggtaatgtccatgccggagatcaccgcgtcatattttttaaacttcagcgccgggatcaggctgtcaaaggcgtggttagtgaaggtgcactctgcctgcatctgtttgcacagcgctttcgccagatcgatatcaaaaccgacaatctgattgctggcatccagggattcaaacggcggataagtggcggaaacgccgaagctgattttgtcggcggcgctggcaccggctgcgaaggtggcaagaatagcggccagaactaactttttcatggtggaactcctgtctgtcagtcttattgtttttaccgtatctgcggcatgggttaaccatgccacttaatgaatttatatgcaatataattgattaattatatttctgcgggcgtaaaaaaggcgggttgccccgcctgtttttaagcattagtttcgccgttcaaaagccagcgcccgacgctcgataagacgcatcattaacgtcagtaaaccatttacaatcagatagataagtccggctgcgccaaacaccatcacatcatacgtccggccatacagcagctgtccgtggcccatgacttccatcagtgtgatggtatatgccagcgacgtgcttttgaatactaataccacttcgttggagtaggacgagagggcgcgtttaaaagcgtacggcagcagaatcgccagcgtatcttttttactcatccccagggctgagcaggactgccactggccctccggaatggcgcgaatggccccgtaaaacagctgcgtggtataggcggcgctgttcagcgacagggccagcagcgcgcacagccagggttcggagagcagatgccacagtaccggatattcctgtagcgtcgggaactgtcccggaccgtagtaaatcaggaagatctgcaccagcaacggcgtaccggtgaacagcgtaatgtaaccgcgcacaatccacaccagcaccggcgttttcagcgtcagcacaatggtaaatagtagtgccagcaccagcgccaccagaatggacgccacggtgagcgtcaggctggtgtgcagccctttcatcagttcaggtaaatactcaagcatcagtcggctctccgctcaaaacgtgtcgcgcgcaggtcaatgcgtttgaggatgtactgactgagcagggtaatgaccaggtaaatggccgccgccacgatataccaggtaaaaggctcctgagtacgggtggcgatactgcgggtctgcaacatcaaatcgttcacgctgatcaaggataccagcgccgtgtctttcagcagcaccagccactgattgcccagccccggcagcgcatgacgccacatctgcggcatcaccagacggaaaaaaatcgcgcttttcgacaggcccagcgcctggccggattcccattgccccagcggaacggctttcagtgccccgcgcagcgtctgggaggcgtaggccgcgtagagcagcgacagcgcaatgacgccgcacaggaacgggctgacatcaaagttttcaatctgcatttgcagcggaatttgcaccacgcccagattgagcgtgaagccgtcagataacattaacagcagctgtgaggagccaaaatagacaaacagcaccaccagaatttccggcaggccgcgcaaaatagtgaccagcgccgatcccgcccatgcgacgggacgccatttgacggattcccataccgcaaacagcatcgccagcgcgaggccaatgatcagcgcacaaacggcaaggccgacggtcatcccggcggcgcttgctaaagggaacatgtcattcatcaaggattacttctggaaccatttgttatagatgttctcgtaggtgccatctttcttcactttatccagcgcagcgttgaatttctgctgaagttcagtgttgccctgacgaacagcaatgccgaggccggtaccgaagtaatctttatcggtcactttgtcgcccacggcggccagcttgtcactggctttcagccactcggtcaccaccgcggtgtcaccgaataccgcatcaatacgaccattctgcagatccagcttcgcgttctgatagctgtcgtaaggcacggtggtgatttccgggtgcttatcggtgatgaatttctggtgcgtggtaccgttctgcacgccgacttttttgcctttcagcgcgtcaatgctggcgaatttacctttctgaccaatgaacagcgcggagttgtcgtagtaaggcttagtgaacagcacctgcttttcacgctccggcgtgatgtccataccggccatcaccgcgtcgaaacgacggaatttcaggctcgggatcaggctgtcaaaagcctggttggtgaaggtacaggtcgcatcgatctctttgcacagcgcgttggccagatcgacgtcaaagccgacaatcttgttactggcatccgtggattcaaacggagggtagcttgcttcggtggcgaaacgaatagtctgggcagcaccggcggagaggctgacgctggcgagcagggcggcaatcagtacttttttcattgtcatagtcccgaaaagatcagtgagataagtagtgtttaaaagcatcggtctgcggcgcggcaaagcggctggcatccccctgctcgataatatgaccattttccatgtacaccacgcggctggcggtcttgcgcgccacttccacttcgtgggtcacgatcacctgggtgatattggtttccgccagttcgcggatgatgctcacgatctgcgcggtgatttccgggtcgagcgcggcggtaggctcatcaaacaacagcacctgcggctccatcatcagcgcacgggcaatagccacgcgctgctgctgaccgccggagaggtgcagcgggaaacgatcgctgtagggtttgagacgcaaacgctcaagcagcttttcagcgcgcgccagcgcctgatctttgctcagacccagcacgcggcagggggcttcgatcaggttttgcagcacggtcaggtgcggccataaattgtattgctggaacaccatgccgacgttctgccgcaggctgcggatcgctttgtcagacggggcctttgagaaatcgaactgattgccggcaatagtgagcgtgccggagcgcggcatctccagcagattgagtacgcgcagcagggagcttttgcctgcaccgcttgggccaagcagcaccagcgtttcgccctcagggcaatccaggttgatatcgaacagcgcctgatgtgcgccgtagaaacagttaatgccgtttaattgaatactcatcgaggcaatctaatagctattgaggccgcaaatagtaacgttgacagaatagttatgcaatatttctgcgtgaaaaggtaaatataaagcgcatccagtaataaagttagcacaaaaccctggacgtggtgtgatgcaggtagaaatgtcggcattcaccgcggaatgccagacattttacgggggttaacagatttaacccgttaatgatgcataatttatcagcgatgctcgacagactgacgcagcgatccggcaggcgcgtgagcgttgccgcccagataacgcacatcatcaaccgcccagcactgaccttcacggatcatcagcacttcgtcctgccacgtctggctgccctgggtgagggtgacgcgcagcggaatattgcgggcatcggtgttagggatggttgaggcgctgctgacgctggcggtttccggctgggtggtgcggctggagaacggatcgctgcgcaggaaggcggtgtttttggtatcacggctggcgtcggccagcagcttcgccagatcgtcgctcaggtacggacgcagcgcggtagcatcagtgctgcggttctgaatacgaaaatcgtagaacttttgtgccacactgtcaggaccgccttcgacacaggggccgctgcgtgtgccaatatccttgaacgcgggggttaccgttgtacaggcgctcaacgccagcgcgcagggtacaatgacggataaaaatgagtagcgcataatgatttccttattaacctactgtctgttcaatgatagcgtatcggtttgattatgcgcgcgttaggcactgaacgttaaaaggagaagcaccatgcaattttcaaccaccccaacgcttgaaggccagccgattgtaaaatattgcggcgtggtcaccggggaggcgattctgggcgcgaatatcttccgcgatttttttgccgggatccgcgacattgtcggcggtcgctcaggcgcttatgaaaaagagctgcgtaaagcgcgggaaatcgcctttcgcgagctggaagaacaggcgaaagcgcttggcgcagacgcggtagtcggtattgatatcgactacgaaaccgtcggtaaggacagcagtatgctgatggtgagcatcagcggtacggcagtgaaaacccgctgatgaaaagctggtttgggctgattgcgctggcgctgctgctcaccggttgcgccagcgaaaaaggcgtggtggataaagctggctatcagctggatacgcgccatcaggcgcaggcggcctatccgcgtattaaggtgctggtgatccactacaccgccgacgattttgacgcctccctggcgacgctgaccgacaaacatgtcagttcgcactacctgatcccggcacggccaccgctgcatcagggcaagccgcggatctggcaactggtgcccgagcaggatctggcctggcatgcgggcgtcagcttctggcgcggcgcaacgcgcattaacgatacttccatcggcattgaactggaaaaccgcggctggcaaaaggttgccggcagcaagcgctttacgccctttgagccgcagcaaattgccgcgctggtgccgctggcgaaaaacatcatcgatagttacaacatacttccgcagaacattgtggcccactcggacattgcgccacaacgcaaggacgaccccggtccgttattcccctggcaggcgctggcgcagcaggggataggcgcatggccggacgatgaccgcgtagcgttttacctgaacggccgcgatcccgcgacaccggtcgatcaggcgcagctgctggatttgctgtcgcgttatggctatgaggtgaaaccggagatgacacccgcgcagaaaaagcgggtgatcgtggcattccagatgcatttccgtccggcgcgctgggacggtgtggcagatgcgcagagcctggcgattgccgaagcgctgctggaaaagtacgggcagggctgaacaggcctcagcggtgtaacttaccgtgatctttcagccacagcgccgtgcggcgaatgccttcatcaagcgtaacctgcggctgatagcccagctccgtctgcgcgcgtgacgtatccagcgtgaaatcaaagttcagcttcgccacgccgtagtgggtcagggcgggctctttcgcttttttatcgccaaaacgctccagactgcgggcgatcatatccagcatcggccacggcacggagcggatacggcaatcgatacccagttcgtcaattaatcgctgcacgatagtccgcagcttcaccggttcgccgttggtgatgttgtacgcccggcccgacggcagcgcatcgcacacctcctgacttgccagccacatcgcgtgcacggcattctcgaaataggtcatatccactaacgcatcaccgccgcgcggcaacagcacgctgcggtagtggtgcatcatctgggcaagacgcgggataaacactttatcgtgcggtccgaacaggctctgcggacgcagcacggtgaagcgggtgttggggttcgcctgcgccagcatatgcaccacgtcctccgccgccgctttactgcgggcgaattcgttggcgtagcgcaacggacggaaatcttcctgaatgttccggtgatggtgataatcaaaatagacggacggcgaggagacgtgaataaagttacgcacgccccaggccaccgcccactcacccagacgacgggtagcgcgcacgttagccagatcgaaggcttcctgggtgccccagggcgaggtaaagctggagcagtgccacagcgtatccacgcctgccagcatcacttttgcctgggaagagaccagctccgtcagatcggcctgtacaaattcagcgcccattttttgcagcagcttgcccatcgcttcattgcgacctgtcgccctgacgctgacgcctttctgccgcagaaactcgaccgcgtttcggcctaaaccgctggttgcgcccgtgaccagaaccttcatagcaatccactgtgttgaaaagaatttcgtgcgcattcttccgtgaaaaacggctggttgcaatgggaaaggtgaaagattaccgcttccattcagactttctctctattttgttctgtcgggcgcgtgatgtggccttccgcgccttagcgttgtaaaaaggcctgccagtgcgccaccagttccgtcagctgttcgcggctgacgtcaagatgcgttaccagacgcgtcaccggcgaggcgttcagcagcacgccgcgcgcctgcataaattcgcccagcgccgcggcatcttcttcgcccacgcgcacaaacagcatattggtttcctgacggctgacgtccgccccgatatcacgcagctgcgctgccagccaggcggcgttgtcgtgatcctctttcagacgctggacgttatttttcagggcgtacagaccggctgccgccagaaatcccgcctggcgcattccgccgccggtcattttccgccagcgcagcgcgcgtttgatgtagtcatggttgcccaccagcagcgagccaaccggcgcgcccaggcctttcgacaggcaaatggtgaaggagtcgcaatactgcgtgatctctttaagctcgcagccgtattccaccacggcgttaaagatacgcgcgccgtccacgtgcagcgccaggcctttctcacgggtaaagtcccacgcctgctgtaaatagtcgcgcggcagcactttgccgttatgggtgttctccaggctcagtaagcgggtgcgggcgaagtgaatatcgtcggctttgattttggccgccactttgtccagcggcagggtgccgtccgggctggcgtcgatgggctgcggctgaatactgcccagcaccgcggcaccaccggcttcatacagatagttatgcgcgccctggccgacgatgtactcctcgccgcgctcgcagtggcttaacagcgccaccagattcgcctgggtgccggtgggtaaaaacagcgcggcttccttgccgctgagttccgccgcgtaacgctgaagttcgttcacggtcggatcatctccgtacacgtcatccccgaccggggcggccatcatatagcgacgcatattgcgcccggggcgggtgacggtatcactgcgtaagtcgatcacggcatttccttattttgactcagaattgtccttctgttttacctgagccagttggttttcgccagttccatgacctcatcaccgcgcccgttgatgattgcgcgcagcatatacaggctgaagcctttggcctgctccagtttgatctgcggcggcatcgccagttcttctttggcgaccaccacatcgatcagcaccgggccgtcgatggcgaaagcgcgctgcagggcgtcgtccacttcggaggatttctcgacgcgaataccggtgataccgcaggcttcggcgatacgcgcgaagttggtatcctgtaaatcggtgccgtcagtcagatagcccccggctttcatctccatcgccacaaagcccagcacgctgttgttaaagacgatgattttcaccggcagcttcatctgtaccacggaaaggaaatcccccatcagcatactgaagccgccgtcgccacacattgccaccacctggcggtccggcgcggtggcttttgcgcccagcgcctgcggcatggcgttcgccattgagccgtggttaaaagagccgagcagacggcgtttgccgttcatcttcagataacgcgccgcccagacggtgggcgtgccgacgtcgcaggtgaaaatcgcatcgtcatcggcgtaatggctgatctgctgcgccaggtattgcggatgcacggctttttcgcttggcttcgccagatcgtcgaggcctttacgcgcatcacggtaatcttccagcgctttatcaaggaagcggcggtcggttttctcctccagcaacggcagcagggcggtgagggtggcgttgatgtcgccgatcagcgccatatccactttgctgtgcgcgccaatgctcgcggggttgatatcgatctggatgattttggcgtcggtcgggtaaaacgcgcggtacgggaactgggtgccgagcaggatcagcgtatcggcattcatcatcgcgtgatagccggaggagaaaccgatcagccctgtcatgccaacgtcatacgggttgtcgtactccacgtgctctttgccgcgcagggcgtggataatcggcgctttcagtttagcggcaaactcgatcagcggctggtgcgccccggcacaaccgctgccgcacatcagcgcgatattgctggagtagcgcaacagctgcgccagttttttcagctcctcatgcgtcggcgtgatcaccggctgcggcgcgtgataccagtgggcgctggcggtttcaggcgcggcctgaagcgcgacgtcgcctggcagtaccaccaccgacacgccgcggttgagaatggctttgcgcatggcgatggccagtacctgcgggatctgctcggggctggaaaccagctcgcaatagtggctgcactcacggaacaactcttgcgggtgggtctcctggaaatagccgctgccgatttcgctggacgggatatgcgcggcaatcgccagcaccggcacgcggttgcggtgacagtcaaacaggccgttgatcagatgcaggttacccggtccgcatgaaccggcacagaccgccagttcgccggtcaactgcgcttctgcaccggcggcaaaggcggcgacctcttcatggcgggtcggcatccattcaatggtgcccatacggttgaggctatcgcttaggccattcagagaatcgccggtgacgccccagatgcgttttacgccagcctgttcgagtgttttggcgacaaatgcggctacggtctgtttcataatgtctggtgtccttgttaaaagtctcgttaacaagcgtagatgaaaatggccgtcacacttttatcagccctacagctaacaggggtttatttccgccagcattcggaataatctgcaagccacataatgaaaacaggaatcatttcaaatggttaaatcaatgttaaatgcagttaacagaatgtttgcgcatgaagatgcgggcaagtttttactgcgtctgacggtgggcgggctgatgttatttcatggactgcataagctctttgacgggattgacggcatcagcggcatgctggtggcaaaagggttgccgggttttatcgcctacggcgtgctgctgggggaagtgttgtgtccgctgctggtgatcctgggcgtgctgacgcgtccggcggcgctgggcattgcgttcacgatggtggtggcgtggctgatggtcggcattaataaaaccggcgcgctggatgtgaccggcgcctgggcgattgaaagcctggtctatttctttgtggcgtcgatcgcggtggcgttgctaggcgcgggacggtattcctttgcgccctcggcagaatggcgttaatagccttgcccggcggcgcaagcttgccgggcctacaggtgtgcagttgtgtaggccgggtaaggcgtaagccgccacccggcatttttcagttgtccaggccgggtaaggcgtaagccgccacccggcgctatttattacgccaacactaaatcactctgcggatggcaggagcaggccagcacatagccctctgccacctccgcatcgctcagcgtcatgctgctggttacgctgtaatccccggaaagcacccgcgttttacagctgccgcacacgcccgcacgacaggcggcattaaccggcaccttattgctttccatcgcttccagtaacgtgctgccaaccggcgcataaaaatcccgcgccggttgtagcttgctgattttcagcccgcctgttgccgcggcagcggcgggtacaaagaactgctctttaaagaagcgggtcacgcccagcgctttcacctctttttccaccagatccatgtacggtgccgggccgcaagtcatgacggtacgcgaggccagatccggcacggatttcagcaactccgtggtcaggcgtccggagacaaaaccgtgagtggcattgttttccgccaccagcgtcaccggataacgacgccactcatcggcaaaaatgacatcttccggcgagcggacgttgaaaatcacctgcacatcggcgtcagggcgatacttcgccagccagcggcgcattgacataatcggcgtcacgccacagcccgccgccagcaacagcagccgatcgttaggttcgttatcacaggtgaattccccctgcgcatcggaaagccacagatagtcgccgcgcttcacgtcgcgggtcagccattccgagcctgcgccgccgtccagacgacggatggtcagcgtgatgtattcgctgaccccaggcgttgaggagagcgtataggcgcgcagcgtatcggcggaattacgaatgctgaccagcgcatactggcccgcacggtacgggtagtagtcatggcataacagcgacagcgtccacacatcaggcgtttcctgtgtgatgtggtgaacctgcatacgccatggacattgggctacgggcatcgtcataacgtcctccttacgcgctcagcagttgctgaatgtcctgttccacggtggtcacggaacgcagaccaaacttctcattcagtaccgccagcagatccggcgtcaggaagcctggcgcggtcgggccggtaacaatattggtgacgccgagcgacagcagcgtcagcagaataacaatcgctttttgttcaaaccaggagagcaccagcgacagcggcagatcgttcacgccgcagcccagtttttccgccagggtgaccgccagaataatcgccgaataagcatcattacactgaccggcatccaccagacgcggcagtccttcgatgttgccgaagtccagcttgttaaagcggtatttcccgcaggcgagggtgaggatcaggcagtcatccggcacgctggtggcaaaatcggtaaagtagttacgctcgccgcgtgccccgtcgcagccgccgacgaggaagatgtgacgcagtttttcacggcttaccagatcgatcagcgtatctgccgcgccgagcagcgtctgacggccaaagcccacggtgatcagatgttcaatttcgctgaacgggaagcccgccatctgctgtgcctgggcgatcaccggcgcgaaattgtcaccttccaggtggcttacgcccggccagccgacgatgctgcgcgtccagatacgatcgtcatacgcgccgaccgtcgggtcgataatgcagttcgaggtcatcacaatggggccagggaagcgggcgaattccacctgctgattctgccagccgctgccgtagttacccaccagatgtttaaacttacgcagttcggggtagccgtgcgccggcagcatttcgccgtgggtataaacgttcacgccggtgccttcggtctgttgcagcaggttgtagagatctttcagatcatgaccggagatcaaaatacatttaccggcagtggctttgacgttcacctgggtcggggtcggatggccgtaggtttcggtttcaccggcgtcgaggatgctcatcactttgaagttcatctggccgatttccatcgaacattccagcagcgcattcatatccgcaggccaggtgccaagccacgccataattttgtgatactgggcgtagatggcgttatcgtactggcccagcacgtgagcgtgttccatataggccgccgcccctttcaggccgtacaggcacagcaggcgcaggccgagaatattgtcgccgatgtcggctttgtctttgttcggcgtgaaggcttctgcctgacgctgcaactcgcccagatcgtcgctcaccagttgcagatccgccagcggatgatccacgctggccgccggatcgatgctctggcacagcgctttcagggcttcacgtttcgcaatggcgtcacgggcataacccacgatacgcggcgaatcgaagtttacgttagttaaggtggagaagaaggcgcgcggcgcaaagttgtcgatctcatggtcgatgagatcatagtcgcgggcttttaccgcccaggcggataacccctgcagcgccgcaatcagcagatcctgcaaatcagaagtttctgcggttttaccgcacatcccctgcgcgtaagaacagccgttgccagccggagtacggatagtttgctcacattgcacacaaaacatgatcacacctgtataagttatatttaaaatgcatgtttaagcttatgccgctgacgcaggggtttaaagtgatttgtatgactacttgcagggagattgatttaacgcaatttcaggcggtagtgacctaccgccggaggggtatcaggcggagaaaaaggccattaacagcggtaccagcagacttaacacaaaaccgtgcacaatggcggcgggaaccatctccagccccccgctgcgttgcagtaccggcagcgtgaagtccatggaggtggcgccgcataatcccagcgcggtagaacggctacggcgcaccagcgccgggatcagcataatggcgatcagttcacggcccagatcgttaaagaaggcggcgctgccaatgaccgggccaaaggattcggtcagcaggataccggagagggaataccagccaaaaccggacgccatagctaaaccggttttcagcggcagatcaaggatcagcgcgttaattatgccgcccgccagcgagcttaacagtaccaccacggcgacaatcatcccgcggcggttcagcacgatctgctttaaggtcatgccgttattacgcagctgaatgccaatcaggaacaggaggaaaatcagcgtatattcgctggcttcggtggcgtgctgcaggaatgtcagcccgctgaggccaattataaaaccgagcaccaccacgccgcacagcttaagggattccagcgccatggccacccgcgacggtaatttttcctgctggtgctgatgatgccagggcagggcgcgttcaagccataacagggcggcaatattacacagcataataatgacgatgctgaccgcggaataatgcagtatggccagcagattggtcgccagattatcgagaaaggccaggcttatccccataaaaaaaagaatgacgtacacgatccagcttaataagcggttaatcagcttaagggcggcggtatggtgcaggggaatgagataacccacgataagcgggataagtatgatgagtagtcctgataacatgaacagcctggatcctttgcttaaaaatgaaatagcgccgtaacacactactcaatccgcttaagtgagtaaagaagcagaaataaagaaaaattatgcagatgtgatgtccgtatattctctcaggtcttgatatattttacttttttccggcccgctatactgttgtactcaatggagcgccattattgccggaggagttatgctgctggaacgcgtggacattgccggatttcgcggtattaaccgattatctctgctgctggaagaaaataatgttctgatcggcgaaaacgcgtggggtaaatccagcctgctggatgcgctgacgctgttattatcacctgaatccacgctttatcatttcacgcgcgatgatttctggtttcccccgggcgatgttatggggcgcgaacaccatctgcatatcattctgacctttcgtgaaaccgagccggggcaccgccatgcccgacgttaccggccgctgaccgattgctgggtggccggagacgatggctatcaccggatattttaccggctggagggcgagctgggagaagacggcagcgtgatgaccctgcgcggttttctggatgccggagggcaactgctgccgctgacaaacatcgatgaacaggcgcggcatctggtgcgtctgatgccgatattgcgcctgcgggatgcccgttttatgcgccgcattcgcaacggtacggtgccggaagcgccggatgtggacgtcaccgcccggcagcttgattttctcgcccgcgaactggtatcgcgtccgcaaaaccttagcgacgggcagatacgtcacgggctgacggcgatggtacagctgctggagcactattttgccgaacagggcaccacccaggcgcggcatcgtctgctgcgtcgccacgcccacgatgagcagcgcagctggcgctatctcgatattatcaaccggatgatcgacaaacccggcggccgcagccacagggtcattttgctggggctgttttccaccctgttacaggcgaaaggcacaatacggctcgataaagacgcgaggccgctgttgctgattgaagatccggaaacccgcctgcacccaatcatgctgtcggtggcctggcagttgctgaacctgctgccgttgcagcgcatcaccaccactaactccggcgagctgctgtcgctgacgccggtggagcatgtctgtcggctggtacgcggctcctcccgcatcgccgcctggcgactgggaccgggcggcatgaacgccgaagacagccgccgcatcgcgtttcatatccgcgctaaccgcccttcgtcgctgtttgcccgctgctggctgctggtggaaggggaaacggaaacctgggtgatcagcgaactggcgcgccagtgcggtcatcattttgacgccgaagggatcaaagtgatcgagttcgcccagtccggcctgaaaccgctggtgaaattcgcccgtcgcatggggattgaatggcatgtgctggtggatggcgacgaggccgggaaaaaatacgccgccaccgcccgcagtatgctggacggcaatcgcgatcatgaacgcgatcacctgacggccttaccggcgatggacatggaacattttatgtatcgcgaaggcttcgccgacgtttatcaccgggtggcgcaactgccggaaaatgtgccaatgaatatgcggcgggtgatcatcaaagccattcaccgctcatcgaaaccggatctggcgatagaagtggcgatggaagcggggcgacgcggcgtggatgccgtgccgctgctgctgcgcaagatgttttcccgcgtgctgtggctggcacgcgggcgggcagattagcccatcgcgcgctgcacctgcgtcagcaggctgtcgagcagttcataacggcggcgatactccgcgcgttttttgctggcgatctcctccatgggcttgcgcggcatcgccagcggcatctgataatcgcccctggccgtcggctcgccgcccagcgacagccagaagccatcgtaatcggcgtgcagtttgtcctgctttttctggcggtagcgccagttgcgataaatatgcgtatggttactgaccgcgaggatctgcgccaccccaagcttttcacccattgccatggccgcttccaccagcaggcgtttagggaacaggccgtggcaggctttggtggcgctctggatcagttgatgatcgacatgggctttcgcgccctgtaaaccgccgacataaagcgtgtttttgccctccaccgggcagagggtaaaagtcagctccgccagcaccgtctgctcagcatcgcaaaacaccagcgtcgcttccccttctttgtccagcatcgcatccgcgcgcagacgcaggctgtagggccgatcgtttttgccgttaagggtcgccagttccacgccgtgacgggaaaggtagccattgagtacgccggcaggcagttgctgcatcaggctctggtaatgccagcgcagggcgtcaatcgccgtctgccgcgagatgttcaccgacagccagggacgatgcagacggcacggcaggcccggctgcgcattgagaagttgcagcaggcacggctgtctgaccagaatggacatccactttgcggtagcgaagggcgtcgccagcgagcgaagcacaaatttccggcggtaggccgggttttgccaggccagcccggggatcagcattccgctggctaaatggcggaaaagctgccagcctgtttcaggttgcggcaatgcggagtgtggagtggcaacgaatgtagacatgataaacctgcgcgtaataaccaggcattcatttcagcaaggacactctcaacgccacctcaatgggtttgcgggataaaataaaggtggggtttcgttgaccctccgtttaggtagaattcatcattactgaagtcagctcaattactggaatttatatgaagctaaagggaaaacgcaggaaggtcgtattgttgctgaccgtgctggcgctgattgccggattctggctgtggcggcagctcaatgcgccgctgccgcagtaccagacgctgatcgtccggccgggtgatttgcagcaaagcgtgctggccaccggcaaactggatgcgctgcgcaaagttgacgtgggtgcgcaggtgagcggtcagttgaaaacgctgtcggtgaatattggcgataaagtgaagaaagatcagctgctgggcgttatcgatccggagcaggcgcagaaccagatcaaagaggtggaagccacattaatggagctgcgcgcgcagcgccgccaggcggatgcggaaagacgtctggcgcaggtgacgctgggccgtcagcagcaactggcgaaaacccaggcggtgtcgcgccaggatctggatactgccatcactgagctggcggtaaaagaggcgcaaatcggtaccatcgacgcgcaaattaaacgtaatcaggcaacgctggatacggctaaaacgaacctcgaatacacgcgcatcgtcgcgcctatggccggggaagtgacgcaaatcaccaccctgcagggccagacggtgatcgccgcgcaacaggcgccgaacattctgacgctggcggatatgagcaccatgctggtgaaagcccaggtctctgaggcggacgtcattcatctcaaacccggccagaaagcctggtttaccgtgctgggcgatcccctcacccgctatgaaggcgtgctgaaagatattctgcccacgccggaaaaagtgaacgacgcgattttttatcatgcccgttttgaagtgccgaacccgaaaggcgtgctgcgtctggagatgaccgcgcaggtgcatattcagctttcaggagtgaaaaatgtgcttaccgtgccgctgtcggcgttgggcgatcccattggcgataaccgttacaaggtcacgctgctgcgcaatggcgaaacccgcgagcgcgaagtgactatcggcgcgcgtaatgacaccgatgtggaagtgaccaaaggtctggaagcgggcgatgaagtggtgacgggcaccacaacgcccggagtgacgccatgacggcgctgctcgaactgcatgacattcgccgcagctatccctccggcgaaggccaggtggaagtgctgaaggggatcacccttagtattgaagcgggtgaaatggtggcgattgtcggcgcgtccggctccggcaaatcaacgctgatgaatattctgggctgcctggataagccctccagcggcacctatcgcgtggcgggcagcgatgtcgccctgctggataaagacgcgctggcccgcctgcgccgcgagcattttggctttatctttcagcgctaccatctgctgtcgcacctgacggcggcgcagaacgtcgaagtgcccgcggtctacgccggtaccgagcgtaaagctcgtttacagcgggcgcatgaattactgcaacggctggggctgggggagcgggaaggttatcagccgtcgcagctgtccggcggccagcaacagcgcgtcagtattgcccgcgcgctgatgaacggcggccaggtgatcctcgccgatgagcctaccggggcgctggactcgcgttcgggcgaagaagtgatggcgatcctgcatcagctgcgcgacaacggtcacacagtgatcatcgtcacccacgatccgctggtggcggcgcaggccgaacgcatcattgagatccgcgacggggaaatcatcagtaatccgccgccgcgatcccgcgctgccgccagcgcggatcgccatgtgaatacccggccggaaagcggctggcgacagttcagcagcggatttcgcgaagcgctgaccatggcctggcgggcgatggccgccaacaaaatgcgtactttgctgaccatgctggggatcattatcggcatcgcctcggtggtctcgattgttgtggtgggggatgcggcgaaacagctggtgctggcggatatacgcgccatcggcaccaataccattgatgtctatcccggcaaagattttggcgatgacgatccgcagtatcagcagtcgctgaaatatgacgatctggtggccattcagaagcagccgtgggtcagctccgccacgcctgcggtatcgcaaagcctgcgtttacgttacggcggcattgacgtcgcctccagcgccaacggcgtcagcgggcagtattttaacgtttacggcatgaccttcagcgaaggggcgacctttaacgacgaacagctgaaagggcgcgcgcaggtggtggtgctggacgccaatacccggcggcagcttttccctaataaagcgaaagtggtgggcgaggtgatcctcgttggcaatatgcccgcgacggtaataggcgtggcggaagagaagcagtcgatgttcggcagcagcaaaattttgcgcgtctggttgccgtataccaccatgtccgggcgcatcatggggcagtcctggcttaactcgatcaccgtgcgggtgaaagagggctacagcagcgaacaggcggatcagcagctgacgcggctgctctccctgcgccacggtaaaaaagatttcttcacctggaatatggacggcatcttgaaaacggcggaaaagaccacacgtacattacagctgtttctgacgctggtggcggtgatctcgctgttggtcggtggtattggcgtgatgaatatcatgctggtgtcggtgacggagcgtacgcgtgagatcggcatcaggatggcggtcggcgcgcgggccagcgacgtgctgtcacagtttcttattgaagcggtgctggtgtgtctggtgggcggggcgctaggcgtgagtttatccatgctgattgcctttacgctgcaaattttcctgcccggctgggaaattggtttttcaccggtggcgctgttgacggcgtttatttgttcaaccttcaccggcgtgctctttggctggctacccgcccgcaatgcggcgcggctggatccggtggatgcgctggcgcgtgagtaaataaaaatgccagcccgcgggctggcattttactggcaggctgtacacaatgaaacgaagcaggactacgcgacggcctcggcaatcgcaacggcttccgtttcaaggggaacaatgaggctggcatgattgcctttcggtccctgatgtacatcaaaccggaccatctgcccggctttgagcgttctgtaaccatccatctggatggtggaataatgagcgaaaatgtcttcgccgccgccttcagggcagataaagccgaaccctttggcgttgttgaaccacttaacagtacccgtttccatgcttcgacatccttcgtaaatcttatttaagtaagatggaatgaaccggtggcagagagggcagttgttcaaaacgtcgccaactcccgacctgtacaatttagatatttcgggctttgggtcaagcgttagggtgtgcagcgaagcatgattgagtcaaaattttgaagcagttaacgcaattgcggtagtttgtgacagccatcgcggatggcaatgatagatgatagttatctcacttatgatgtagattcaaaatgcatctagactcaagttactgacagtgtgcacgctgttggcaacttcaaccgaagatgaatacgagcgatgggcaagaccaatacctggctggatttcgaccagctggcggcagataaacagcgcgaagcgctaaaaccgccatccatgtataaagtaatgttaatgaacgatgattacacgccgatggaatttgttattgacgtgctacaaaagttcttttcttatgatgtagaacgcgcaacgcaattgatgctcaccgttcactatcacgggaaagctatctgtggtgtgtttaccgccgaagttgcggagaccaaggtggcgatggtgaatgagtatgcccgggagaacgaacatccattgttgtgtacgttagaaaaagcctgatcaaggcaaactattgaggggggtgcccaatgctcaaccaggaactggaactcagtttaaacatggctttcgccagagcgcgcgagcaccgacatgagtttatgaccgtagagcacttgttactggcgttgctcagtaacccatcagctcgcgaagcactcgaagcgtgctccgtggacctggtcgcgctgcgtcaggaacttgaagccttcatcgaacaaaccacacccgtgctgccgctcagcgaagaggagcgggatacccaacctacgctcagcttccagcgtgtgttgcagcgcgcggtcttccacgttcagtcatccggccgcaatgaagtgaccggtgcgaacgtgcttgtcgccattttcagcgaacaagagtcgcaggcagcctatctgctgcgcaaacatgaagttagccgtcttgatatcgtgaatttcatttcacatggtacgcgtaaagatgagccaggccagtcgtccgaacccggcaaccaacctaatactgaagagcaggcaggcggggaggaacgtatggaaaacttcaccaccaatcttaatcagcttgctcgtgtcggcggaattgacccgctgatcggccgcgataaggagctggagcgcaccattcaggttctgtgccgtcgtcgcaaaaacaacccgctgctggtgggtgagtccggcgtgggtaaaaccgccattgctgaaggcctcgcctggcgtattgtgcagggcgacgtgccggaaatcatggccgattgtacggtttattcgctggatattggttcgctgctggcgggcactaaataccgtggcgatttcgaaaaacgctttaaggcgctgttaaagcagctggagcaggataccaacagtattctgttcatcgacgaaatccacaccattatcggtgcgggcgctgcgtcgggtggccaggtggatgccgctaaccttatcaaaccgctgctctccagcggtaagatccgcgtgatgggttccaccacgtatcaggagttcagcaacatcttcgagaaagatcgtgcgctggcgcgtcgtttccagaaaatcgacgtcaccgagccgtctgtagaagaaaccgtgcagatcctgaacgggctgaagccgaagtacgaagcgcaccacgacgtgcgttacaccgcgaaagcggtacgtgcggcggtggagctggcggtgaaatatatcaatgaccgtcacctgccggataaggcgattgacgtgatcgacgaagcgggcgcgcgtgcgcgtctgatgccggtcagcaaacgtaagaaaaccgtcaacgtggcggacatcgaatccgtggtggcccgcatcgcacgtattcctgagaaaagcgtctcgcagagcgatcgcgatacgctgaaaaacctcggcgaccgcctgaaaatgctggtcttcgggcaggataatgcgattgaggcgttaaccgaagcgattaagatgagccgtgccggtcttggccaggatcataaacctgttggctctttcctgttcgccgggccgaccggggtcgggaaaaccgaggtgaccgtgcagctgtcgaaagcgctgggcattgagctgctgcgttttgatatgtccgagtatatggaacgccatacggtcagtcgtctgatcggcgcgcctccgggatacgtcggcttcgatcagggcggactgttaacggatgcggtgatcaagcatccgcatgcggtactgctgctggatgagatcgagaaagcgcacccggatgtctttaacctgctgttgcaggtgatggacaacggcacgctgaccgataacaacgggcgtaaagcagacttccgtaacgtggtgctggtgatgactaccaacgccggggtacgtgaaaccgagcgtaaatccatcggcctgatccaccaggataacagcaccgatgcgatgggcgagattaagaagatctttacgccggaattccgtaaccgtctcgacaatattatctggttcgatcacctctctaccgaggttatccatcaggtggtcgacaaatttattgtcgaactccaggtgcagctggatcagaaaggcgtgtcgctggaagtcagccaggaagcgcgcgactggctggcagagaaaggctatgaccgtgccatgggtgcgcgtccgatgggacgtatcattcaggataacctgaaaaaaccgctcgccaacgaactgctgtttggttcgctggtggacggcggccaggtgacagtggcgctggataaagagaaaaatgaactgacctacggttttcagagtgcccagaagcacaaagccgaagccgcgcattaatctcttttaaataaaacaaaaccgggtgaaaacccggtttttttatggctgtactttttcgcggcaaataaaaaaggccgggattgcccgacctttagtctttctatacgccagtgaaggcgtagcagcgattgctattagcgactacggaagacaatgcggcctttgctcaggtcgtacggggtcagctcaacagtcactttgtcgcccgtcagaatgcggatatagtttttacgcattttaccggagatatgcgcagttaccacgtgaccgttttccagctcaacgcggaacatggtattaggtaacgtatccagtacggtaccctgcatttcaatattgtcttctttggccatctagtcctcgggggtatcactaccaaaatttttttgaaccggcaagataatgccgaaattcatcagttaagtaaagatttgcgcggataattacgcagcaaagtaaccttggcgtattgcccacattataaaccgacgcgtaaaagcgcgaacgtaaaggggagcgacaagataaacgaagggcgttacctgattcgagctagtcccaaacggtggcggggcaacaggcagaagctactctgcgcgtccattataacactctgacaagaaatgtgccgaaaacattcaccgcgtgggcgtaaataacgtccgcggcacccaaaaatgtggcggcatcttttgcagacgcatcgcattcaggtgttgcagatattcccgccgcggaatatctgtcgcgccgagagaggcggtatgttcatttaatacctggcagtcgatcaactggccgccctgacgcaggaaatcctcgcacaataccagcagcgccgttttcgaggcgttcacccggcggctgaacattgactcgccgcaaaacaacgcgccctgcgacacgccgtacatgccgccaaccagctcatccccttcccagacttcgatggaatgggcgtagcccagctcatgcagacgatgatacgccagcaccacatccggcgtgatccaggtaccttcatcacgatcatgggcgcagcctgcgatcacccgtccaaaatcatgattgagggtgacgcggtaaggggaacgcttgtgaaagcgggccatgctgcggctgaggtgaaactgttccggccacaggacggcgcgtggatccggcgaccaccacaggatagggtcgcccggagaaaaccagggaaagatgccgcgctgataagccatcagcaggcgggcagggctgagatcgccgcccagcgccagcagcccgttaggttcacgcaacgccccttcgggcgagggaaaagcaacagaatgacgagataactgaaccaggcgcatgaccacaacgctccacaacgcaacaaggaatgattcaaatttacagccgttgcttaaaccggtagtagcgaccctgttttgccattaacgctgcgtgattaccttgctcaattatttcaccgttgtccatcactattatttgatcgcattgcgacaaaccacgcaaacggtgggtaaccatcagcaccgttttgcctttcgtcacttcagcaagcaaatcaaggatttgactttcagtggtggcgtccagcccttcggtcggttcgtccagtaaaaacagcggcgcatcatgcagcaaagcacgggcgatcgccagacggcgcagttcgccgccggagagctgcctgccgccttcgcccagccagctgttcagcccgccgtcatcaagcaacttttccagcccgacctgagtcagcactgtcgccagcgcctcatcggaagcggcaggggaggctaacagcaggttatcacgcagggtggcgctgaacagatgcacccgttgcggcaccacgctgatggtggcgcgcagggcggcttcgctgagacttgtcagcggctgaccgttcagcaggatctcgccctgctgcggatcccatgcccgcgtcagcagttgcagcagcgttgatttaccgcagccggtgcgtcccagaatggccacacgctgcccggcggtcacttccagcgatacgcctttcagcgctggctgtacctgttgcggataggtgaaggacacggcgtcaagccgcagatcgacctgcgcaggcatggccgtttccccggcagagaaagtcacttccggcgggcaatcggtgatctcggtgatacgacgcgcagaggcgatcacctggcctaaatgctggaacgcgcctgtcactggtgccagcgcttcgaaggcggccagcgcgcagaaaacaaagagcgcaatcagcggaccgggctgggtattgccgcccacgccgcccgccgccagccacagcatggcaatcaccgcaaagccgctaatcagcagcatcagcgcctgggcaagcgccgtcagttcagactgacgacgctgggcgtcatgccagcttaattcggtattctccatctgctcacggtagcgttggctggcgccaaaaatggtcagctcagcctggccctgcaaccagctggtcaggtgctggcgatactgaccgcgcagcgcggtcagtttttcaccggtggatttacccaagcggtaaaacagcggcggcagcaggagtaaggtcagcagcataatgccgccgagcgtcagcgccagcgtgacatccagcacgccaagacccagcgtcaccacaaggatgacgaccagcgcgccgaccagcggcgaaatcacccgcagatagagatgatccagcgtatccacatccgccaccacgcggtttagcagatcgccctgacggaaacgcgccagcccggcaggagaaagcggcagcagcttgctgaaggtggaaacgcgcagatgagaaagaacgcggaaggtggcatcgtggctgaccagccgctcaaaatagcggccagcggtgcgcgtaatggccgcgccacgcaccccggcggcgggaagcatatagttaaaactgtaaatacccgccacgccaaccaccgccgaggcggagaggaaccagccggagagggtcagcagaccgatactggccagcagcgtcacaatggcgagcaccacgcccagcgtcagcagccatttatggcgtttatataatgcgagatagggaaggagcgcgcgcatttaaatttcctcctggcgatgggcgagcagggcggcgaaaggcccgcctgcggcggcgagagcggtataatcgccttgttcaaccagcctgccgttttgcatcacccagatactgtcccagttcgtcagtccttccagttggtgggtcaccatcagggtggtctgacgcagcgaggcggtattcagcgcctgcatgacacgctgttcgctgtgcgcatccagactggcggacggctcatccagcagcatcagctggctggcattcagcagcgcacgcgcaacggccacgcgctgggcctgcccgacggacagacgcgccgcctgatcgcccactggcgtatcgatcccctgtggcaactgcggcaaaaattcgctcacccaggcggcgtccagcacggctttaagctctgcttcgctggcgtccggccgggccagcagcacgttatcgcgcagcgtggtcgccggaagctgtggattctgcccgacccagcttagctgcctgcgccacgccagcggatcgagatcgcgcagctcgacgccgttgatttgcagcgatccttcatagctgagaaaaccggagagggcgttaatcaacgagcttttcccggaaccgctttgcccgaccagcaccacgcgctgcccggcaggaagggtaaaatcgagcggcccagcaaggatcgcgccttccggtgatttaatcaccgcgccgcgggccatcacgctgaccggctcatcggtattcagcgtgcgttcgccgcgttccggccatgccagcggcgtttcgaggaaggttttcaggctgtcagccgcgccaacggcctgcgcttttgcatgatagaaggtgcccagatcgcgcagtggctggaagaactccggcgcgaggatcagcgtcaggaagcccgcaaacagcgtgacgcctgcgccatagtgaccaaaattcaactcgcccagataagagaagccgaaatacaccgcgaccagcgcaatagaaagggaggtaaagaattccagcacgccggaagataaaaacgccatgcgcagcacttccatcgtgcggctgcggaaatcctgggatgcctggcgaatattctcggtttccgcttcaccccgaccaaaaatgcgcagcgtttccataccgcgcaggcggtccagaaaatgcccgcttaatctggccagcgctttaaaattgcggcggttcgcatctgcggcgcccatgccgaccatcgccataaacatcgggatcaagggcgcggtgccgagcaaaatcagcgcggcggcccagttggtcgggaaaatcgtcagcacaatcaacagcggtacgctggcagccagcgccatctgcggcaaatagcgcgcatagtaatcgtgcatgtcgtcgatctgctcaaggatgagcgtcgcccagctgcccgccggttttccctggatccacgccgggcctgcctgttgcagacggtccagcaccagacggcggatctcatagcggatgtgcagaccggcatggaagccgacgcgttcgcgcagccacactacccaggcgcggagaataaacaccagcaccagcagcacaaagggcagcaacagcgcctcgcggggaatattttccataatcatatgattaaggatggtggccagcagccaggcctgagccacgatcaatatgctgctgacaagccccagaatgcgggaggtcatcagccagcgacgggaaattacgctttgctgtttgagccagcgggttagttcttgttgacgggttttattcattgcgcgcttagcaggtaaagtgaccataaatttatgcacggcaatgttacaacggcgaaaaaataaaggcgactgatagtcgccttctttactttgtctttaagtgccttactcgctgaaattatttactgttttcagccagaccgtcgagataacgttcagcatccagcgcggccatacaaccggttccggcagaggtgatcgcctgacggtagatatgatccattacatcgcccgccgcaaacacgcccggaatgctggtctgggtcgcgttgccgtggatccccgactgcactttgatgtagccgttttccagctccagctgaccgtcaaaaatagcggtgttcgggctgtggccaatggcgacgaacagaccggcaacttctaaagattccacgttatcgctgttctgcgtatcgcgtaggcgcaggccgctcacgcccatctggtcgccggtcacttcttccagcgtacggtgagtgtgcagcacgatattgccgctcgccactttatccatcagacgtttgatcagaattttttccgcgcggaaggtgtcgcggcggtggatcaggtgcacttccgaggcgatgttcgccagataaagcgcttcttcaaccgctgtattgccgccgccaatcaccgctactttctggttgcggtagaaaaagccgtcgcaggtagcgcaggcggatacgccgcgtcctttgtaagcttcttctgacggcaggccgagatagcgggcggaggcgccggtggcgatgatcagcgcatcacaagtgtactcgccgctgtcgccggtcagacggaacgggcggttttgcagatccactttactgatgtgatcgaaaagaatttccgtttcgaatttcgcagcgtgttcatgcatacgctccatcaacagcggtccggtcaaatcatgcggatcgccaggccagttttccacttcagtggtggtcgtgagctggccgcctttttccataccggtgatcagtaccgggtgcaggttagcgcgtgcagcatagaccgcagcggtgtaaccagcggggcctgaaccaaggataagcagcttactgtgtttagccgtgcccatgagatcctcattatagttagcggacaatgcgcaggattgtagggaatttacgggcgtaaaaaaagggtgcagcgactatgttaatgatttgtgtagccgatgaatctaccccggcggggagatccataataaattctactgaaatttggcctgttataaggcgataaaatgaggtttgccaggaggtgttgatgaatatctggcatgttgtactaaaaaaagatgttttgctttgacaatcccctgcgcatttgcgaaaacattcgaggaagaaaaaaagcagtgtttcgcgcatgacgcaaattcatgcatgcaaatgccattttaccgggttattgaaatcgacgcacggcgtggacagacgccatgcgcgatattaatagctgccgctggcaacggtcttctcaatacagacccctggaatatgtagcgcaactaacaataaccagcgatgcataaaccgacgggcaaagactctcaacagtgaagtgcacagggtcaaggcaggagtagggaaggaatacagagagacaataataatggtagatagcaagaagcgccctgggaaagatctcgaccgtatcgatcgtaacattcttaacgagctgcaaaaggatgggcgtatttccaacgtcgagctttcaaagcgagtaggactttctccaacgccgtgccttgagcgcgtgcgccggcttgaaagacagggttttattcagggctacacagcactgttaaacccgcactatctggatgcatcacttctggtttttgttgagattactctgaatcgtggcgcgccggatgtgtttgagcagttcaatgccgcagtacaaaaacttgaagaaattcaagagtgtcatttagtatccggtgatttcgactacctgttgaaaacacgcgtgccggatatgtcggcctatcgcaaactgttaggggaaaccctgctgcgtctgccgggcgtgaacgacacccgtacctatgttgttatggaagaagttaaacaaagcaatcgtctggttattaagacgcgctaacacggaacaggtgcaaaatcggtgtagtttgattacactcctgttaatccatacagcaacagtgccggggcaacctggcgctgttctccgttttagcatcaaggacctggagagccttacttgagccaggaatatactgaagacaaagaagtcacactgaccagattaagtagcgggcgtcgtctactcgaagcactgctgattctggttgccctgtttgctgtctggttgatggcggcgctactcagctttaacccttccgatcccagctggtcacagaccgcatggcatgaacctatccataatctgggtggcgtgccgggcgcatggctggctgataccctgttctttatctttggggtgatggcttacaccattccggtaatcatcatcggcgcctgctggtttacgtatcgtcatcgcgcaacggaagattacattgactatttcgcggtctcgctgcgtctgatcggcgtgctggcgctggtgctcacctcctgcggccttgcggccatcaatgccgacgatatctggtactttgcctccggcggcgtgatcggcagcctgttaagtacagccatgatgccgctgctgcacagcagtggcggaaccctcgcgctgctctttatctggggagcggggcttacgctctttaccggctggtcctgggtcagcatcgcggaaaagattggcagcgttatccttaatatcctgaccttcgccagtaaccgcacccgtcgcgacgacacctgggtcgatgaagacgactacgaagacgacgagtacgaagaagacgcccccgtacagcgcgaatcacgccgggcgcggatcatgcgcggcgccctggcgcgccgtaaacgcgtcgccgaaaaatttgctaatccattgggtcgtaaaaccgacgaggcgctgttctccggtcgcaggatggacgatgaagaagagattcaatacagcgcccgcggcgtggccgcggatgccgatgacgtgctgttctccagcactaaagcgacaggcgcgccgcagtgggatgaatacgatccgctgctgagcgggcatagcgtcagcgaaccccttgcggcagcagccgtggcgaccacggcggcgcaggcatggagcgctccggtagaacctgtcatgcaggcaccggctcagccagtggccgagccgccttatgtggcgccacctgtccagcagcctcctgtggcgcagtatgccgcgccggaagagccttcatactatcagccgcctcagccgccagtgcatgaacatgaaaattacgcggcacaggcgccggtctactccgagccagaaacctatgccgcggtcacgccggaaccggagccgcacgttcagcagcaatggcagcagccggaaccgccggcagtagagccagaacctgcgcctgaaccggaagaaattaaacatacccgtccgccgctttactatttcgaagaagtagaagagaagcgcgcccgtgagcgggagcagctagccgcctggtatcagcctatacctgaaccagtccagccggaacctgcgccaaaacctgccccggcaccgtctgcgccagccgtcgagcctgcgcccgttgttccagccgccgcgcttaaagaagcctcaaccgccgctgctgcaggtgctgccgccgccgggccggtattcagtcttgccggtagcggcgcgccacgtccgcaggtgaaagagggcattggtccgcagttgccgcgcccgaatcgggtacgggtgccgacgcgtcgtgaactggcgtcctatggtattaaactgccgtcccagcggatggcggaagagcgcgcccgtgaaatggattacgcttctgaggatgaagcggacgccatgcagcaggacgaactggcccgtcagtttgcttccacgcagcaaagtcgttatggcgatgagtaccagcacgatcagaccggcactgaaataaatgaagatgaggttgcggaagcggaactggcgcgccagtttgctgccgctcagcaacagcgttattcgggtgagcagcccgccggggcaacgcctttctctccggctgattttgacttctctccgatgaaggcgctggtggatgacggcccgactgaaccgctgttcacacctggcgtaatgccagaatcgcagcctgccacgcctgcgccgcaaccctatcagcaacctgctgcgccgcagtaccagcagcctcagcagcagcccgtcgcgccgccgcagtaccagcagcctcagcaacagcctgttgcgacgccgcagtatcagcagccccggcagcctgctccgcaggacagcctgatccacccgttactgatgcgtaacggggacagccgtccggtaccgaaaccgaccaccagcctgccgtcgctggatctgctgacgccgccgccgagcgagacggagccggttgatacctttgcgctggagcagatggcccgcctcgttgaagcgcgcctgaatgatttccgcatcaaagccgatgtggtgaactactcgccaggtcctgtaatcacccgctttgagctcaatcttgcgcctggggtgaaagccgcgcgtatctccaatctctcccgcgatctggcgcgttccctctccaccgtggccgtgcgcgtggtggaagtgatccccggcaagccttatgtgggtctggagttaccgaataaaaaacgtcagaccgtttacctgcgagaagtgctggactgcgataaattccgcgacaacgcctcgccgctgacggtggtgctgggtaaagacatttccggcgagccggtgattgccgacctggcgaaaatgccgcacctgctggtggccggtaccaccggttccggtaagtcggtgggggtcaacgccatgatcctcagcatgctctataaagcgcagccggaagacgtcaaattcatcatgatcgatccgaagatgctggagctgtcggtatatgaaggcattccgcatctgctgaccgaagtggtcacggacatgaaggacgctgccaacgcgctgcgctggagcgtcaatgagatggaaaaacgctacaagctgatgtcggcgctgggcgtgcgtaaccttgccggttataacgagaagatcgccgaggccgcgcgtatgggtcgtccgatcccggatccgtactggaaaccgggcgacagcatggacgccactcatccggtgctggaaaaactgccgtatatcgttgtgctggtggatgaattcgccgacctgatgatgaccgtgggtaaaaaagtggaagagctgatcgcccgtctggcgcaaaaagcgcgtgcggcaggtattcaccttgtgctggccacccagcgtccttccgtggatgtgatcaccggcctgattaaggccaacattccgacgcgtatcgcctttaccgtttccagtaaaatcgactcccgtactattctggatcaggcgggtgcggaatctctgttaggcatgggtgacatgctctactccgggccgaattcctcctcagcgcccgtgcgtgtgcatggtgcctttgtgcgcgatgaggaagtgcacgccgtcgtgcaggactggaaagcgcgcggacgaccaaaatacattgaaggcatcacctccgatgcggaaagcgaaggcggcggcggtggtttcgatggcggtgaagagctggatccgctgttcgatcaggcggtgaactttgtcaccgaaaaacgcaaagcgtcgatctccggggtacagcgtcagttccgtatcggttacaaccgcgcggcacgtattattgagcaaatggaagcgcagggcatcgtcagcgagcagggccataacggtaaccgcgaagtgctggcgccgccgccgtttgattaaccttctgattgcaaagttgggtaaacgaacgaaaaatcagtcttttcctctgtcgccgccgtctcgtcaggcctacagtgagtgacagaagagtctcccggatggggagtgacgtacttaaggaataacaatgaaaaaaattgccattacctgtgcattactgacttcattcgcggccagcagcgtctgggctgacgccgcgggcgatctgaaaagccgtctggacaaagtcagcagcttccacgccagtttcacccagaaagtgaccgatggcagtggggcggcggtgcaggaaggacagggggatttatgggtaaaacgcccgaacctgtttaactggcacatgacgcagccggatgaaagcatcctggtatcagacggtaaaacattgtggttctacaacccgtttgttgagcaggcaacggccactaatctcagctcagccaccggcaatacgccctttatgctgattgcccgtaaccaggcaagcgactggcagcagtacaacattaaacagaatggtgacgacttcgtgctggtgccgaaaggcaataacggcaacctgaaacagttcaccattaacgtcagccagaacggcaccattaatcagttcagcgcagtggagcaggacgatcagcgcagcagctatcaactgaaatcccagcagaacggggccgtcgatccgtcgaaattcacctttaccccgccgcagggcgtgacggtggatgaccaacgtaagtagaggcatgagtgggaaatctgacgctcgatttttccgataatacgtttcaacctctggccgcccgtatgcggccagaaaatttagcgcagtatatcggtcagcagcatctgctggcggccggtaaacccttaccgcgcgcgattgaagccgggcatctgcactccatgatcctgtggggcccgccgggtaccggtaagacgacgctggcggaagtgataggccgctatgcggacgccgacgttgagcgtatatctgccgtcacctccggcgtaaaagaaattcgtgaagcgatcgagcgggcgcggcagagccgtaatgccgggcgtcgcactatcctgtttgttgacgaagtgcaccgtttcaataaaagccagcaggacgcctttctgccgcatattgaagacggcaccatcacctttatcggcgccaccactgaaaatccctccttcgaacttaactcagcactgctttcccgtgcgcgcgtttatctgctcaaatccctgaccgttgaagacatcgaagaagtcctaaaccaggcgatgacggataaagagcggggttatggcgggcaaaatatcgtgttgccggacgaaacccgtaaagcgattgctgaactggttaacggcgatgcccgccgggcgctcaacacgctggaaatgatggcggacatggccgaagcggatgacagcggcaagcgtgtcttaaaagaggcgctgctgacggaaatcgccggtgagcgcagcgcgcgctttgataacaagggcgaccgtttttacgatctgatttccgcgctgcacaagtcggtgcgcggcagcgcgccggatgcggcgctgtactggtatgcccgtatcatcaccgccggtggcgatcccctttatgttgcgcgccgctgcctggcgattgcgtctgaagatgtgggcaacgccgatccgcgtgccatgcaggtggcgctctctgcctgggactgcttcacccgcgtcgggcctgccgaaggcgaacgcgcaatcgcccaggccattgtttatctggcctgcgcgccaaaaagtaatgccgtctataccgcctttaaagcggcaatggcggatgcgcgcgagcgccctgattacgacgtgcccgaccatctgcgcaatgcgccgaccaaactgatgaaagagttaggctacggtcagcagtatcgttatgcccatgatgaagccaatgcctacgcggcaggcgaggtctatttcccgccggaaatagcacaaacgcgctattatcacccgacaaacagaggtcttgaaggcaagattggcgaaaagctcgcctggctggctgaacaggatcataaaagccccacaaaacgctatcgctaactgtggcgttgcggtaaggttatcgatgattctggtggttgcaggctgtgaccactttctctcattttcaattcgataagcacaggataagcatgctcgatcccaatctgctgcgtaccgagccagacgcagtcgctgaaaaactggcacgccggggctttaagctggatgttgataaactgcgcgctcttgaagagcgtcgtaaagttctgcaggtcaatacggaaaatctgcaggcggagcgtaactcgcgatcgaaatccattggccaggcgaaagcgcgcggggaagatatcgagccattacgcctggaagtgaacaagctgggtgaagaactggatgcggcgaaagccgaactggaaaccctgctggcagaaatccgtgatattgcgctggcgatcccgaacatccctcacgatgacgcgcctgttggccgcgacgagaatgataacgtcgaagtcagccgctggggcaccccgcgtactttcgatttcgaagtacgggatcacgtgacgctgggcgaaatgcacagcgggctggattttgccgcggcggttaaactgaccggttcacgctttgtggttatgaaaggccagatcgcgcgtatgcaccgtgcgctcgcccagttcatgctggatctgcataccgaacagcacggttacagcgaaaactatgtgccttacctggtgaaccatgacaccctgtacggtaccgggcagctgccgaaatttgccggcgatctgttccatacccgtccgctggacgaggaagccgacagcagcaactatgcgctgatcccgactgccgaagtgccgctgactaacctggtacgtgatgagatcatcgatgaagacgcgctgccgatcaaaatgaccgcgcatacgccgtgcttccgctctgaagccggatcttacggtcgcgatacccgcggtctgatccgcatgcaccagttcgataaagtcgagatggtgcagatcgttcgtccggaagactccatggacgcgctggaagagatgactggccacgcggaaaaagtgttgcagctgttaggtctgccatatcggaagatcatcctctgtaccggcgatatgggctttggcgcctgcaaaacctacgatcttgaagtctgggttccggcgcagaacacctatcgtgagatctcctcctgctccaacattggcgatttccaggcacgtcgtatgcaggcacgctgccgcagcaaaaccgacaagaaaacccgtctggtgcacaccctgaacggttcgggtctggcggttggtcgtacgctggtggcggtgctggaaaactaccagcaggctgatggtcgcatcgaagtgcctgaagtgttgcgtccgtatatgaacggcctcgagtacatcggctgatcaccgcgtcacccatcacatttaaagcgcctgcgggcgcttttttattgcctcattgacaccgaacaataaccccttttattaaaagggtaatactcactttgtattagcgcagcataaaaaacttaaaaaatgttatttcgctatagggaaaactatatagcgagtgttttttcgtgagcaagcaaagtgagtttttatgaaaatatctgttccggaggtgttactcaccgccggggtgagtcgtcgcagcctgatgaaaacctcagccataggcggcctcgctgccgccagcagcgccctgactttacccttttcccgcatcgcccgcgccgccgaggccattgcgccgggctcatccactgaaaaagtcgtctggagcgcctgcaccgtgaactgcggcagccgctgcccgttacgcatgcatgtggtggacggcaaaattaagtatgtcgaaaccgataacacaggcgatgacaactatgacggacagcatcaggtgcgcgcctgtcttcgcgggcgctccatgcgtcgtcgcgtctacaatcccgatcgcctgaaacaaccaatgaaacgcgtgggcaaacgcggggaagggaagtttgttcccatcagctgggatgaagcctttgacactatcgcgggcactatgcagcggctgatcaaagagtacggcaatgaatctatctacctgaattacggcacaggcacgctcggcggcaccatgacccgctcctggccgccgggtaaaacgctgattgcccgcctgatgaactgctgcggcggctatctgaatcactatggcgactattccacggcgcaaatcgctgccggactgaattacacctatggcggatgggccgacggcaacagcccgtccgacatcgaaaacagccagctagtggtgttgttcggcaataacccaggcgaaacgcgcatgagcggcggcggggtgacctactacgttgagcaggcgcgggaaaaatcgaaggcgcgcatgattattatcgatccgcgctataccgataccggcgcagggcgcgaagatgaatggatccctattcgccccggtaccgatgcggcgctggtgtcggcgctggcatgggtgatgatcgacgaaaatctcgtggataagcctttcctcgataaatactgcgtgggttacgacgaaaccacattgccggaaggcgcgcccgccaacgggcattacaaggcgtatattctgggcgacggcgatgacggcatcgccaaaacgcctgaatgggcggcggctattaccggtatcccggcggcccgtatcgtgaagctggcgcgggaaatctccatggcaaaaccggcgtttatctcccagggctggggcccgcagcgtcattcgaacggcgaactggtctcccgcgccattgccatgctgccattgctgaccggcaatgtgggcatcaacggcggcaacagcggcgcgcgcgaaggcgcttatgcgatgccgtttgagcgcatgccgacgctggaaaacccggtgcagaccagcatttccatgtttatgtggacagacgccattgagcgcggcccggaaatgaccgccacccgcgacggcgtgcgcggcaaagataagctggatgtgccgatcaagatgatctggaactatgcaggtaactgcctgatcaaccagcattcagaaatcaatcgcacccatgacatcttacaggatgataaaaaatgcgagctgattgtggtggtggactgccacatgaccgcatcggcgaagtatgccgatattatcctgccggactgcaccgcgtcagaacagatggatttcgcgctggacgcctcctgcggcaacatggattacgtgatcttcgccgaccaggccatcgctccgctgtttgagtgcaaaaccatttatgagatgacgacggaactggcgaaacgcatgggcgtggaagcgcagtttaccgaaggccgtactcaggaaggctggctgcgccatctttatgagcagtcccgcgcagcgatcccggcgttgccctcctttgaggagttccgggcacagggcatttttaaacagcgcgatcccgacgggcaccatgtggcctatcaggcgttccgtcaggatccgcaggcgaacccgctgaccacgccgtcgggcaaaatcgagatttactccacgcaactggcagagatcgccgccacctgggagcttgtggatggcgatgtgatccacccgttgccgatctacagcccgggcttcgagcatcacgaggatccacagcgcgaaaaatggccgttgcagctcaccggcttccattataaagcccgcacccattccacttatggcaacgtcaatgtgctgaaggccgcgtgtcgccaggagatgtggattaaccccctcgacgcgaaacaacgtggcatcgccagcggcgacaaagtgcgtattttcaatggtcgcggcgaagtacatgtcggggcgaaggtcacgccgcgtattttgcccggcgtggtggcattaggggagggcgcctggtacgacccggacgcgaaaggcatcgatcagggcggctgtataaacgtgctgaccacgcagcgcccgtcaccgctggcgaaaggtaacccgtcgcacagcaaccttgtccaggtcgaaaaggtttaaggagtaacccatgacaactcagtacggcttttatattgattccagccgctgcaccgggtgcaaaacctgcgagctggcctgcaaagattacaaagacctgactccggaagtcagtttccgtcgcatctatgaatacgcgggcggagactggcaggaagacaacggcgtctggcagcagaacgtgtttgcctattatctgtcgattgcctgcaaccactgcgccgatccggcctgcaccaaagtctgccccagcggcgcgatgcacaagcgcgacgacggttttgtggtggtgaatgaagaggtgtgcatcggctgtcgttactgccatatggcctgcccgtacggcgcgccgcagtacaacgccgctaaaggtcatatgaccaagtgcgacggctgccattcgcgggtgacggagggcaaaaagccgatctgcgtcgagtcctgcccgctgcgcgcgctggactttgcgcccgttgacgagctgcgtgaaaaatacggcagccttgatgccgtcgccccgctgccgtccgggcattttacaaagccgaatatcgtgatcaaacccaacgccaacagccgccccaccggggataaaaccggctttctggctaacccgcaggaggtgtgagatgggcaacggatggcatgaatggccgctgatgatttttaccgtgtttggtcagtgcgtggtcggtggatttatcgtcctcgccgtcgcgctgctgcgttttgagacgacatcgttgcaacggcaacgcatcttcaccgccatgaccggcctgtgggtgttaatggggctggcctttgtggcctcgaccctgcatctgggatcgcccctgcgcgcctttaatgcgctcaatcgcattgggcattcagcgctgagtaacgaaattgccagcggtgcgctgttctttgccgtgggcggatgcggctggctgctggcaatgatgaaaaagatgccgcccgcgctgttacgcgtctggctggtgatcaccgcgctgctggggctggtatttgtctggatgatggccagggtgtatgacagcatcgacaccatccctacctggtacagtctctggacctcgctggggtttttcctcactgtgcttactggcggcccgctgctgggctatctgctgctgcgggttgccgggtttcgggcatgcggcatgcgcgcgctgccagcggtgacgctgctggcggtcatgatcagccttgtggctggcctgatgcagggccatgaactggcagcgatttccagctctgtgcagcaggctgcggcgctggtgccggaatacggcaccctgatggcctggcgcgtcgtgctgctgctggtggcgctggcagtgtggatcgtcccacagcttaaaaaccgccagcctgccgtgccgctgctgtcgctggcattcgtgctggtgctggcaggcgagatgatcgcgcgcggcattttttatggtttacacatgacggtcggcatggcggtggctggctgacgtcatcagggtaaaaccggggggccaaccgccggttttaccgttttttcaccatgaaatatttcaactgaatgtaacggtatatcccggaaataacccatataaaacatcacgctattcactttgctctggccttacccgctccgttagatgagtaaattcaatcgacgtcctctaaaacgcccgcagcgccattttccgtagattgacaaagtttttgccggtggcatgatgcgctcgaattctgatcatcctcacggtttttcatccatgtttacttatacccggccggtgctgttactgctctgcggcctgttactgctgacgctggcgatcgcaacgctgaacacgctcgtcccgctctggctcgcccatgaaaaccttccggtgtggcaggttggtatggtcggctctgccttttttaccggcaaccttgtcggtaccctgctgaccgggcgtctgattaaacgcatggggtttaaccgcagctattacatcgcgtcgctggtgttcgccaccggctgcgtcggcctcggtctgatggtcggcttctggaactggatgctgtggcgcttcatcgccggtattggctgcgccatgatctgggtggtggtggaaagcgcgctgatgtgcagcggcacgtcgcgaaatcgtggtcgcctgctggccgcctatatgatggtctattacatcggtacggtgctgggacaactgatggtcagcaaactgtccaccgagctgatgcatgtcctgccgtgggtgaccggtatcgtgctggcggctattctgccgctgctgtttacccgcattgtcgatcagaacagcgaacatcaggaagccaccagcgtctggccgatgctgcgtctgcgtcaggcgcggcttggggttaacggctgcattatttccggcattgtgctgggttcgttgtatggcctgatgccgctctggctgaaccaccgtggcgtgagcgatgccggtattggcttctggatggccgtgatggtcagcgccggtattctcggacagtggccgattggccgactggcggatcgctttggacgtctgctggtgttacgggtgcaggtttttgtggtgatcatgggatgtctggccatgctcagcaatgcggcgatggcgccggcgctgtttgtcctcggcgcggcggggttcacgctctatccggtggcgatggcctgggcctgcgaaaaggtcgaacatcatcagttggtggcgatgaatcaggcgcttctgctcagttacaccgtcggcagtcttttcggcccgaccttcaccgccatgctgatgcaaagttattccgataatttgttgtttatcatgatcgccagcgtctcctttatctatctgctgatgctgctgcgtaaagcaggtcagcatccaacgccagtggctcacgcctgataaataaaaaagcctgtccatgacaggcttttttacggctgctttccaggatttctttcctgtttttgtaaagcggaacggacgataattgccatgagtacactctgactaaggcggcaattatgcacactcgtcgttttaataccctcgcgctggcagtcgttttatccctgtcctttgtttccgcaccgggcatggctaaccctggtaacgggaatggtaacggaaatcacggtaacgcggatcatgggaataaacagaaaaatgaccatggcaaccggggcggggcggaaaagaaaaacgtcagcgatgatgtctctgtccggctgagctacgatcgcgcccgttcgctggcggtgaatcatggcctgacgggttaccgttcgctgccgcccggcatcgccaaaaacctggcgcgcggtaagcctctgcccccgggcattgccaaaaaaatggtgccgtcttctatgctggggcaactgccttcttaccccggttatgaatggcgtatcgccggtgacgatctggtattgattgcgctgagcacggccattgtgacggcagtcatcaacggcgtgtttgaataaataaaaaagcccggtcgctatgcggcgccgggctttttgtttttcttaagcttagtacatgaccttgtgaccatactgttcaaggatgcctttcacgcgctccatggtctcttttttcggcggatgcacgccatcgagcttgtactcttcgcccatcgccacccacttatgtttacccagctcatgataggggagcagttcgattttttctacgttacccatgtcgcgcgtgaattcacctaagcggtgggcagaatcatcatcgtccgaccagccgggcaccaccacatagcggatccagaccttaatgtttttcttcgacagatactgagcaaattccagcgtacggtgattggagacgcccaccagattctggtggatctcatcgttcatctgtttcagatcgagcatcaccaggtcggtgacttccagcagttcatcaatgaccggatcgtaacgacgcacaaagccattggtatcgaggcaggtatgaataccttccttgtgacaggcgcggaaccagtcacgtacaaattcagcctggagaatggcctcgccgccggatgcggtcacgccgccgcctgacgcgttcataaagtggcggtaggtcaccacttctttcatcagctcctcgacggtaatttctttaccgccgtgcgtgtcccaggtgtcacggttatggcagtacaggcagcgcatcaggcagccctgaaagaaggtgataaagcgaatgcccgggccatctacggtgccacaggattcaaaggagtgaatgcgaccgatcactgacattgcgatgtatctccaggtgtagcccgtcccgggcttgtattgcacagctcaaaccggctgtgttaagtctgttttggcaatggcctgaaaagacacttggcaaagcaggcttgatgaagagggggaactgttaaaaaggccccacataagtggagcctttattgtacgctttttcagccggacatgaaattacatggtctgggtgaaggtacgggtaataacgtcctgctgctgttctttcgtcagggagttaaaacgtaccgcgtagccggatacacggatggtcagctgcggatatttttccgggttttccatcgcgtcgagcagcatttcacggttcatgacgttgacgttcaggtgctgaccgccttcgatggtagactcatgatggaagtaaccatccatcaggcctgccaggttggttttacgcacttcgtcatctttacccagcgcattcggtacgatagagaaggtgtaagagataccatctttagcgtaagcgaacggcagttttgcaacggaagtcagagaggcaacggcgcctttctggtcacggccgtgcatcgggttagcacctggtccaaacggcgcgccagcacgacgaccatccggggtgttacccgttttcttaccatacacaacgttagaggtgatggtcagaacagactgcgtcgggatagcgttacggtaggtagtcagtttctgaattttcttcatgaaacgttcaaccaggtcaaccgccaggtcatctacgcgagcatcgttgttaccaaactgcgggtattcaccttcgattttgaagtcgatagccagaccgtcttcgtcacgcaccggggtgactttcgcatatttgattgcagacagggagtcagccgcaacggacagacctgcgataccacacgccatggtgcggataacgtcacggtcgtgcagcgccatcagagaggcttcgtagctgtacttgtcgtgcatgtaatggatgatgttcagtgcggtaacgtactgtttagccagccagtccatgaagtgatccatgcgatccagcacttcatcgaagttcaggacatcgcctttgataggttcagacttcggacccacctggattttcattttttcatcaacgccgccgttgatagcgtacagcatggttttcgcgaggttagcgcgagcgccgaagaactgcatttgcttaccaacaaccatcgggcttacgcagcaagcgatcgcgtagtcgtcgttgttgaagtcaggacgcatcaggtcatcattttcatactgcagggaggaagtatcgatagacactttcgctgcgtattttttgaaggccatcggcagtttttctgaccacagcacggtgatgtttggttccggagacggacccatggtgtacagggtgttcaggaaacggaagctgtttttggtaaccagagtacggccatcaacgcccataccaccgatagattcagttgcccaaatcgggtcgccggagaacagttcatcatactcaggggtacgcaggaagcgaaccatacgcagtttcatgaccaggtggtcaatcagttcctgagcttcttgttcggtgattttgcccgctttcaggtcgcgctcaaagtacacgtcgaggaaggtggaaacacgaccgaaggacattgctgcgccgttctgggatttcacagcggccaggtagccgaagtaagtccactgtaccgcttcttgcgcattttttgccggagcagaaatatcgcagccgtatttagcagccatctctttgatctggcccagagcacggtgctgttcggcgatttcttcgcgcagacggatagtcgcttccagatcaacgccgttttccagtttgtcctgcagggacaggaactgggcgtatttgtctttcatcaggaagtcgatgccgtacagcgcaacgcgacgatagtcaccgatgatacggccacggccataggcgtccggcagaccggtcagcacaccggatttacggcagttcaggatgtctttggtgtaaacatcgaacacgccctggttatgggttttacggtattcggtgaagatttttttcagcatcgggtccagctcgcggttatacgctttgcaggaaccttcaaccattttaatgccgccgaacgggatgatcgcacgtttcagaggcgcttcagtttgcagaccaacgattttctcaaggtttttgttgatgtagccagcatcatgagaagtaatggtggaggcaattgaggtgtcgaaatcaacaggtgcgtgagtgcggttttccagcttcacgccttccatcactttgtcccaaagcgaggtggtagcttcagtggcgccggccaggaaggattcgtcaccctcgtaaggcgtgtagtttttctggataaagtcgcgtacgttgacttcgttctgccagtcacctttcgcaaaaccttcccaggctgtggctaacttttcattaagctcggacatatgatacctaccttcttaagtggattttttatttactgcctgaggcaaccattaatgatggtcgtcgccacgcaggtaaatgacccagtatgtcaacccaacaagtaaacccccgccgataatgttcccgatggttaccgggatcaggttatctgttatgaagttcatcactgtcagatgagaaaaactttctggagtcgaaccgatcgcggtccagaactccggcgctgcaaaatgacgaattacgatacccagtgggatcaagaacatgtttgcaatactgtgttcgaagccgctggcgacaaacataccgacgggcagaaccatgatgagggctttatccatcaggctgcggccggagtaactcatccataccgccagacagaccatcaggtttgccaggatcccgagagccacggcttcgacaaaagtgtgatgcattttatgatcggcggtttgcaggaggttgagtccccagccaccgttagcgaccatatattcaccagataaccacatcaacagtacgaataatagcgcaccaatcaggttgccgacataaacgttaacccagttccgggcgagctggccccaagtgatgcgtccgctggctttcgcgacgacaatcagtaccgttgaagtaaacaggtcggcgccgcagataacgcacaggatcagccccagagaaaaacatatgccgccaatcagtttggcgataccgaacggcatagtcgcggtgccggtcgtggcagtgatgtagaacacgaaagcgatggagatgaatacgcccgcggtgatcgccagataaaaggtggtcagcggatgtttcgttgctttatagacaccggcttcctcggcaactttcgccatagcagctggtagcaatagatcaaaagggttgtcagctttcacactaactctctctttattaagtcggcgacgagatactaacaaagcattatagaagagaaattgatgtggatcatatctcgcctggcttataggcccgtaaagcgcatggttttccggcaaatacggagtaacgtgttgattatccaaataaaaataaattttaaagtttattaaaagtgttgaaaaaaattatatgctctcccggctgacagttaattaatatggagtaatgacttaaaaaagtaacaattctgcctgggtgtcgataataatattcacccataattaacttaattattacatttgcggttcattacaaaataataaaaaaaggggcgatttaatcgccccgtaatatagcctgaacctgcgcttacgcctacaggttgtaatgttatttctgcttattttgtccagtaggccgctttcgcgcgctgcaacttctcatatgcctgtaacagagactgatgcgccgggaaggcggtcaatgtgccgtcggcggcctgcaggccatagaagggcgcttcaccgctcagcgccgcgctggccgcttccacggcctctgcgccgtacatacgcacaaaagcgtgcagatattgcagcggctcgcgatcctcttcctgcgtcagcagcaacagcgtttgcaggcagcggtaatagttggcgcgttccggcgtaaagatcgaggcgttgaattccatcgtccattccgtccagatgagcgcctgctcggtgtcgccacccgccagcgccagcatcgctttcagttcgccgatgcgcagcgtgtaccagccattatctttacccgtggcgatacccagcagttcacgcacgcgggtgaaatcgtcatggccttcttcatccagctgcgcgatcagattgagataatcttctttttcccacgcgctgcccggcagcgccagcagagtctcacgcaggtgcgcgcccatgctgttattcgccagccacagatcttccgccggataaatatcagacattcccggcacgatgatgcggcaggcgtacacgctcaggtgctcgtagtcggcgatatagacttctttatcttccgccttaaagatggccatcagggtggcaaactcttcttcggtggtgccggcaaagctccagtccacgaacggataatccgcatcctgtttgaacatgtcccaggagatcagaccgctggaatcgataaagtgcgtttcgagattcgcatgttcagccacttcttcatcatcaaaggttggcggcgtaaagacgtcgagatctttcagtccgcgtccctgcaacagctcggtcacagtacgctcaagggccacgccaaagtccgggtgcgcgccgaaagaggcgaagcaggtgccgttagccgggttaaacagcacgacgcagatcaccggatatttaccgcccagcgaggcgtcatacgcgaaaatcgggaaaccttcggcttccagcgtttcaatagatgccaccacgcccggatagcgcgccagaacgtcagccgggattaccggcaggctgatgctttcggcgatgatgcggtttttgatatggcgctcaaacacctcagacagaccctgaacgcgggcttcgttggcggtattaccggcagacataccgttagaaacgtacaggttgccaacgatgttcatgggaatataaaccgtctgctgatcggactgacgggtgaaaggcaggccgcagatcccacgctcttcattgccggactgcaaatcaatcagcatgctggcggtcagttcgttttccggatcgtagaacgcgcgcagacgctcatcaagaatgcctttcggcagttcgtcgtcttccggcagcgggaaccatttttcgttagggtaatgaacgaacgggccattggcgatggcatcgcccagccagaaatcggcaaagaaatagttggtggagaggcgttcgaaatattcgcccagcgcggaagccagcgccgcctttttggtcgcgcctttgccgttggtaaagcacagtgagcaggctttatcccggatgtgcacagaccagacgttcggaaccggattcagccaggaggcttcttctatatcgaagccgagatcgagcagtttttgctggaagcgggcgatggaatcttccagagcggcatctttgccggggataaatgtttgcgtcattgtcttcactttattcgtacggaaagcgcgcaatgatacgggttttgcgtgacaggcgctatcgaagtaagccgggcggcaaaaataaaacttcccactatgcttatactcactaacatactgttcaggatgaataaaatgaaagcgtttgatctgcaacgtatgatgctggataaagtgccgctggagtttttgggcgaagtcgcgctgcgtagtctttatacttttgtgctggtttttatatttcttaagctggcaggtcgccgtggcgtacggcagatgtcgctgtttgaagtgctgataattctgacattgggatcggctgcgggggatgtggcgttttacgacgatgtccctatgctgcccgtattcatcgtatttcttaccctggcggtgctttaccggctggtgatgtggttgatggctcacagtgaaaaactggaagatctttttgaaggtaaggcggtgatcgtcatcgaagaaggcgagctggcgtgggaaaaactgcaaaaagaaaacctcaccgaatttgaattttttatggagctgcgggttaacggcgtcgaacagctggggcaggtcaaactggcgatcatggaaaccaatggccagatcagcctctattattatcctgataatgaagtccgtccgggtctgagtatattgccgccggaatggagcccgcgtttcacgactattcctgaagaagatgattacgcctgcataaggtgcagtgaggtcataagaatgaaggcgggtcagcggatgctctgcccgcgctgcgcccatcccgaatggtcaaaagcgagccgcgcgctacgcattacctgacagcgtttttctccataagaaatcagcaagtccggacattgtgctatgtgataacgcccacaattccgggctgtgcgccattacccgttgcgacacccgtcactgaatggtaaaaccgatgtcacaggaataacttattgctatcagcatggtgaggggaaatggctcaggtgtttaatttcagttcaggtccggcggttttaccggcagaggtgcttaaacaggcgcaacaggagttgtgcgactggaacggtcttggcacatcggtaatggaaatcagccaccgtggaaaagaatttattcaggtggcagaagaagcagaacaggattttcgcgatctgctggacatcccctcaaactataaagttttattctgtcacggcggcggtcgcggtcagttcgccggtatcccgctgaatatcctcggcgataaaaccactgccgattatgttgatgccggttactgggcggcaagcgcggtaaaagaggcgaaaaaatactgcaccccaaacgtcattgacgctaaaactaccgttgacggtctgcgtgctgtgaagccgatgcgtgaatggcagctcagtgataacgccgcctatatgcattattgcccgaacgaaaccatcgacggtatcgccattcatgagactccggatttcgggcgcgacgtcgtggtaacggcggatttatcctcgaccattctgtcctcgccgctggatgtcagccgcttcggcgtaatttacgccggcgcgcagaaaaatatcggcccggccggactgacgctggtgatcgtacgtgaagatctgctcggcaaagcgcatcccgcctgtccctcgatcctcgattacaccgtgttaaacgataacgactccatgtttaacactccgccgacctttgcctggtatctgtcagggctggtgttcaaatggttgaaaaagaatggcggcgtcacggccatggaccacatcaatcagcaaaaagccagcctgctgtacggcgtcatcgataacagcgacttctaccgcaacgatgtggccgtcgctaaccgctcgcgcatgaacgtgcctttccagctggccgacagccagcttgataagctgttccttgaagagtccttcgccgccggtttacatgcgctgaaaggccaccgcgtcgtgggcggtatgcgcgcctcaatttataacgccatgccgctggaaggtgttcaggcgctgaccgacttcatgacggatttcgaacgccgccacggttaatcccgcatcccatcgctacccccgcagcctgactgcggggtttttattccgtttttttgagagttaagcttcatggaatccctgacgttacaacccatcgcgcgtgttaatggcaccatcaatctgccaggttcaaaaagcgtttccaaccgcgcgttgctgctggccgcgctggcgcacggcaccactgttctgaccaacctgctggacagtgatgacgttcgccatatgctcaatgccctgagcgcgttgggggtgcagtacaggctgtccgacgatcgtacccgctgtgaagtgacaggcgcgggcggcccgttagtttccgctgaaaagctggagttatttttaggtaacgccggtacggcgatgcgtccgctggcggcggcgctttgtctgggaaacaacgatctggtgctgaccggcgagccgcgtatgaaagagcgtcctatcgggcatctggtggacgccctgcgtcagggcggcgcgcagatcgactatctggagcaggaaaattacccgccgctgcgtttacgcggtggtttcgctggcggcgagattgaggttgacggcagcgtctccagtcagtttttaaccgcactgctgatgaccgcgccgctggcggcgcaggatacctttattaccattaaaggcgatctggtatctaagccgtacatcgacatcaccctgcatctgatgaaaaccttcggtgtgacggtggataaccagaattatcagcgctttgtggtacgcggcgcgcagcactaccagtcgccaggacattatctggtagaaggcgatgcctcttctgcctcttatttccttgcggcgggtgccatcaaaggcgggacggtaaaagtcaccggcattggccgcaacagcgtgcagggcgatatccgttttgcggacgtgctggaaaaaatgggcgcgaccgtggaatggggcgatgattacattgcctgcacccgtggtgagctgaatgcagtggatatggatatgaatcatatcccggatgcggcaatgaccatcgccacggcagcgctgtttgcccgcggcaccacgacgctgcgcaacatctacaactggcgcgtaaaagagaccgaccgtctgtttgcgatggcgaccgaactgcgcaaggtaggcgcagaggtggaggagggcgaagattatatccgcatcacccctccggcctcgttaaccctggccgagatcggcacctataacgatcaccgcatggcgatgtgcttctcgctggtggcgctgtccgatacgccggttaccattctcgatccgaaatgtacggcgaaaaccttcccggattatttcgaacagttagcgcgcatcagcacgctggcgtaaagggcgacaatccagacgcgctggataaaaagtaacaaattgtctctttccgggctgacttcctgtcagccctctatacttgcgccattcttctccccaccgttattacgcttttggttattttcacgcgacagtaacggtcattcgcgttgcagcgtataatgcgcggcgttcacgttaacggtatgcctttattaaggagaaaaagatgacggcaattgccccggtaatcaccattgatgggccaagcggcgcaggtaaaggtacgctgtgcaaagcgatggcggaaacattgcaatggcatctgctggattcaggcgcaatttatcgcgtgctggcattggcggcattacatcaccacgttgatgtgacctcggaagatgtcctggttccgctggcagcccacctggatgtccgctttgtctctaccaatggcaatctggaagtgatcctcgaaggggaagacgtgagcggcgagatccgcacccaggaagtggccagcgccgcctcgcaaatcgcggcgttcccacgtgtacgtgaagccttgcttcgtcgtcagcgcgccttccgcgatgccccggggcttatcgccgatggccgcgacatgggcacggtggttttccccgacgcgccggtgaagattttcctcgacgcctcctcggaagaacgtgcgcatcgccgcatgctacagttgcaggagaatggctttagtgttaactttgaacgccttttggccgagataaaggaacgcgacgatcgcgaccgtaaccggccagtggcgccgctagtgccggctgctgatgcattagttctggattctaccagtttaagcattgagcaagtgattgaaaaagcgctacaatacgcccgcgaaaagctggcgctcgcttaattagcgaccaaattccgaagtacctgctgcaatggagtgtgagcaggcatgtgaaacaaccccatccggcatgaagccagatggacgttaaattgaagaatcctgaagattatcaatatgacagaatcttttgctcaactatttgaagaatccttaaaaacaatcgaaacccgtccgggttccatcgttcgtggtgttgttgttgctatcgataaagatatcgtactggttgatgccggtctgaaatctgagtccgccatcccggctgagcagttcaagaacgcccagggcgaactggaaattcaggttggtgacgaagttgacgttgcgctggacgcagtcgaagacggcttcggtgaaactctgctgtcccgtgagaaagctaaacgtcatgaagcttggatcacgctggaaaaagcatacgaagacgctgaaactgttgttggtgttatcaacggcaaagttaaaggtggcttcactgttgagctgaacggtattcgtgcgttcctgccgggttccctggtagacgtgcgtccggttcgcgatactctgcacctcgaaggcaaagagctcgagttcaaagttatcaagcttgatcagaaacgcaacaacgtggttgtttcccgtcgtgcggttatcgagtctgagaacagcgctgagcgcgatcagctgcttgaaaacctgcaagaaggcatggaagttaaaggtatcgttaagaacctcactgactacggtgcattcgttgatctgggtggcgttgacggcctgctgcacatcacagacatggcatggaaacgcgttaagcatccgagcgaaatcgtaaacgttggcgacgaaatcactgttaaagtgctgaagttcgaccgcgagcgtactcgtgtatctctgggcctgaaacagctgggcgaagatccgtgggtagctatcgctaagcgttatccggaaggtaccaaactgactggtcgcgtgaccaacctgaccgactacggctgcttcgttgaaatcgaagaaggcgttgaaggcctggttcacgtttccgaaatggattggaccaacaaaaacatccacccgtccaaagttgttaacgttggcgatgtagtggaagttatggttctggatatcgacgaagaacgtcgtcgtatctccctgggtctgaagcagtgcaaatctaacccatggcagctgtttgctgagacgcacaacaaaggcgaccgtgttgaaggtaaaatcaagtctatcactgacttcggtatcttcatcggcctggacggcggcatcgacggcctggttcacctgtctgacatctcctggaacgttacaggcgaagaagcagttcgtgaatacaaaaaaggcgacgaaatcgcagccgttgttctgcaggttgacgcagagcgtgagcgtatctccctgggcgttaaacagctcgcagaagatccgttcaacaactacgttgctctgaacaagaaaggcgcaatcgtaaacggtaaagtgactgcagttgacgctaaaggcgcaaccgtagaactggctgacggcgttgaaggttacctgcgcgcttctgaagcgtcccgtgaccgcgttgaagatgcaactctggttctgaacgtaggcgacgacgttgaagctaaattcaccggtgttgaccgtaaaaaccgcgtagttagcctgtctgttcgtgcgaaagacgaagctgacgagaaagatgcaatcgctactgttaacaacaaacaggaagaaagcaacttctccaacgcgatggctgaagcgttcaaagcagctaaaggcgagtaatcagatactctctatcttttgtgctaacgcatgaaggatgacgagtagcttgacagattgcaggattcgtcctgtaatcaataacaaagggcggctacggccgcccttgtttaataagctgttagctaattttccttactaaggaaaccggaggaatcatgaccaagtcagaattgatcgaaagacttgccacccagcaatcgcatatcccggcaaaggctgttgaagatgcggtgaaagagatgctggagcatatggcctcgactcttgcacagggcgagcgcattgagatccgcggtttcggcagtttctctctgcactatcgtgcaccccgcaccggacgtaaccccaagacaggcgacaaagtggatctggaaggcaaatatgtcccacactttaagccgggtaaagaattacgtgaccgcgccaacatttatgaaaattaagttttactgctgataagcgaaaacttaatgacctgaaaaaagcacccaatgaggtgcttttttcatggctggtacatctctccgcaacccgcgccgcatttttaaagcgccgttgctgcaaaccgataaaatcttcccggccttcgccgtaaatccgcaaacgcctgcccgacatctcacgctggtttatgcacactacctgcaacaaggaggtggggatgcatttgccaggaattgccctgtgtctgctgaccgcgataacgccactgctgtggttgccaaaactgccggatcttaacagcatcttcattatgatctttatcggttgtttggcaggcgtttgccgcgatcgccgctcaggttatatcgggctatggctgctgtttatggcgtgggggatgcttgccgctaaagaagccctctggccgacagagcacctgcccggacgcgtccggcaggcggaagtgcgtcttaccggtaccgataacgtcactacgcaccgcggcgtgatagaaaggctgaacgggaaagctctgtatcctgcgccggggatcatgctttatggcgaatacctgccgcagcctgcctgtgccggacaattatggaagatgaccctcagggtgcgcccggttcacggtcagcttaacgacgggggatttgatactcagcgctacgccctggccacacacaagcccgtgaccggccgcttcacccgggcgaacgtgcttgatgcccgctgtagcctgcgggcgcagtatctggcttcccttgacgcaacgcttgaaaaagcacgctggcgagcggtgctgctggcattaggaatgggggagcgaagagcactggatgccccggtgaaagcgattatgcgtcagaccggcactgcacatctgatggccatatccggactgcatattgctcttgcggccacgctcggctggctgttagctcgcggaatacagttcttactgccgggccgctggatcgactggcgcgcgcccttattaacaggactgctatgcgcgacaggttatgcctggctgaccgggctgcaaccgcccgccctgcgcacagtcgtgtcgcttgcggtgctggcggcgctgcggctttcaggacggcaatggtcggcgtggcacgtctggctctgctgtctcgcggcgatcctgtttatcgatccgcttgcggtattgtcagaaagcctgtggctgtcggcgttcgcggtagcggcgttaatcttctggtatcagtggctaccgctgcccgcgtttcgcggcggacgattactgcgcagcatgataagcctgatccacctgcaaactggcatgatgctattactgctgccgttacaggtggcgctgtttcacggcatcagcctgacatccctggtggctaatttgctggcggtgccgcttgtcaccttcgtatgtgtgccgctgatcctggcagggatgttgctgcatctgacggcatttaacggactggaagcctggatctggacgcgagccgatgacacgctgacggcgctgttcggctttctgaatgctttacccgatggctggtacagcatcgacaggcgctggcaatggctggcatttgcgccctggctgatgatagttatctggcgtctgcgtatctggaaaacgtcgccctttgtctgtgccgcagcggtgctgctgatggcgcagccgttatggaaaagcacgcccaaagaccgctggtctgtctatatgctggatgtcgggcaggggctggcgatggtggttgcccggcagggcaaggccattctctatgataccgggctggcatggccgggcggcgacagtgcacagcaattgattgtaccctggctgcgctggcatcacctgcagccggaaggcatcatcctcagtcatgaccatctcgatcaccggggcgggctggaaaccctgcgtcagacgtggccagcggcctggatccgcagtccgctggacgaggccgggcatttgccgtgctttcgcggccagcgctggcagtggcaggggctgacgttcagcgttcactggccgttgccgggtactgcccttcagggaaacaaccgctcctgcgtggtaaaagtggacgacggtaaaaacagcattttgcttaccggcgacattgaagcttccgcagagcaatctatgcttagccattactggcagcatttacgggcaactgtcgttcaggtgccgcatcatggcagcagcacatcgtcgtcgctgcccttgctgcaacgggcaggaggccaggcggcactggcctcagcgtcacgctttaacgcctggcgattgccatcagaaaagattgttcgccgttatcagcagcagggatataagtggttcgataccccgcaccaggggcaaatcagcctccatttttccgcagaaggatgggaaatcttaggcttacgggatcaacttttcccgcgttggtatcatcagtggtttggcgtcccaggatataacaggtagaatatgcggctatttcaacaagtgctggttttttgaatgcataacgacaaagatctctccacgtggcaaacattccgccgtctctggccaatgattgcacctttcaaaacgggtctgctcgtggcgggtgtagcgttaatcctcaacgcagccagcgataccttcatgctatcgctcctcaaacctttactggacgaaggctttggtaaaacagaccgatcggtgctgctgtggatgccgctggtggtcattggactgatgatcctgcgcggactcaccagttatgtgtcgagttactgtatctcctgggtgtcgggcaaagtggtgatgaccatgcgtcgtcgcctgtttggtcatatgatggggatgccggttgctttcttcgacaagcaatctaccgggacgctgctgtcccgtatcacttacgactccgagcaggtggcttcctcctcttccggtgcgctgatcaccgtcgtacgcgaaggggcctcgattatcgggctgtttgtactgatgttttactacagctggcagctctccctcattcttattgtcctggcgcccattgtgtccatcgctattcgcgtagtgtcgaagcgttttcgcagcatcagtaagaatatgcagaacaccatggggcaggtgaccaccagcgccgagcagatgctgaaaggccacaaagaagtgctgattttcggtggtcagggcgtcgaagccaaacgcttcgataaggtcagcaataagatgcgtttgcagggcatgaaaatggtctccgcatcgtcgatttccgatcctattattcagctgatcgcctcgctggcgctggcatttgtactctatgccgccagcttcccgagcgtaatggaaaccctcacggccggtaccatcaccgtggtgttctcctccatgatcgccctgatgcgtccgctgaaatcgctcaccaacgtcaacgcccagttccagcgcggtatggcggcctgtcagacgctgttctccattctcgacagcgagcaggaaaaagacgaaggcacccgccagcttgagcgcgcgaaaggcgacatcgaattccgtaacgtcacctttacctatccgggccgtgatacgcctgcgctgcgtaatatcaacctgaccattccggcgggtaaaaccgtggcgctggtcgggcgctccgggtcgggtaaatcgaccatggcaagcctgctgacccgtttttacgacatcgacgaaggggaaattctgctcgacggacacgatctgcgcgaatacaccctggcgtcgctgcgtaatcaggtggcgctggtttcgcagaatgtccatctcttcaatgataccgtggctaacaacattgcctatgcccgcactgaagagtacagccgcgagcaggtagagaatgccgcccgcatggcctatgcgctggactttatcaataagatggataacggtctcgataccatcattggtgaaaacggcgtcctgctttccggcggtcagcgtcagcgtatcgccattgcccgcgcgctgctgcgtgacagcccgatcctcatccttgatgaagccacctcggcgctggacaccgaatcagaacgcgccattcaggcggcgctggatgaactgcaaaagaatcggacttccatggtcatcgcccatcgcctgtcgaccatcgaacaggccgatgaaattgtggtggtggaagacggacgtatcgtcgaacgcggtagccacgccgatttgattgcccgtcagggcgtgtacgctcagctgcataagatgcagttcggcgaatgatagcccgcatctggtcaggggagtcgccgctgtggcgactgctgctgccgctctcctggctgtatggtctggtgagcggcgcgatccgcctgagctaccgtatcggactgaataaatcctggcgcgcgcccgtgccggtggtggtggtggggaatctcaccgcgggcggcaacggcaaaacgccggtggtgatctggctggtggagcaactgcaacagcgtggcgtgcgcgtgggcatcgtctcgcgcggttacggcggcaaggctgcccgttacccgctgctgctcaatccgcaaacgtctaccgatgaagccggtgatgagccggtgttgattttccagcgcaccggcgcgcctgtggcggtgtcgcccgtgcgatccgacgcggtgcaggcgatccttgcccgctacccggtgcaaatcatcgtcactgacgacggtttgcagcactaccgtctcgccagagataaagaaattgtggtgatcgacggcgtacgtcgcttcggcaatggctggtggctgcccgcaggcccgatgcgcgagcgggcttccagactgcaaagcgtggatgcggtgatcgtcaacggcggcgaagcgcggcagggtgagatcccgatgcgtctgcaccctggtctggcgattaatctgaaaagcggcgagcgtcgggacgtgcgcgaactggcgcatgtcgttgcgatggcgggcattggtcatccgccgcgcttctttgccaccctggccgactgcggcgtgcagcctgaaaaagctattgcgcttgccgatcaccaggcgctggatcatgctcaggtcagcgcctttaccggatccggtcagacgctggtcatgaccgaaaaagacgcggtgaagtgccgtgcgtttgctgaagatcactggtggtatctgccggtggatgcacagcttacgggagacaaacccgaacaacttctccgggaactgcttacgctggcgcagcagggtaaccatccggcctgaggcgctgcttatcacagggatccctatgtcagttgcgcatctttctctatccgccgcccgctgtctgcatctcgccgcacaggggctactaaaaaaaccgcgtcgccgtgcccgtcccgccgatattctcgccgcgatccgccgcatgtccctgctgcaaatcgacaccattaatatcgtggcgcgcagcccttatctggtgctgttcagccgtctcggcgcttatccgcagcactggcttgatgacgccttacgcgccggtgacctcatggaatactgggcccatgaagcctgtttcctgccgcgcagcgattttgcgctggtgcgccatcgcatgctgaacccgcaaaatatgggctggaaataccgtgccgcctggatggaggagcatgcgccagagatcgaacagcttttgctgcaaatccatgaaaacggcccggtacgctcggcggactttgcccatccgcgcaccggtaccagcggctggtgggactggaaaccgcataaaaagcatctggaggggctgtacactgccggcaaggtgatggtggttgaacggcgaaacttccagcgcgtttacgatctcaccagccgcgtgatgccggagtgggacgacgaacgcgatctgctcagccagacgcaggccgaagccattatgctggaaaacagcgcccgcagccttgggctgtttcgtcctcaatggctggcggattactaccgtctgcgtcagcctgcgctgccagccttactcgcgcgctggcaggaagaacaaaaaattattccggtcaccgttgaggagcttggcccggcatgggtgcacgcctcgctgacggaagagctggcgctggccgcagcgggcaaactgaccgccacccacagcgccgtgctgtcgccctttgatcctttggtctgggatcgcaagcgtgccgaacagctgtttaacttcagctaccgtctggaatgctacacccctgcgcccaaacggcagtacggctattttgttctgccgctgctgcacgccggtcagctggtcgggcgtatggatgccaaaatgcaccgcaaaacgggcgtgctggaaatcattgcgctctacccggaggcgggcatcacgcctggccgcacgctggaaaagggacttcttcaggccattaccgaatttgccgcctggcagggagcgacccgcgtgagcataacgcgctgtccgccggaattattccctgcctgtcccacaggctgggaaattgacccggcctgaaaaatgtatatggtaaacttttgcgaaaccttatccgttccatctggaggaaccatggatcaccgtctgcttgaaatcatcgcctgcccggtttgcaccggcaaactctattacagccaggagaaacaggagctggtctgcaaaatcgacaatctggcgttcccggtgcgtgaaggcattccggtgctgctggaaaacgaagcccgcgccctcactgctgaagagaaccgtccatgagtttcgtcgtcataattccggcgcgctatgcctcaacccgtctgccgggcaaaccgctggtggacatcaacggcaagccgatggtggtgcacgtgctggagcgtgcccgcgaatctggcgcggaacgcattattgtcgccacggatcatgaagaggtggcccgtgcggtggaagcggtgggtggcgaagtgtgcatgacccgcgtcgatcatcagtccggcaccgaacgtctggcggaagtggtggaaaaatgcggtcttagcgacgacaccatcatcgtcaatattcagggcgatgagccgatgatccccccggcgattgtgcgtcaggtggcggaaaatctggcgcagcgcgacgtgggtatggcgaccctggcggtgccgatccacagcgcagaagaagccttcaatccgaacgcggtaaaagtggtgaccgatgcgcagggctatgcgctctatttctcccgcgccaccattccctgggatcgcgatcgttttgcgcaaagccgtgacgccatcggccatactttcctgcgccatatcgggatttatggctatcgcgctggctttatccgccgctatgtcacctggcagccaagccagcttgagcagatcgaaatgctggagcaactgcgtgtgctctggtacggcgagaaaattcacgtggccgtcgcgcagacggtgccgggtaccggtgtggacacgccggaagatctggagcgtgttcgcgtcgaaatggcccgcagctaatccctccgtactttgtccagagataagctaaaacgcggtacagccttatctttggactatctcctgctcttttgatctcatgcgggtgacaagatcgtgacagacgctcattatgaaaacagtagttttcataggggtaaacggatatggaacgattgcgcgctgaattgagtcatctactgggcgaaaggctaagccgcctggaatgcgtaagcgaaaaagcggataccgcactgtggtcactgtacgacagcaacggtaatccgctgccattactggcaagaagctttaccacgcccggggttgcccgccagttggcgtggaaaatgtcgatgctggcgcgcagcggcacggtacgtttaccggtggtgtacggtgtcatgacccatgaagagcaccccggccccgacgtcttactgattgagcggctgcgcggggtatcggtggaagccccggcccgttcgccggagcgctggcaacagctcaaagatcagattgtcgaaggcctgctgagctggcacagacacgacagccacggctgcgtgggcgtggtggacagcacccaggaaaacatctggccgtcctggtatcgccagcgcgtcgaagtgctgtggaccaccctcggtcagttcaaaaataccggcctttccatgcagaacaaacgcattttgtttcgcacccgtgaatgtctgcccgcgctctttgacggctttaatgacaactgtgttctggtgcacggcaatttcacgctgcgcagtatgctgaaagatgcgcgcagcgatcagttgctcgcggcggttacgcccggcccgatgctctgggcgcccagggagtatgaactcttccggctgtgcgaaagcgactacgccgaaagcctgctgtggcattacctccagcgcgcgcccgttgcggagtcctttatctggcggcgctggttgtatacgctgtgggatgaagtggcccggctggtcaataccgggcagtttaaccgcagccgctttgagctggcctccaaatcactccttccctggctcgccggaagtgccttttaaccactgccagatgcgtcccagggtttcatagcccacccggtcgctgtgcatcagccagaccggggagggaataatacgttcccaggtgttaagcggcgaggcgatcgccaactgattcgccggtgcaggcagcggatgtaacccggcctgctggaaaaatatcatcgcccgcggcagatgggacgccgacgtcaccagcaggaaaggcgcatcgccaatcgccgcttttaccgccgccgcttcttcttccgtatctttcggcgtccccagcgtaataatgtcgctgcgcggaatgccgagggtttccgccacccgcgcgcccgcttcagcggtggtcaccggattgcctggcgccgccgcgccggtgaagatcatcttcgcgcccgggttcatgcgccacaaacgcaccgcctcattaagacgcggcagactgttattgattaaattcgagctgggcgcccactcagggttccaggtataaccgccccccagcaccacgatataactcacctgctgcgtaccgcgccaggtagggtatttatcttcgatcggttttaacaggccatcggcgacgggttgcaggctcagcagtaacagcaccagccagctgacgctgacgagggttttgcccgtgcgctggtaacgggaaaaccacagcagagcgatcccgagcgccatcagcaaaagcagcagcggcagggggagaataaaaccgcctatatattttttgagcgtaaaaaacaccgcatccgtctcctttttaaccatacagcaggtgaattccggcgatattacaccagataggttccttctgggcgcggctgtgacaaaatagcggttttgccaggatcgcacagccatgaaggatcgcaatttcgacgacatcgcggaaaagttctcccgcaacatctatggcacgaccaagggccagttgcgtcaggcgatcttatggcaggatcttgacggtctgctggcgacctttggcacgcagccgctgcgcattctcgatgctggcggcggtgaaggacaaacggcaattaaaatggcgcagcgcggtcatcacgtgacgctgtgcgatgtgtcggctgagatgatcgtccgcgcaaaagcggccgccgacgcgcagggtgtgagcggcaacatgcattttgtacaatgcgcggtgcaggacatcagccagcatttggaaagcccgcttgatctgatattgtttcacgctgtgctggaatgggtggcggaaccggtcgccgcgctccagaccttatggtcggtattgcgcgaaggcggggcgttgtccctgatgttctttaacgtccatggcctgctgatgcacaacatggtggtcgggaattttgattacgtacagctcgggatgccgaagaagaaaaagcgcacgttgtcgcccgattatccgcgcgatcccgccgaggtgtatcgctggctggaacagattggctggcagatcaccggcaaaacgggcgtgcgggtgttccatgattatctgcgtgtaaaacagatgcaacgcgactgttttccagcgctagtcgaattagaaacacgctattgccgtcaggagccttatatcaatcttggccgctatatacacgtgaccgcgctaaagccgcaggtgcaaggataaacgatgagtgaattttctcagacagtccccgaactggtcgcctgggcgaggaaaaatgatttttccatttcgctgccggtggacaggctttcatttctgctggccgtcgccacgctgaatggcgaacgcctcgacggagagatgagcgaaggggaactggtagacgcgttccgccacgtcagtgatgcgtttgagcaaaccagcgaaaccatcaatgtgcgcgcgaacaacgccatcaacgacatggtgcgtcaacgtctgctgaaccgctttaccagcgaacaggccgaaggcaatgccatttaccgcctgacgccgctgggcatgggcattaccgattactatattcgccagcgcgaattctcgacgctgcgcctttccatgcagctgtccatcgtggcggcagagctgaaacgggccgccgatgccgccgatgcaggcggggacgagttccactggcaccgtaacgttttcgcgccgctgaaatactcggtggcggagattttcgacagcatcgatctgacccagcgcgtgatggacgagcagcagcagctggtgaaagacgacatcgcccagctgctgaacaaagactggcgcgcggccatttccagctgtgaacttctgttgtcagaaacctcaggtacactgcgcgaactgcaggatacgctggaggcggcgggggataagctgcaggccaatctattgcagatccaggatgccaccgtcggacgcaacgatctggagtttgttgaccgtctggtcttcgatctgcaaagcaagcttgaccgcatcataagctggggccagcaggctattgacctgtggatcggctatgaccgccacgtgcacaaatttatccgtaccgctatcgacatggataaaaaccgcgtcttcgcccagcgtctgcgccagtcggtacaaacctatttcgatgccccctgggcactgacctacgccagcgcagaccgactgctggatatgcgcgacgaagagatgacgctgcgcgatgaagaggtcaccggcgaactgccgccggatctggagtttgaagaatttaatgaaatccgcgagcagctcgccgcgatgatcgaagcacagctggcggtgtacaaaaccagacaagtgccgctcgatctgggcctcgtggtgcgcgagtatctgtcgcaatacccgcgcgcgcgtcacttcgacgtggcgcggattgtggttgatcaggcggtgcgcctcggcgtagcgcagggcgatttcaccggactgccacccgaatggcagccgattaacgattacggagccagggtacaggcgcatgtcattgacaaatattgaacaagtgatgccagtgaaactggcgcaggcgttggcgaatccgttgtttccggcgctggacagcgcactgcgcgccggtcgtcacatcggcctggatgagctggataatcacgcctttttgatggatttccaggagtatctggaagagttttacgctcgttataacgtggagctgatccgcgcgccggaaggtttcttctatctgcgcccgcgctccaccacgcttattccccgctcggtgctgtcagagctggacatgatggttggcaaaattctctgctacctctacctcagcccggagcgtctggcgaacgaaggcattttcagccagcaggagctttatgatgagctgctgtcgctggcggatgaaatgaagctcttaaaactggtgaacaaccgttctaccggctctgaccttgaccgccagaaactgcaggaaaaagtgcgctcctcgttaaatcgtctgcgccgtctcggcatgatctggtttatgggcaacgacaacagcaaattccgcattaacgaatcggtattccgcttcggcgcggacgtgcgcagcggcgacgatccgcgtgaagcgcagcgtcgcttaattcgtgatggcgaagccatgcagattgaaaataacctgcagctcaatgacgagcaggaagaaactctgccggacggtggggaggaagaataatgatcgaccgcggaaaatttcgctcactcacgctgattaactggaacggcttttttgcccgcacctttgatctggatgaactggtcaccacgctgtcaggcggtaacggtgccggtaagtccaccaccatggcggcgttcgtcacggcgctgatcccggatctgacgctactgcacttccgtaacaccaccgaagcgggggccaccagcggctcgcgcgataaaggtctgcacggcaaactgaaagcgggcgtctgttattcggtactcgacgtcatcaactcgcgtcaccagcgcgtggtggtgggcgtgcgcctgcaacaggtcgccggacgcgatcgcaaagtggacatcaaaccctttgctattcaggggctgcctgccgatattctgccgacgcagctgctgaccgaaacgctgaacgagcgccaggcgcgcgtgctgtcgctggccgagctgaaagacaagctcgacaccctggaaggggtgcagttcaagcagtttaactccatcaccgactatcattcgctgatgttcgatctgggcattgtcgcccgtcgtctgcgctcagcctccgaccgtagcaaattctaccgtctgatcgaggcctcgctgtatggcgggatctccagcgccattacccgttcactgcgcgactacctgctgccggaaaacggcggcgtgcgtaaagcgttccaggatatggaagccgcgctgcgtgaaaaccgcatgacgctggaagcgatccgcgtcacccagtcggacagggatctgtttaaacacctgatctcggaagccaccaactatgtggcgtcggactatatgcgccacgccaacgagcgccgcgtgcatctcgaccaggcgctggcctatcgtcgcgaactctttacctcccgccagcagctgtcggcggagcagtacaagcacgtggatatggcgcgcgaactgcaggagcacaccggtgccgagggcgatctggaagccgaatatcaggccgccagcgatcacctgaacctggtgcaaaccgcgctgcgtcagcaggaaaagatcgaacgctacgaagcggatcttgaagaactgcaaatccgcctcgaagaacagaacgaagtggtggcggaagccgccgatcagcaggaagaaaacgaagcccgcgctgaagccgccgagctggaagtggatgagctgaaaagccagctggcgaactatcagcaggcgctggacgtgcagcaaacgcgcgccattcagtacaaccaggcgttgcaggccctgcaacgcgcccgcgagctttgccatctgccggatctgaccgccgaaagcgccgacgaatggctggaaactttccaggccaaagagcaggaagccaccgaaaaactgttgtccctcgatcagaaaatgagcgtcgcgcaaaccgcgcacagccagtttgaacaggcttaccagctggtggcggcgatcaacggcccgctgtcccgtaacgaggcctggagcgtggcgcgcgaattactgcgcgacggcgtgaaccagcgccatctggcggagcaggtgcagccgctgcgcatgcgtctgaacgagctggagcagcgtctgcgcgaacagcaggacgccgagcgtttgctggcggaattctgcaaacgccacggcaaaaatatcgatgccgacggcctcgaagccctgcatcagcagctggaagcgcaaatcgcctcgctgtctgaaacggtggcgaatgccggtgaacagcgtatggcgctgcgtcaggagctggaacagcttcagtcgcgtattcaggtgctgatgaagcgcgccccaatctggctggcggcgcagaacagcctggcgcaactgtgtgagcagacgggcgaggagttcgaaagcagccaggaagtcacggaatacctgcaacagctgctggagcgcgagcgcgaagccatcgtcgagcgcgatgaagtgggcgcgcgcaaacaggcggttgacgacgaaatcgagcgcttaagtcagccgggcggctccgaagatccgcgtcttaatgcgctggcggagcgttttggcggcgttctgctgtcggaaatctatgacgatgtcagccttgaagacgctccctattattcggcgctttacggcccgtcgcgccacgcgatcgtggtgccggatctgtcactgatcaccgaacagttagaggggctggacgattgtccggaagatctctatctgatcgaaggggatccgcagtcctttgacgacagcgtgttcggcgtcgatgagctggaaaaagcggtgattgtgaaagtcgccgaccgccagtggcgttactcccggttcccgtcgctgccgctgtttggccgcgcggcgcgtgaaaaccgtatcgaaagcctgcatgccgagcgcgaaaccctctctgaacgtttcgcgaccctgtcctttgacgtgcagaaaacccagcgtctgcatcaggcgttcagccgctttatcggcggtcatatcggcgtggcgttcgaaaacgatcccgaagccgagatccgccagctgaccagtcgccgtggcgaactggaacgcgccatcagcgcgcatgaaaatgacaaccagcaaagccgcatgcagtttgagcaggcgaaagagggcgtcgccgcccttaaccgcttgctgccgcgcatcagtctgctggaagatgacacccttgccgaccgcgtggacgagatccgcgaacgtctcgacgaggccgaagaagcggcgcgctttattcagcagttcggcaatcagctggcgaagctggagccaatggtatcggtgctgcaaagcgatccggaacagtacgaacagctgaaagaagattacgcgtactcccagcaggtacagcgcgatgcgcgtcagcaggcgtttgcgctgatcgaagtggtacagcgccgcgcgcacttcagctacagcgattcagcgcagatgctcgacggcaacagcgatctcaatgagaagctgcgtaaacgtctggaacaggccgaagccgaacgtactcgcgcccgtgaagcgatgcgcagccacgccgcgcagctgagccagtacagtcaggtgcaggcatcgctgaaaagctcttacgacaccaaaaaagagctgctcaacgatctgcttaaagagttgcaggatatcggcgtgcgcgccgacagcggtgccgaggagcgcgcgcgtattcgtcgcgatgaactgcatgcccgtctgtccggcaaccgctcacgccgcaaccagctggaaaaagccctgaccctgtgtcaggcagaaatggataccctgacgcgcagcctcaaacgccttgagcgcgattatcatgagatgcgcgagcaggtcgtgatgtcgaaagcgggctggtgcgcggtaatgcgcatggtgaaagacaatggcgttgaacgccgtctgcaccgccgcgagctggcatatctcagcgccgatgagctgcgttccatgtcggataaagcgctgggcgcgctgcgtctggcggtggccgacaacgaacacctgcgtgacgtgctgcgcctgtcggaagatcccaaacgtccggagcgtaaaattcagttcttcgtggcggtgtatcagcatctgcgcgagcgtatccgtcaggatattatccgcaccgacgatccggtcgaggccatcgaacagatggaaatcgaactgagccgtctgacggaagagctgacctcccgcgagcagaagctggctatcagctcccgcagcgcggcgaatatcatccgtaaaaccattcagcgcgagcagaaccgtattcgtcagctgaaccagggcctgcaaagcgtctccttcggccaggtaaacagcgtgcggcttaatgtcaacgtgcgggaaacccacgccacgctgctggacgtcctctcggagcagcacgagcagcatcaggatctgttcaacagcaatcgcctgaccttctcggaagcgctggcgaagctgtatcagcgcctgaatccgcagatcgacatgggccagcgcacgccgcagaccatcggtgaagagctgctggactaccgcaactatctggagatggaagtggaagtgaaccgtggctccgacggctggctgcgtgcggaatccggcgcgctctccaccggggaggcgatcggtaccggtatgtccatcctggtgatggtggtacaaagctgggaagacgaagcccgccgcctgcgcggaaaagatatctcgccatgccgtctgctgttccttgatgaagcggcccgtctggatgcccgttccattgccacgctgtttgaactttgtgaacgcctggagatgcagctgatcatcgcggcgccggaaaatatcagtccggaaaaaggcaccacctacaaactggtgcgtaaggtcttcaacaaccaggagcacgtacacgtggtggggctgcgcggctttgcgccgcagttgccggagcccttacccggaacggcggatgccaacgcatcctgatttttcaaaacagagggtggcttttgccacccttttcttttctgaacgccaggttttctttaaacttctttacattaggccgggcaaatgtatttttagctttatatactcaatataagcgtgacgcgttaacctcgtcgcaacaatttataaaaacagggggcaagggatgttgctgaataaaatgaagggtcgtcggatgtccgcactgggtttgtgcctggcattcgcatttgctccgctgtttaacgccatggccgatgagccggaggcgatccccaccgacagctcggcaactaccggccaacagccaacggcgctgttacagccgctggaacagtcacgcgccacggcggtgatggcaggccttgtgacgctgccggacgacgcggtcgccagtacgcgcagcgcgcttgaggcggcattaccggcgggctataaaccggtctatatgaatcagctggcggcgctgtacgcggcgcgcgagcagaagccgatgtgggagaatcgcgaggcggtgaaagccttccagcagcagctggcggaagtggcgatcgccggtttccagccgcagtttaccgcctgggtggaattactcaccgatccgggcgtgagcggaatggcccgcgacctggtgctgtctgacgcgatgatgggctatctgcagtttattgccgccatcccggttaagggcaacagctggttgtacagcgctaaaccctatgcgctggcgaccccgccgctgtccgtcataaaccagtggcagctggcgctggataaaggcgagctgccctcattcattgcgcagcttgcgccgcaacacgaacagtatgccgccatgcacaccgcgttgctggcgctggtggcggattcccagccctggccgcaactgacctccgcgggcaagctcaacccgggtcagtggagtaatgacgtgccggcgctgcgggaaattctcagccgctccggtatgcttgatgacggtcctaagattgcgctgccgggcgacagcagcgacagcggggcggtggtcagtccgtcggcggcaaacgtggacgaaaacgcagcccagccgacgccggtaccggataagaaaaataagcgggtggctgcggtacgcagtgcctacagtaaagatctggtggaaggggtgaagcgctttcaggcttctcaggggcttggggcggacggcgtgatagggccatcaacccgcgacgcgctgaacatctcccctgcgcagcgggcgggtgtgctggcgcttaatatccagcgactgcggctgctgccggagaagctctccaccggcattatggtgaatattccggcctattcgctggtgtactatcagcagggcaaccaggtgctgtcgtcgcgggtcattgtgggccgtccggatcgtaaaacgccgatgatgagcagcgcactgaataacgtggtggttaacccgccgtggaacgtgccgccgacgctggcgcgtaatgatattctgccgaaggtgtggaacgatccggggtatctggagcgccacaattatgtcgtgctgcgcggctggaacagtaaagagaccatcgatccatggcaggtagactggggcacgatcacgccgtccaatctgccattccgtttccagcaggcgccgggcgcgcacaactcgctgggccgctataaattcaatatgcccagctcagacgccatctatctgcacgacacgccgaaccataacctgttccagaaaaacgcccgtgcgctgagctccgggtgcgtcagggtcaataaggcctcagagctggctaacatgctgttgcaggatgcgggctggaacgatacgcgcatctccgatgccctgcgccagggcgacacgcgctatgtgaatattcgtcagagcattccggtgaacctttactacctcaccgcctttgtcgacgctgatggccgtacgcagtatcgtacagatatttacaattatgatctcaccgcgcgatcaagcgcacaaatcctgccaaaagcggaacaattaatcaggtaaatgaagcagttcagaaaaatctggagtcgtaatttccggcacttacgcgcaaacgggcagaaatgcccgtttattcgggccattgacctggcttgacgcagactttgttgcccggtaaggtgcctctcgtgcgccagaagtgcataaattacgcaactcttgacctgtagacctgattatcatggataaatttgacgctaatcgccgcaaattgctggcgttaggtggcgttgcactgagtgctgccatcttaccgacacctgcatttgcaaccctttccaccccacgcccacgtatattgacgctgaataacctgcataccggcgaatcaattaaggcggagttctttgatggccggggctatattcaggatgaattagcaaaacttaaccattttttccgcgattatcgcgcgaataaagtgaaatccatcgatccaaaactgttcgatcagctttatcgtttgcagggcctgctgggcacccgtaaaccggtgcagcttatttctggctatcgctcgctggataccaataatgagctgcgtgcccacagcagcggtgtggcgaagaaaagctatcacaccaaaggacaggcgatggatttccatgttgaaggcattgcattaagcaatattcgcaaagcggcgttatctctgcgcgcaggtggtgtaggatattaccccagcagcaactttgtgcatattgataccgggccggtccggcactggtaatctaagccttcaataaacaggagcagtatgaactatcgtattattccggttaccgcttttgcccagaactgttctttgatctggtgcgaagaaacacggcaggcagccgtggttgatcccggtggcgacgcagataaaatcagacaggttgtggacgccagcggcatgacgctgacgcagattttattgacccacggtcatcttgatcatgtcggtgccgccgcagaactggcgcaacattatgctgtgccggtgatcggcccggaaaaagaagatgagttctggctgacgggcctgcccgcccagagccggatgtttggcctggaagagtgtcagcctctgacgccggatcgctggctgaatgaaggggaaagcgtcagcctgggcaatatcacgcttcaggtactgcactgccctggacatacgccgggacacatcgtgttctttgatgaacgcgcccgtctgttaatttccggcgatgtgatttttaaaggcggcgtggggcgcagtgatttcccgcgcggcgaccatgcgacgcttatcgattcgatcaagcgtaagctgttgccgttaggtgacgacgtgaccttcctgccggggcatggcccgctgtcgacgctcggcgaagagcgcctgcacaatcctttcttacaggatgaaatgccggtctggtaataaaaaaaggtcgccgtggcgaccttttttaatgctcagaaacttacagcacggcgacaatggcttcgcacagcggcgccatattgtccggcgtcatacccgccacgttgacacggcctgatgccaccgcatacacgccgaattcctcacgcagacgcagcacctgctctttggtcaggccgctgaaggagaacatgccgttctgtttgatgatgaagctgaagtctccctgcgcgcctttctcctgtaaggtattcacaaacagcagacgcatacgctggatacgctgacgcatatccgtcagctcctgctcccagatggcgcgcagcgcgtcattgctgagaatagtcgccaccaccgaggcaccgtgcgccggcgggttagagtagttggcgcggatcaccgacttcatctggctgaacgcacgatccaccgtttctgcatccgcacacaccagcgtacaggcacccacgcgctcattgtacaggccgaagtttttggagtaggagctggcaacgatcagttcgtgatgcagcgcagcaaaggcacgcagaccttcagcgtcttcttccagtccacgggcgaagccctgataagcgaagtcgaacagcggcagccagcctttttgcgcggacagctcagccagctgttgccactgatccagcgttggatcgatacccgtcgggttatggcagcagccatggaacagcaccacgtcaccggcctgggcttcgttcaggctggccagcaggccgtcgaagtccagggtgtggctggtagcgtcatagtacgcatattcacgcacttccagacccgcggagttaaagacgcttttatggttcggccagcttgggttgcttacccagacgcgttttacgtccgtatttttcgccagaaaatccgccgccacgcgaagcgcgcctgtaccgccgggggtttgtgccgtgcgggcgcgtttgtcgttgatgagggcattgcctttgccaaacagcagctcctgcgtgcaacggccaaactccggaataccgtcaatgccgaggtaatttttagtcgtttcattttccagcagatactgctcagcttttttcacgctggtcagcaccggggtcttgccggtttcatctttatagacgccgatgcccagattaattttagtggggcgagtatcggcacgaaacagatcggccaggcccaggattgggtcggcaggggcagcagtgattttctcaaacatgacgaggttccattgtggtgtcaaaaagggaaagccgctatcaggttaacggctgatggagcaaatgccaaccgtttgcgacaaaaagaaaaaggaagtgcggggtgaagggaataacaggattttaaacataaaaaaacagggccggagccctgtttaataagcatataacgaggtgtgttacgacttagaactggtaagttacgccaacaacagcctggtcagcagaaccgacgaagccggtatcagcatcttcgtcatccagcaggttgatacggtagtcgccgtatacgttgaagttcttgttgaagtagtaagttgcgccaacggtcacgtattgcgccagatcgcggtcgccgatgcccggcagatctttagctttggactgcacgtaagatacggacggacgcagaccgaaatcgaactggtactgagcaatcatctcaacgttctgagttttgttcgcaacagtgtagaagttaccgtctgagttcggaacggttaaggaatcaccgctgttacccaggttagtggtgttacgggtttcagcatataccgcagcgaggtaaacgttgtttgcgtcgtatttcgcgccaacagcccatgcttcagcacggtcgccgttgccatcttctttctgcgcaacagtacggttagcggtgctgtaagaaccgatcacgccgaagccttcaccgaactcgtagcccagggacgcgcccacgccgtcgccgtttgcttcacgcaggttgtcacggtcgtttttgccctgatattgcaggccaaagctcagaccatcaaccagaccgaagaagttgctgttacggtaggtcagcagaccagtggaacgcatggtcatgaagttgtcagtgtatgcgccaccccaggtttcgccagagaaggacggagccatatcggtgtaggattctacatcgtaaacgatgccgtagttacggccgtagtccagagagccagcgtcagcaattttgataccagcgaaagccagacgggttacgttgtcctggctgccttcagctttgcttgctttagcacgatattcccactggccgtaaccggtaacttgatcgttaacctgagtttcgcctttgaagccgatctggccgtaagagttatctttgttagtggtgttgtcgccagaagtggtgaaggcgtgctcgccaacaactttgccgtacagatccagtttgttgccgtttttgttataaacttctgcagcgttagctgcaccggctaccagcagagcagggataaccactgccagaatattgcgcttcatcattatttattaccctcattaggttttatgaacacctgccactgccgccaatagattccgtcaataaatatttacggaactattgatgagagtttggtgtctctctgtgtctgagaggcatctttccattcatgtaatcgtttcgctagcgccaaagtgctacaaatgtcttaaagcggtaacgaaaagaaataatgtgtaacattgtgtgaatttttcggaactttgtgaaccatctctaatttccggactctccgctgataaattcagcgaatccattcctatatatatgaattgcttatatttaatagtgctaatggcaattcttatttaagaatcattcttatctctctttttcttataattgcatttagccgtccggattgccgggcgatttttatccacatgtgctaatgcttcagaaaaacctaatccgcaagaagtgaagggcttattttttgttcagaaatgtaaagacgacagggatggttacaaaagtgaaaagaagagagaggagtgttgagaatacagactgaatgttaacaaaagttgacaatgagccttaaaaataagggccagattagctggccctgatattcagaaactggcgttacgcggggtacgcgggaacggaatcacgtcacgcacgttctgcacgccggtcacataggcaatcagacgttcaaatcccagaccgaaaccggcatgaggaacggtgccgtagcgacgcagatcgcgataccagccgtagtcttctttattaagacccatttcagccatacgcgcatccaggacatccagacgctcttcacgctgggaaccaccgatgatttcaccaatccccggcgccagcacgtccatcgcggcaacggtcttgccgtcatcgttaagacgcatatagaaggccttgatgtctttcgggtagttcttcaccaccaccggcgctttgaaatgtttctcggcaagataacgctcgtgttcggaggagagatccacgccccagtaaaccgggttttcgaatttctcaccgcaggtttccagaatgcgcaccgcatcggtgtaatccacctgggcgaagtccgcagagatgaaacgctccagacgttcaatggcgtctttatccacgcgctcggcgaagaatttcagatcgtccatacgctcgtccagcacggctttaaagacatacttcagcatggcttctgcaagggcggcgttatcttccagatcgttaaacgccacttccggctccagcatccagaactcagccagatggcggctggtgttggagttttccgcgcggaatgtcgggccgaaggtatagaccttcgacagggcgcaggcgtaagtttccgcgttaagctggccggaaacggtcaggaaggcttctttaccgaagaagtctttatcaaaatcgattttgccctggtcgttgcgcggcaggttttccagatccagcgtcgacacgcggaacatttcaccggcgccttcggtatcggaggcggtgatcagcggcgtcgacacccagaagaagccctgctcatggaagaaacggtgcagcgcctgagccagcgtgtgacgtacgcgggctaccgcgccaatcaggttggtgcgtggacgcatatgcgccacttcacgcagatactcaatgctgtggcgtttggccgccatcggataggtatccggatcctcaacccagccggtgacttcaacgctggtggcctggatttcaaagctctggccctggcccggcgatgccacgacggtaccggtaacgatcaccgagcagccggtggttaaatgcagcacctcgtcattgtaattgggcagagaattattaataacggcctgtacaggatcaaagcaggaaccgtcatagacggccaggaaggagatgccagcttttgaatctcggcgggtacgtacccaaccgcgcacggtgacctgctggtcaacggctacacggccctggagtacgtcggctacaggcgcaacgctcataatattctctctgttaattgtctggaaaaaatagtcatttatccacccaatggggggatacctatgttacctggcatgcgccatcagacaagcagaattcgcagcaaccggcgaagaattaataaataaataagaagaagggagccattcaggctcccttttgcgattaactggcttttttaaccagcggtaaatcgaaggcttcacgcaatgcgcggacaaaagctttatcgtgacagatggtttttcccgggctgtccgagagtttagcgacgggcttgccgttacactccaccagtttgatcacgatattcagcggcttcacctgcggaatattacaggtcaggcgcgtaccgataccaaagcctaaattcacgcgtgaagagaagtgccggtaaagatcgatcgcttttttcagatccagattgtcggagaacaccagcaccttgctgtgcggatcgataccgagcttctgatagtgggcaatggctttttcaccccattccaccggatcgccggagtcgtgacgcaggccctggtagcgggtggcgaattccggaccgaaatcccgcaagaaggcgtccatggtgatgcagtcggtcagcgcaatgcccagctgatccgggtattcggcaagccaggcggcgagagccgcgcgctggctggtcgccaggtccgggctgatctgctgatgcgcctggaaccattcgtgcgcctgggtgcccattggcgtcaacgacagacggcgcgccagatcgtaattgctggtgccggtaaaccacggctcccgggtcagacgctcgacaatggcctgttgcacgctgcgggaaaaacgacggcgggtgccgaaatccatcagacggaaacgcgacagatccagatcggcggtcagatcagcaaactcgaccagcttctcttccagcatcgccagcgcctgcggcacccctgcttccggtgaacggtagctgtgcaccagctcgctaatcaccgccagcagcggcacttcccacaggatcacttcccgccacgggccgctcagacgaatattgagtttgccgttctcgttaatgacttccacctgttgtgggtcataacggaaatcgcgcagccagttgaggtaatccgctttaaagaagggaaggccggaaagccactggaattcatcatcctgcaagcgcaaatgttgcatggcatttatctgctcgcggatggcatccgcgtagatgcccagcagatcgtcaccacggcagcggaattcagccaccacctgcacatcggcgtagcggtggaaaacagcctgttgcatgtgcagcttgtacgcatcggtatcaagcagcgtatgcaggatcggggaagcaaattgtgtcatggcgtgccgtagcatcctctcacaggagcgtttagtacattaaacaacaggggagaatcgctggagtataccctgtttagcaatttattgaaccccgatcacaacataagcgggcttttcagacgagcgcaattcgtgccactgttataaaaatgtagcaaacaggacgtttctgtctgaaaagatgaagattctgcgtggcgagttgttcacaacaggaatagactggagtcgataccatactaaaagatgctaaaggttttttatgacacaacagccacaagccaaataccgccacgactaccgtgcgccggactacctgatcagcgatattgacttgacctttgacctggatgccgccaaaaccgttgtgaccgccgtaagccgcgtgtctcgtcagggcgcgtccgacgcccctttgcgtcttaatggtgaagatttaaccctggtctcattgcacattaatgatgcgccctggaccgactaccagatcgaagagaattatctggtgatttcggcgctgccggaccactttaccctgcgcatcgttaacgagatcagcccggcgaccaatacggcgctggaaggcctgtaccagtccggcgaagcgctctgtacccagtgtgaagcggaaggtttccgccatatcacctggtatctggatcgcccggacgtgctggcgcgttttaccaccaaaatcattgccgataaaaccacctatccgtacctgctctccaacggtaaccgtgtgggcgagggggatctggaaaacgggcgtcactgggtgcagtggcaggatccgttcccgaaaccctgctacctgtttgcgctggtggcgggggatttcgacgtgctgcgcgatacctttaccacccgctcaggccgcgaagtagcgctggagctgttcgtcgaccgcggcaatcttgaccgcgcgccatgggcgatgacctcgctgcaaaactccatgaaatgggatgaaacccgcttcggtctggaatacgacctcgacatctatatgatcgtcgccgtggacttcttcaacatgggcgcgatggagaataaaggcctgaacgtctttaactccaaatatgtgctggcgcgtaccgacaccgccactgataaagactatctcgatattgagcgcgttatcggccacgaatatttccataactggaccggtaaccgcgtcacctgccgcgactggttccagctcagtctgaaagaaggcctgacggtgttccgcgatcaggagttcagctcggatttaggctcccgcgccgtgaaccgtatcagcaatgttcggaccatgcgcggcctgcagtttgcggaagacgcaagtccgatggcgcacccgatccgcccggacaaagtcattgaaatgaacaacttctacaccctgacggtatatgaaaaaggggcggaagtgatccgtatgctgcatacgctgctgggagaagaaaacttccagaaagggatgcagctttactttgagcgtcacgatggcagcgcggccacctgcgatgattttgtgcaggcgatggaagacgcgtccaacgtggacctgtcgcacttccgtcgctggtacagccagtccggtacgccgattgtcagcgtgcgtgacgactacaacccggaaaccgagcagtacaccctgaccatcagccagcgcacgccgccgaccgctgagcaggacgaaaagctgccgctgcatattccgttcgatatcgaactttatgataacgacggccatgtgatcccgctgcaaaaagacggtcatgctgtgcatcacgtgctgaacgtcacccaggccgagcagacctttgtctttgataacgtctatttccagccggtgccgtcgctgctgcgtgaattctccgcgccggtcaaactggaatacaaatggagcgatcaacagctgacgttcctgatgcgccatgcccgtaacgatttctcccgctgggatgctgcgcaaagcctgctggcgacctatatccgcctgaacgtggcgcgccagcagcaggggcagccgctctccttaccgctgcatgtcgccgatgccttccgtgcgatcctgctggatgagcagatcgatccggcgctggccgcagagatcctgacgctgccatccgccagtgaggtggctgaactgttcgatatcatcgatccggtggctatcgctgcggtacgcgaagccctgacccggacgctggcgacagagctggcggacgagtgcctggccgtttataacgccaataaactcgacgcctaccgcgtggaacatgcggacatcggcaagcgctcgctgcgtaacacctgtctgcgctacctggcgtttggcgatgcgcagctgggggaccgtctggtcagtgagcagtaccataacgccgataatatgacggacgtgctggccgcgctctctgccgctgtagcggcgcagctgccatgccgcgatgcgctgatgcaggactatgacgacaagtggcatcacgacggtctggtaatggacaagtggtttattctgcaggccaccagtccggccgccaacgtgctggataccgtgcgcagtctgcttaatcaccgctcgttcaccctgtccaacccgaaccgcgtgcgttcgctgatcggcgctttcgccagcagcaacccggcggcgttccatgcggaagatggcagcggctatcagtttatggtggagatgctcaccgagctgaaccgccgtaacccgcaggtggcttcacgtctgattgagccgctgatccgcctgcgtcgctatgatgaaagccgtcaggcgttaatgcgtatcgcgctggaaaaactgaaagggctggataatctgtcgggcgatctgttcgagaagattgagaaagcgctggcgtaatctgctgttgttaccctctccgggaggagagggtagagagggtaaggatcagggtgagggggtaatccttcaccctgtttttactgctcttaccggcgcatcaatgcgtttcatcacccgatccagcacttctgattccagctctgccagccgcaccgagccgagcctgcgcggacgcgggatatccaccgtcagatccagcccgatttttccgtcttcaatcagcaggacgcgatccgccatcgccaccgcctcgctgacatcgtgagtcaccagcaataccgtaaagccctgggattgccacagcgattcgatcagcgcctgcatttccagccgggtcagcgcatccagcgcgcccagcggttcgtccagtaacagcagacccggtttgtggatcagcgcccgcgccagcgccacgcgctgtttttgaccgcccgagagcgccgctggccactcggtcgcgcgatcttcaaggccaaccgccgccagcgactgacgggccgcgtcgcgccagtcgcccttcaggccaaggccaacgttatcaatgaccgatttccacggcagcagacgcgcatcctggaacatcattcgcgtgtcgtcctgaatttgcgccagcggcgtggatccggcgaggatttcgccgctttgcggtttttccagcccggccagcaggcgtaacagcgtacttttaccgccgccgctgcgtcccaccaccgcaacaaactgcccggcaggaatgtgcagatccaggccattgagaatggtgttctggccgtagcgtttagtgacgccgttgagcaccagcggcgtaccgcgattaaggcgcgcagtattcatagatcactccttcgcagaataggccgggttccagcgtaaccagacgcgttccagcagttgcgcgctcagatctgccagtttgcccagcacggcataaagaatgatggcgaccaccaccacgtcggtctgcaaaaactcacgggcgttcatcgccagataaccgatcccggcgttcgccgaaatggtttccgccacgatcagcgtcagccacatcaggcccagcgcaaaacgcacaccaaccagaatcgacggcagagcgccgggcaggatcacatgggcaaagagcgcgaaaccggacagcccgtaactgcgggccatctccaccagaccccggtcgatattgcggatgccgtgccaggtattgatataaatggggaacagcgtaccgagggcgacgaggaaaattttggcgctctcatcgataccaaaccagaggatcaccagcgggatcagcgccagatgcggcacgttgcgcagcatctgcaccgaggtatccagcagcctttccccccagcgcgacaggccgctgatcaaccccagcgtcaggccgatcgacccgccgatggagaagccaatcagcgcccgccatgaactgatagccagatgctgccacagctcgccgctggcggagagcgaccagaacgcctccaccacgccctccggcgagggaagaatgcgggtggagagccagccggttgacgaggcgatctgccagatcaccaccacggccgccggtaaaaaccagggcgcggcgcgcagcagccactgccgggacgagtcggacatagcgcctccttaactctgtgaaacgttgcgcggaatgtaatcattcgccaccgcttcgccctgcgcctgtaactggcgcggttgcggcacggcgggaatggcgacatccagatgcgggaacagcagctcgcccactttgtaggcttcctccagatgcggatagccggagaggataaagctgtcgatgcccagcgcggcgtattcattaatacgcgccgccaccgtcgggccatcgcccaccagcgccgtacccgcgccgccgcgtaccagacccacgcccgcccacaggttcgggctgatttccagattttcgcgtctgccgttatgcagcgccgccatgcgctgttgaccaaccgagtcctgacgggcaaatgccgcctgggcgatggcaatggtttcatcatccagatgggagatcagccgatctgccgcctgccacgcttcttcgttggtttcacgcacaatcacatgcaggcggataccgaagcgcacgctgcgcccgtgtaccgccgctttggcgcgcacctgctcgattttctctttcaccagttccggcggttcgccccaggtgagataaagatcaacctgctcggcggccagatcctgtgccacatctgacgagccgccaaaatagagcggcggacgcggctgctgtaccggcgggaagaagagctttgcgccacgcacgtggatatgcttgccgtggtagtccacggtgtcgccctccagcagacgccgccagacgtgggtgaattctgccgaggcttcatagcgttcagtgtgatcgaggaacacgccatcggcggccagctcctgcggatcgctgccggtcaccaggttgaacagcgcccggccattggagagacgatccagcgttgccgcctgacgggccgccacggtaggggaggtcacgctcgggcgcagcgccaccagaaacttcagccgttgtgtcaccgggatcagcgatgcggccaccagccacgcatcttcacaggagcgacccgtcgggatcagcacgccgctaaaaccgatgcggtcagccgcctgggcgatctgctgcaaataaccatgatcgaccgggcgggcggcatgttcagtgccaagatagtggccatcgccgtgggtcggtaaaaaccagaacagattcaggctcatgatttagctccttgagtagtggccggatgccagatgcgggtgcggatatccacctgtttcgggacaaggcggttctgataaaacagatcggcggtctgctgttgcagggcggccgtggcgtcgttgaccggcgaaatgcgcgtcggcggacggtggtcaaaataggtggcgatcaccggctcaggcagccccatggttttcgccagtaagctgatgctggcctcgcgctggctgagggttaacgcatctgcttcgctgaaggtatccagaacgccctgaataaaagcgccatttttttcagcatagggacgggaggcgagataaaacgaacctgtctgcttcaaatcggtgccgtctttcagcacccgcacgccaccctgtaacagggctgcggaataatagggatcccagatggcccaggcgtccacattgccctgcgaaaacgcggcgcgcgcatcggcaggcgtcagataggttggctgtatatcggtgaatttcagtcctgcctgttgcagggcgcgcagcagcaggttgtgagaactggaacctttctggaacgccaccttatggcctttcagatcggcgacggttttgatcgggctgttttccggcacgaggatcacttccgctttcggcttcggcggctcaacgccgacatagagcagatccgccccggcggcctgggcaaagataggcggaatatccccggtgctgcccagatcaatactgccgatattcagggcttcgagcatctgcgggccggcagggaactccacccaggagattttggtgtccgggtaacgtttttccagcagctgatgatttttcgccagcaccatgctgacgctgcctttctgatagccaatacgcagcgcgtccggggccgtttccgccgcctgcgaccaggcggagagcgttaacatgccgctgagcgccagccactgggcgcgggatttgaaaaggttaaacatggacgactccttgcgtgtcactgatcaacggggctttcggctcaaggcggtgcagcgcctgggtaaaggtttccagcgcgctatcgaggcggacctgcagatgcgggctgaaggtggctttatgctggtaatcggcgatctggctatcatcagcgaataccccctgcaaaatttcctgcgcgcgcagggcgctcagtaccggtttcagggcgtaatccaccgccagcatgtgggcgatgctgccgccggtcgccagcggcaacacgactttccccgccagcgcgcgctccggcagcagatccagcagcgtttttagcgcgccggaaaacgaggctttatagatgggcgtggcgacaatcagtccatcagcatccgttaactgttcgttcagcgccagcagcgccgggctgtcaaaacgcgcgtagagcagatcttccggctcgaagttatgcagatgccagtggcagacctcgatcccctggtcgcttaagctttcgcgggcgtattccagcagggcgctggagcgcgaggggaaacgcgggcttcccgctaatgtcactacacgcatactgactccttataaccaaatgtttgcttttatctaacattgataacaatttgccagagtgtttttattccactaaatgatttatctgaacaagaattgccaaaaaacggcataagaagagatgggcaggtaaacgtttgcgcttttgcggttttttttgccgcaggtcaattccctttcgccgcgggatgaaacataatacgcccccggtttgcacaccgggaatccaggagagttcatgtactaccccttcgttcgtaaagccctttttcagctcgatcctgagcgcgctcatgaagtgacctttcagcaattacgccgggtgtccggtacgccatttgaagcactggtgcgccagaatgtgccggtaaaacccgtcacctgcatggggctgaccttcaagaatccgcttggcctggcggcgggtcttgataagaatggtgaatgtattgatgccttcggcgcgatgggatttggcgcaattgaaattggcacggtgacaccgcgtccacagccgggtaacgataaaccgcgtattttccgcctcgttgaagccgagggattaatcaaccgcatgggctttaataacctgggcgttgataacctggtggagaacgttaaaaaggcgcattttgacggcgtgctgggtattaatatcggcaaaaataaagacacgccggtggagcagggtaaggatgactacctgatttgcatggagaaagtctatgcttatgccgggtatatcgcgattaatatttcctcgcctaacacacctggtttgcgttcactgcaatatggcgaagcactggatgatttgctgctggctatcaaaaataagcaaagcgaattgcagaatatccatcacaaatatgttccggtggcagtcaagattgctcccgatctgagcgaagaagaattgatccaggtggctgatagtttagttcgccataatattgatggtgttattgccaccaatactacgctggaacgatcgctggtgcagggcatgaagcattgcgatgaaacgggcgggttaagcggccgtccgttgcaattaaaaagcacagaaattatcaggcgtttagcgcttgagctgaatggccgtctgccaattatcggcgtcggcggaatcgattcggtgatcgccgccagggaaaaaatggcagccggcgcaacgctggtacaaatctattcgggctttattttcaaaggcccgccgctgattaaagaaattgtcacccatatctgacgtttatcccgctaaatgacaaccagggctttatttcctgccctggttgttttatattccgtcgttgttgcttatttaaacattgtggtcttttattatttacacaataagcgaagcggcaaaatggataaaaaagcaacaggacgcttgcggacgggagaggaagatgcgaattaaacctgacgataactggcgctggtattttgatgaagagcacgatcgtatgatgctcgatctggccaatggcatgttatttcggtcccgttttccccgtcgcatgttaacccccgatgctttcgcgccgaccggtttttgcgtggaagatgccgcgctctatttctctttcgaagaaaaatgccgctatctggatttaagccgtgaacagcaggcggagctggtgctgaatgcgctggtggccatccgttttctgaaaccgcaaatgccgaaaagctggcacttcttagcgcataacgaccgttggacgccgctgcagggcgaagccgccagcgtctggctgagcgacaccgcagagcaggtgaatctgctggtggtcgaaccgggcgataacgccgcgctctgtctgctggcgcagccgggtgtagtgattgccgggcgtaccatgcagcttggcgatgccatcaaagtgatgaatgaccggctgaagccgcagccgattgccgccagcttcagcctcgaacaggcggtttaaggttccagtttcagcgccgttctggggatgcagctacagctcagaatggtgccatcgtcaccgatcgccgactgtttcagcgcactgacttccccctcgactaagcgtatccggcagcagccgcagatccccgcccggcaggagtagggtacgcggatcccctgactttccagttgttccagtaatacctgttgattattaccggtaaattgctgtccgtgaaaatcaatgctgacgcctgagggatccgctttatcgacgttaagcgtttcagcaacgtttcctgcaccatagatttttcctggcgcgcgggccagcaccgtgacttcatcgccgacgcggatcacgccgctgttgcgggcgatcaggttctggccgaaatccacatcgccattgtcctgggctgtgcggaatccctgtaaagtggtaagcggttctccggacgggtgcttttgcccgcgctccgggctgacggtggtgaatacgcaacggctacagggtttaaccacatcgaaaatcacctcgccgatgcgcaccactttccagccgtcttcttcccaggcggcggcgccgctgaccaccaggttgggccggaactgctctatttgtacgctggcggggcagcgctgctggagatcccgtagcgaggcctcgttgaccagcagatagggaaagccatcggcaaaggagagcggcacgctttcaaagcgttttacccttcgcgttggctgcgggccgacccagcgcagttgcacctcgcgggcgaaaaaaccgctcagccacaggttaatggccgcaggcgctataaaggccgtaaaatggttgccccagacttcagtgggttctggctgcgggtcaaaatccgcaaagcgcaccagcgcgctgctgccatcgggcgcggtgaggtgcagcccatcgggtagcagggcgggcgtgaagcgtaccatcgcgggaaactgacgggcggtgatgaaagtgccgtcgggttcagtgagcataaatatacgatcgaacgccaggccgctgctgtccgccagcgcatgggtaagaccggtgccgcgcatcgatttaaccggatgaataaaaagccgcgataaggttgccacgccatcctcttctgaatctggaaataagcgctcaactttatgacatagcgttgagattagctataatgcgcaacaattttctaagtgaataagtgacgatatgatttctctgtttgccagtacggcccgcgggctggaagagctgttaaaaactgaactggaaaacctgggcgggcaaaacgtccaggtggttcagggtggtgtccattttgagggggacacccggcttgtctaccagagcctgatgtggagtcgtctggcttcgcgcatcatgatgccgatgagcgagtgcaaggtgtacagcgaccttgatctctatctcggggtgcaggcgatagactggacggagattttcagccccggcgcgacctttgccgtgcacttcagcggcctgaacgacaccatccgtaacagccagtacggcgcgctcaaggtgaaagacgccatcgtcgacagcttcacgcgcaaaaatctggaacgcccgaacgtcgatcgtgaaaagcccgatctgcgtatcaatgtctggctgaataaagatactgcgcatatcgcgctggatctgagtggcgaaggtctgcaccagcgcggctaccgtgacggcaccggccttgcgcccattaaagaaagccttgcggccgctattgtgatgcgatctggctggcagccgggtacgccgttgctcgatccgatgtgcggttccggtacgcttttgatcgaagcggcgatgtacgccaccgaccgtgcccctggcctgcatcgcgggcactggggattcggcggctgggcgcagcacgacgacgccatctggaaagaagtgaaagccgaagcccaggtacgcgcccgtaaaggcctggcggattacggttcgcgtttctatggttccgacaacgacagccgcgtgattgaacgcgcccgcagcaacgcccgtcgcgccggtgtggctgatctgatcgcgtttgaggtaaaagacgtcgccaaactcaccaacccgctgccggaaggcccgaccggaaccatcctcagcaacccgccttatggcgaacgtctggacagcgaaccggcgctgatcgcgttgcacagtatgctggggcgcattatcaaaagtcagttcggcggctggaatttatccctgttcagcgcttcgccggatctgctcaactgtctgcaactgcgcgccgatcgccagtttaaagccaaaaacggcccgctggactgcgtgcagaaaaactatgctattgccgtgaccagcgccgatgcgcagggcggcggcagcgcgtcgatagcggaagattacgctaaccgcctgcgtaagaacgtcaagaaactggaaaaatgggcgcgtcaggaaggcattgaatgctatcgcctgtatgacgccgatttaccggagtacaacgtggcggtggatcgctacggcgattccgtggtggtgcaggagtacgcgccgccgaaaaccgtggatccgcagaaagcccgtcagcgcctgttcgatattatttccgccactatcgcggtgctcggtatcgccccgaacaagctggtgctgaaaacccgtgagcggcagaaaggcaaaaaccagtatcagaagatgaacgagaaaggggacttcatgcaggtaagcgaatataacgcgcgcctgtgggtcaacctgaccgattatctggataccggcctgttcctcgatcaccgtatcgcccgtcgtatgctgggccagatgagcaagggtaaagacttccttaacctctttgcctataccggcagcgccagcgtgcatgcggggctgggcggcgcgaaatccaccacgacggtggatatgtcccgcacctatctggagtgggccgagcgcaacctgcgtctgaataatctcagcggccgcgcgcaccgtctgatccaggccgactgtctggcctggctgcgcgataccgatgaacagtttgatctgatctttatcgatccccccacattctctaactcgaaaagaatggaagatgcctttgacgtgcagcgggatcacctgcgcctgatgaaagatttgaaacgtctgctgcgcaaaggcggcaccattatgttctcgaacaacaaacgcggtttccgtatggatcacgacggtctggctgagctcggactgaaagcacaagaaatcacgcaaaaaacacagtcgcaggatttcgcccgtaaccgtcagatccacaattgctggctgatcacctcagcctgaaggaagaataaatgtcattaattagtatgcacggtgcctggctgtcgttcagcgatgcgccgcttctcgataacaccgaactgcacatcgaagataacgagcgcgtgtgtctggtgggacgtaacggcgcgggtaaatcgacgctgatgaaaatccttaaccgtgaactgggtctggatgacgggcgtattgtttacgaacaggatctggtggtggcgcgcctgcaacaggatccgccccgcaatgtagcgggcagcgtgtacgatttcgtggcggaaggtatctcggagcaggcggaatacctgaaggcctatcatgagatttcccatctggtgatgaccgatccgagcgaaaaaaatcttaacgagatggcgcgcttacaggatctgctggaccaccacggcctgtggcagcttgaaaaccgtatcaatgaagtgctggagcagattggtctggaagcggatatggcgctggcctcgctgtccggcggctggctgcgtaaagcggcgctgggccgtgcgctggtcagcaacccgcgcgtgctgctgctcgacgaaccgaccaaccacctcgacatcgaaactatcgactggctggaaggcttcctcaagaccttcaacggcaccatcatctttatttcccacgaccgttcgtttatccgcaatatggcgacgcgcattgtcgatctggatcgcggtaagctggtgacctatccgggcagctacgatcagtatttgctggagaaagaagaagcgctgcgcgtggaagaactacagaatgcggaatttgaccgcaagctggcgcaggaagaagtgtggatccgccagggcatcaaagcgcgtcgtacccgtaatgaaggacgtgtgcgcgccctgaaagcgatgcgtcgcgagcgcggcgaacgccgtgaagtgatgggcagcgcgaaaatgcaggtcgaagaggcctcccgctctggcaagatcgtctttgagatggaaaacgtcaactacggcgtggacggcaaagtgctggtgcgggatttttccgcccaggttcagcgtggcgacaagatcgcgcttatcgggcctaacggctgcggtaaaactaccttgctgaagctgatgctcgggcagttacaggctgacagcggccgcgtgcactgcggcaccaaactggaagtggcctattttgaccagcaccgcgcggaactcgatccggacagaacggtgatggataacctctccgaaggcaaacaggaagtgctggtgaacgggaaaccgcgccatgtgcttggttatctgcaggacttcctgttccatccaaaacgcgccatgacgccggtgcgcgcgctgtcgggcggagagcgtaaccgcctgctgctggcgcgtctgttcctcaagcccagcaacctgctgatccttgatgaaccgaccaacgacctggatgtggaaaccctcgaactgctggaagagttaatcgatggctatcagggcaccgtcatgctggtgagccacgatcgtcagttcgtcgataacaccgtgacggaatgctggatcttcgaaggcgaaggccgcatcggtcagtatgtcggcggttaccaggacgcgcgcggccagcaggcggcttcgctggcgcataaacagtcagcgtcgaaaaaaagtgccgaaacggcggcccctaaagcagaaactgttaaacgtgccggtaacaaactaagctataacctgcaacgcgaacttgagcagctgccgcagcgtctggaaacgctggaagcggaactgagcgcgcttcaggcgcaggtcgctgacggtgcattcttcagccagcctcatgaccatacgcaaaaagtgctggccgatatggcgcaggctgaacaggcgctggaagaagcttttgagcgttgggaataccttgaggcccttaaaaacggcgcgtaattcaggataaacgtatgtgcgatcaccaccatgccacccggcacattttgtgttctcagtgtgacttgctggtggcactccccgcgctggaggacggtcataaagcggactgtcctcgctgcgggcataccctgaccacaaaatgggccgaaccgcgtcagcgtcccagcgcctattcgctggcggcgctctttatgctgctgctggccaatctctttcccttcgtcaatatgaaggtcgccggtatcaccagcgaggtgacgctgctggaaattccgcgcgtgatgttttcggaagattacgccagcctcggcacctttttcctgctgtttgtgcaactggtaccggcgttttgcctggtgacgatcctgttgctggtcaaccgcgtcacgctgccctggcgcgtacaggcttttctggcgcggatattctttcagctaaaatcctggggcatggcggagattttcctcgccggcgtgctggtgagttttgtgaagctgatggcctacggcgatattggcatcggcagcagttttgtgccctggtgcctgttctgtctgctgcaactgcgtgcctttcagtgcgtcgaccggcgctggctgtgggacgatctcgcgcatatgccgccggtggatcagccgcttaaaacgggcgtcactggccttcgccaggggctgcgctcctgcccgtgctgcaccgcgattttgcctgcggatttacgccagtgtccgcgctgtcacacccgcggttatgtgcgacgcaaaaacagtctgcaatggacaatggcgctgctgatcacctctgtcctgctttatctgcccgccaatattctgccaatcatgatcaccgatctgctgggcgataaaatgccctccaccattctggcgggggtcattttgctgtggggggagggatcctatccggtggcgctggtcatttttatcgccagtattatggtgccgacgctcaaaatgatcgcgcttggctggctgtgctgggacgcaaaagggcacggcaggcgtgacggcgagcgcatgcacctgatttatgaagtagtggaatttgtcggccgctggtcgatgattgacgtttttgttatcgctgtgctgtccgcgctggtgcgcatcggcggtcttatgaacatataccccgcaacaggcgcattaatgtttgcgctggtggtcatcatgacaatgtttgcggcaatgactttcgatccccgtctgtcctgggatcgtgagccagaatcaagccatgaggagcagtaaaaacatggagacgaaaagtggggatgcgaaggtgcaaaaggtaaaaagctggtcgccggtgtggatctttcccatcgtgaccgcgcttatcggcgcatggatcctgttttatcactacagccatcaggggccggtggtaacactcatcaccaacaatgccgaaggcatcgaagcgggtaaaaccaccatcaaaagccgcagtattaacgtcggcgtggtggaatccgccaccctggcggatgaccttaagcgcgtggagatcaaggcgcggttgaacgcggatatgagcaaactgctgcatggcgactcggtattctgggtggtgaaaccccaggttggccgggaggggatcagcgggctgggcacgctgttatccggtgcttatattgagttacagccgggcagtaaagggacgcagccggaaagctataaattgctggattcgccgccgctcgcgccgccggatgcgaagggcatccgcgtgctgctcgacagtaaaaaagcggggcagctgtcgccgggcgatccggtgctgttccgcggctatcgcgtgggctcggttgaaaccagcacttttgattcggaaaagcgcaccatcagctatcagctgtttattaatgcgccaaacgatcgtctggttaccagcaacgtccgcttctggaaagacagcggtattgcggtggatctgacgtccgccgggatgcgcgttgagatgggatcgctgaccacgctgtttggcggcggtgtcagctttgatgtgccggaaggcattgacctgggcacgcctgtagcggaaaagaccgcattcacgctgtttgacgatcagcgcagtatccaggaatcgctctataccgaccatatcgattacctgatgttcttcaaagattccatccgtggcctgcaggcgggcgcgccggtggaattccgcggaattcgtctggggacggtaagcaaggttccggcgatgatgccggggatggaacaggccctggacaacgattaccgtattccggtgctggtgcgtattgagccggaacgactggccagccagcttggcgaaatgccggacatgaaatcccatatcaatgaactgctaaaaagcggcctgcgcggttcgctgaaaaccggcaatctggtgacaggcgcgctctatatcgatatggatttctatccgaaagcgccgccggtaaccggggtacgtcgctatggcggctatgaaattattcctaccgtgagcggcgggctggcgcagatccagcaacgtctgatggataccctggataagatcaacaatctgccgctgaacccgatgattgagcaggccacgaattcgctgaatgaaacccagcgcaccatgcgccgcctgcaaaccacgctggataatctcaataagatcaccgccagccagtccgcgcagcaactgccggcggatatgcagaaaaccctgcgcgagctgaaccgcagtatgcagggcttccagccaggatcggcggcgtacaacaaaatggtggcggatatgcagcggctggatcaggtactgcgtgaactgcaaccggtactgaaaacgctgaacaccaagagcaatgcgctggtatttgaagcgaaggataaaaaagatcctgagcctaagagggcaaaataatgaaaaatggagtagtcatcgccgcgacgctgctgctggcggcctgtagcagcaacgtggaagagacgaattattatcagttgccgacgccgcaacagaataccgtgcagcgccagagtggtagcgccgaccgtctgctgtgggtggagcaggtttcagtgcccgattatctggcgggtaatggtgtggtgtaccagaccagcgatgtaaaatacgctatcggcacgcaaaacctgtgggccagcccgctcgatcagcagctgcgcacaacgctggtgtccaacctcagtcagcaattacctggttgggtagtggcttcaacgccgcttggcaacgagcaggatacgctgaacgtgacggtgacagggtttcacgggcgctatgatgggcgggtgattgtcagcggcgagtggttgctcaaccatcaggggcagctgataaagcgaccattccatatcgaaatgacgcagcagcaggatggttacgatgcaatggtgaaagtgctgggcgaggcgtggagtcgtgaagcgggcgacatcgcgcgggaacttaaccgtctgccctgattgctattaatcctaaaaaaccgccggtttgctcacgcactggcggttttttttatgtcggttttccgggcatttacttgtgccgtctcacactttttgtacaaatgaagttctgtgtatctcacatttatgacaatggtatgaattttgtgcattgacgatgctgttcatccgcgttacaaaagagacgtgattgcgcattttgtaatcactgttttcttttccaccagactcaaaatatgagggaaacgaggcatgaagagacaaaaacgagatcgcctggaacgggcacatcaacgtgggtatcaggctggtattgccggacgctcaaaagaactatgtccttaccagacgctgaatcagaggtcatactggcttggaggctggcgagaagccatggaggtcaggacagtaatcgcctgattctgtctctttagtaagaaacctccgcctggcggaggtttcgcctgtcagggcactcagaatgcagacgtatcctggaacagcccaactttcaaatcgtttgccgtatagatcacgcgaccatcgaccagcacttcgccatccgccaggcccataatcagacgacggttaaccacacgcttgaagtgaatgcggtaggtgacttttttcgccgtcggcagaacctggccggtgaatttcacttcacccacgcccagcgcacggcctttgccttcgccgccgagccagccgagatagaagccaaccagctgccacatggcatccagacccaggcagccaggcatcaccggatcgccaatgaagtggcaaccgaagaaccacatgtccggatggatatccagctcggcttcaacatagcctttatcaaagttaccaccggtttccgtcattttgacgacacggtccatcatcagcatgttgggagcaggtaactgcgggcctttttcgccaaacagctcaccacgaccagaggcaagaaggtcttctttcgtataggattcgcgtttatctaccatgttttgagtaagccttattgtaagtttgggacgcaggatagctaacacgtgtacgctgaacaagtccgatcagttcggtacaaaccagttcaaccagcgtaacggccacggaaagcgatggcgtgcttcctgctgcgaggcctgggcgatgcgttcctgaatggtctgaatgagggtggtttgcccttcagcatcccaggccaggtttgtcagtaagggtagcgcatctgtcacatcatcgatggcccagataaagaattgtccggcttccacggcgtcgagcagcgtctgcggcagacacagatgacgtacgttagcagaaggaatgatgatcccctgcttaccggtcagaccacgctgctggcagatactgaagaaaccttcgatcttttcattcaggccgcctaccggctgcgcgcgtccgaactgatccaccgaaccggtgatcgccagatgctgattaacaggcacgtccgccagcgcgctgatcagggcgcacagttccgccatcgaggcgctgtcgccgtccacttcgctataggactgctcgaaggtcagcgaggcagagaaggggatctgctgatccagctgaagctcggccattaagaaggcctgcatgatcatcatgccttttgcatgaatatttccgcccagctccgctttgcgctcgatgtcattaaattccccgtcaccgatatgcactacgcaactgatgcgcgacggctcgccaaaggcgcgcgggtgcccagggaattcgacaaccgaaagggcgttgatctgaccgacgcgctcaccttcggtttcaatcagaatttgttccagcaggatctcatcctgaatgcgttcaggtaagtatccttcacgccattcgcgctggctgagcatggtctgcaactgttgtgcatcaaacgaggtctctgcgcccagcgccgcgacttcacgcagctggcgcgccagccacagcgggcacagcggcagcgtttcctgatcgccggtgtaacgcacagcttcacggatcaacaccggccatgcatccttcgccggaacgggcagatcggcgctggcggccacgtgcagcacccactggcaccactgcgccatggtttccgcatccgttatctgaagattatcttcgtactcgctgtaaatggactgggcagccagctccggttccatctcctggaattcggccagtgaatccctctcgccgacgaggatcaccttcagctgtaacggcattgacggcacgctgaccggtaacggacgcgactcgtcaaaggagacccagtcgaagcgctggcgggtgatcatggttttcaggcgcatccacagcagcggctgtgccagcagcgtacgcagggagatcaccagcacgccgccgttagcctgatgcaccaggcccggttgcagggcaatctcattattaaactgacgcaggcagccaaaaagctgctctgcttctacccagtcggcaatgacgaccgggtttttggagacgaagtcggccagcggatccgttgaggcttcaaaggtaacgcttcgaccagcgatctggtattgcccaccagtaaacggctgatcttccggcagtaattgacccacagcatcagcaataatacccagatactccacttcctccggcgcttttgccagcaaaaagcgtgacgatgccagcggatgaagcagttgctccagcgcgtactgtaagcggggttgcgtatcgccgagggataaatcctcctcagacggcgcacaagattgtgtaaatacctcctgataactgtcggtatcagggacaaggtcttgccaggcgagtttagtaatggtcaaagttgaggttttatcgtcagaagtaaagggcggaattataccgtaagcggcaaagcatcacaccagtaatacgcgatttcctgaccgcaaagtcgtctgcgtgttcacaggatatgatttcttttcagcagattgctaaaaaactgatattctgaactgagttacagggtaacactgagatcgcgatgaaataccaacaactggaaaatcttgaaagcggctggaaatggaagtacctggtgaaaaagcaccgtgaaggtgaattaatcacgcgctatatagaaaccagtgcggcaaaagaggccgtggatcagctgttgacgctcgaaaatgacccggttcgtgtgaatgcctggattgaacaacacatgaatgcggcattaatgaatcgcatgaagcagactattcgcgcccgacgcaaacgtcactttaatgccgagcaccagcacacccgtaaaaaatccatcgatctggaatttatggtctggcagcgcctggcagggctggcccagcgccgtggaaaaacgctctcagaaaccatagtgcaactgattgaagatgccgaacacaaagagaaatacgccagtaaaatgtcgacgcttaagcacgatttgcaggcgctgttaggcaaagaataaacccgcgatatttttcacgccggatcgcaggcaataaaaaaccccgcagcgcggggtttttttaagacgtaaacttaagcctgcggctgagttacaacgtctttgatacctttaacttcgatctcaacgcgacgatccggagccaggcaatcgatcagcgcagggcgcgctttcacgttgtcacaggtgctgccggtaaccgggttggattcgcccataccacgagcagagatcttgttggacgggatacctttagagatcaggtagtcaacaacagactgagcacgtttctcggacagaccctggttgtaagcgtcagaaccgatgcggtcggtgaagcccagaacaactacggaaccgtctttcggatccaggttgctcagctgggagtacatctgatccagagcctgctggccttctggtttcagagtcgctttgttgaagttgaacagtacgtcagacttcagggtgaagtgcttggtggatacctgcggagccggagccggtgccggagcaactaccggagcaacgtcttcctgctgaccgaagcggtaagaaacacctaagctcagcagaccgttgtcctgacgggtaccaacagtttgcgcgtcgccgatgttgttaacccactggtattccagacgggtagcgatgtcacgggtaactgcccactcaacaccaccagcgaataccggggaaacaccggtgtcgtggtctttagcgtggaaatcagcgccaggaacgttggctttagcgtctgcacgccaaaccataccacccagacgggtgtaaacgtccagatcgtcagcaaccgggtagctcagtttggtagtcagctgaacgccttgagctttgaacgcaccgtttacggtgtcgcctttataggcttcgcggcccagccagtcgtaacccagttcaaaaccaacgtacgggttaacctgatagccaccgaacgcaccagcacccagctggtcattacgggtcgggccgtcattaggaatgaaaccagtatcgtggaattgggaccagcccagtttaccaccggcataccaggtattatctttcggagcggcctgcgctacagtagcgaagccagccagtgccactgcaatcgcgatagctgtctttttcattttttgcgcctcgttatcatccaaaattcgccatgaatttctcgccagagaaaacacggtttaaatccttcaccgggggtattgctctaagtatctctaccgatatcttcggtttatgccgagcacccctggcgatgtaaagtctacaacgtagttggaaacttacaagtgtgaagtccgtcaggcatatgaaaaaaaaagctttctgcgtgcattatttaacatttatgacgagaatataatcaatgcaaaacagcgcaaaccgcaccagacaggcattgcagcacgatttcgcttaagaaccggtcagcccaggaattcacaaaaaaaatcccaggaattatcttaaactggcttaatgatacaaatttgagtgaatttttagcccggaaagctgtcttgtggcgtgaggatccctccgcacgggacgcataataaagcccatcgcattaccttcttcagccgcctgaaccagacgctgatgttcatcatccgtcagttcttctgtatgccagccgataacaacactgtaattgccggtgcgtaacgctctgatcatggattccagggtatcatccggggaaagctggctgatctgcatcagtttggtcaacggcagccctgccgcctgaacccactgacggcttaatttttgctgcggggttaaccatagctgccagcgcgactgctgaccgagctgttgcagaaggggcagtaacagcaactgcgtcatgccgggctggtcttcacgataaaccacttcgctgataaggccagtcgagtcgccagccggttttgcctgtgtgcggttgcccgtcatagcgttaagtgttgatgcacgattagcgtagcctgaagtgtacataatcaatccagccctgatagttactgtatggatgtacagtaactcctggacgtacaaagatcaacctcaatttctgaaagcacctcgcaaatttgcgggataactgatgtccgttaaaaaatcatcttgcccgccgcggacaacttccctatgttcctcattaacggatccgttactaccagaagatgcctttatgccatgattttaaaggaataatcatgaaagatatgtcttatcaacggatccatgaatcacgtgaatacctctcagagttgggtactattcgccatcgaacgctgttcggcggttacagtctttccgttgatgatacggtgttcgccatggtggcaaagggggatctttaccttcgcgcctgtgagcaaagtgctgaataccgtgcgcaacatccggctccgttactgacgatgatgaaaaggggcaggccagtagtactgaactattaccgcgttgatgacagcttgtggcaggacagggatacgctgatgaagctttccacctggtcgcttgccgccgcgtggaaagaaaagatgcagcgcctctgcaagccccggcttaaagatctaccgaacctgaattttcagctggagatgctgctgtgggaagcgggcgtgacggatgtcctcacgctgaaaaaactgggcgctaaagcgtgctgggtcaggctacgcacgcttaatacacatctgggcgttaacgtattgctggcgctggagggagccatcgaagggatgcatcaggccgcgctcccggcgcagcagcgccaggcattgacgacatggtttacagagtttgaggcggagcatcggaaacatcagcggacaacctgacgctgcaatcggctgatttcaggaagcagcgctaccaccaggccgatctgctgtaaaaccagtggttctttactgtccggacgggaatccacctgcgtaatgcgatcggccagctgtgccagcgttttctggactcgttcttcatcagcgggggcgtggtgtaacgcgtcgtcaacgtagcacaccgcgtcgtccagcagagtgaggatctcagcagaagtcagtttttcccggtgcgcgcccagcgcggaaatgtagctggtaaaagtgtggttgaggcacaacagacggaatgcggcatcgcgcagttccgttgacgcgcctggctctgttgacatattggataccaccgacgccagttcggcatcgcggttatgggcatcgcgccttgcaatacggtacgccatgcggttatcacgtccctggtgatactgctcaaggatagcgtcaaggtagcggcagttcgcatcaatggcccgttccagcacgcgtggaagattacgaaaacgccagtccggccagataaagctcaccgcagcccaggcaatcgcacagccgataagggtgtcaataatacgcggaatggcaacttcaaagccttccccaagcaggttaaagcacagcagtaccagcagggtaataaacatggtggcatgggcgtactgcacattgcggaaggcgaagaacagcacgccggtaatgacgatcaaaatcagttgcccttcaatggacggcacaaaatagagcaccggcaggccaatcgccacgcccaccagcgtgccgataatacgcagcgccagacggtgccgggtggcgttgtagttgggctggcagacaaagaggctggtcagcaggatccagtaaccgtgttccaggccggtaaactgtataaaagcgtaaccgacacacaacaccacagacatgcgtatggcgtggcgaaaaagtgctgattccggcgacagattgcggctgaggcgggcgcgaatgtcgctcatgccgttaagaccctcatccgccagcatgttatcggtgtcgttgcgcggcagggtctgcgcctgctcagattcgatcgtcgccagctgtgcgtcaatcgcgcgaaggttttgcagcagaaagcccagcgctttcatctgttcgtcagacgtgccgtcgccgcgggcacgctccagcgcggcatcaagatgggtaaaagcgcgctcgaagcggccatcatgctgatagggctcgcgtaataaaatgcagcgtgataaatgcgcgcaggcctgcgactgcatggagagcaggcgctgaaagcggaacatcacgtcgctgtagcgaaactgttcccgcagcgtctgatactggatatgagacgaactggcgcgctcgtgaatatcctgcgcgacaaaatagtagtgcagggttcgccgggtgccgcgttgcccacgatccccgcgcagacgcgttaataatgaacttttcgtctggttcagcgtggaaaccagctggccgttcgccagcgccaggtcatacagcggcgcctggctttcatcttcgatatcgggatcgaacaggcgggatttcagctccagaaaatgcgccagctgttcatagcaacgcgcaaggttgtcctgtagcgggcggatcgggaagaccagatgaccaatcagcgtcaacaggttaaaccagacagcccccgccagcagcagaaggggttgctgataccattgctcgtaaagcgagatgccgagcatggtgtaaatggcgatcagcagaccgccaaaggcaatagtcgcgtagcgctgcccaagcccgcccagcagaataaatccgctggtggaaatgatcagccccagcgcaaacagccacggccacgggaacagcagttctaccgaggcggaggcgataaaaaaggagatcaacgtgatcagcagattacgtaaacggccggcgaggcggtcatccagatcggccagcgccgccgccacgacgccaagcgtcagcgggatggtcagctttacatcacccatccaccacggcagggcggtagtgccgcacagcgcgatgaaaattctggcgttataaagccaggtactgttccatgtatagcggcgaagcagggggctgagcatcgtggttcagatccttaattattgaaagcggcgacgggcattagcttcacgtgccgctcgcgccgtttccaccgacaccacgcggcgtccgaccggccacagggcaatgccggcgatcttgaaattcgcaatgcctaccggaataccaataatcgtcagacattgtgcaatacctgacacaatgtgcatcaggcagagccaccagccgaacagcacgaaccacaaaatgttcagcagcgtaccgccggtgttcaggatgacgctggactctcccggcgacagttcatccacatgtaccgcctcatttccgtaaggcagcagggaaagcttagtaatttcccagcaggagcgcgtcagcggcagcgtaataataagcacaatactgaccagcgttgccagcagccaggcgagagtggtgaaaaaaccacccagcacaaaatttaaaatattcagtacagtacgcataaatcctcagggaaaagccgttaacgaaaagacccatcaatagtaacgattttttgggctggagcacacattctctggcggttacactggcgcatcacgacatgagttgagaacggcacgtcatggaactgaaagcaacttctttaggaaaacggctggcgcagcacccctatgaccgggtggcgattttacacgctggtgtcaaagtgtctggcgatcgccacgaatatctcattccattcaatcagttactcagcatcgaatgcaagcgcggcctcgtgtggggcgagctggagtttgtcctggtggacagtaaagtcgtgcgtctgcacggaacggaatgggcgcaaacccagctgttctggcaacatctgcatagccgctgggagcagtggagcaaagagatgagcgaggtggcggcgggcgtattgcaggcgcagctggaggcgattaacggccatgttgaccagggcaaatggttaacccgtcagcagaccgaaggattacagcagcagatccgtggcgcgtttgacgcgctgccgctgcctgtcgccaggctggcgtcttttgacaattgccgtgagctgtggcgtcagtgccaggcgtggctggcggatgtggaaggccgccgggcgcagcataaccaggcgtggaccgatgccatgctaaaaaaatatgctgatttctttgccggcatcgaaagctcgccgttaaacccggcgcaggcgcgggcggtggtgaacggtgaatcatccctgctggtgctggcaggcgccggtagcggcaaaacctccgtgctggtggcgcgcgcaggctggcttatggcccgcggcgaagcggcggccgatcagatcctgctgctggcctttggtcgcaaagcagcgcaggagatggatgagcgcattcgtgaacgactacacaccgacgagatcaccgcgcgtacctttcatgctctggcactgcatatcattcagcagggcagtaaaaaagtgccggtgatcagccgtcttgaaaacgataccgatgcgcggcagaaactgtttattgaggcctggcagcagcagtgcagcgagaaaaaagcccaggccaaaggctggcggctatggctggaagaggagctcaactggacggttcctgaaggcaatttctgggacgacgaaaaattgcagcgtcggctagctggccgtctcgatcgctgggtcagtctgatgcgcatgcacggcggggcgcaggcggagatgattgccagcgcgccggaagacattcgcgagcggttttcgaagcgcgtaaagctgatggctccgctgttaaaagcctggaaaacggcgctgaaagcagaaaacgccgtcgatttttcagggcttattcatcaggccattaacgtactggaaaaagggcgctttatcagtccatggaaacatattctggtggatgaattccaggatatttctccgcagcgcgcggcactgctcgccgcgctgcgccgccagaactcccaaacctcgctgtttgccgtgggcgatgactggcaggcgatctaccgctttagcggcgcgcagctcgaactcaccaccgcgtttcatgattattttggcgaaggcgattgctgtgcgcttgatacgacttaccgctttaaccagcgtatcggcgagatcgctaaccgttttatccagcaaaacccggcgcagatgtccaaaccgctgaacagtctgaccgcgggggaaaagaatgcggtttcgctgctctctgacgatcagctggatgcgctgctggataagctcagcggttttgcgctgccggatgaccgcatcctgatcctggcacgctaccatcatctgaagcccgccgcgctgcaaaaagcggcaacacgctggcctgaactgaacctcgattttatgaccgttcatgccagtaaaggccagcaggcggactatgtcattgtgctggggttacaggacggtcaggagggcttccccgcgccggagcgggaatcggtgatggagcaggccttgctgccgcagccagaagattttccggacgccgaagagcgccgtttgctttacgtggcgatgacgcgggcgcgtaaacgcgtctggctgctgtttaataaagcgcagccgtcacgatttgttgaggttttaaagcggctggacgtaccggtggcgcgtaagccctgaaattattcaggcggtaaggccgcctgaatgccattacttcaggcgctctgccaggtagcgcggataatccgggatcataatgtccacgctgtcgctgaaagtgggggactggataataaaatctgcggtggagatattggtggcgaccggaatgttccatacggtggcgaggcgcaacagcgctttgacatccggatcgtgcggcacggcgttcagcggatcccagaagaagatcagtacatcaattttaccttccgaaatcatcgccccgacctgctgatcgccgcccatcgggccgctcagcatggcattcacctcaagccccgtggcacgggaaagcagattaccggtggtgccggtggcatagagttcatgctgttccaggatcggctggtggcgttccacccagttcagcaacatctttttgcagtgatcgtgggcgacaagggcaatatgcttgcgcgcggggagagtgcgagtggtcagttccataatcatattccgcgaatgaatttcgttacagattactggaagcgtttgatgctgcaatagaaagacgcaaaaaaaacctctgacggaatacctttgtgaggggaaccaggatcaggacggcggctgctgttttgcccattgcagaaagcggtcgcgggtttgcggatccgcctgttcaaaccagaatttcaggcgctgctcggtaagggtttgcgattgcgacgggatcgtatccagctcagacagaccggacagcaaagcgctgtcatcagccatggcaggcgcaaagagcggcaacgaggctgttttccccgctttgttatagcgtacggtttcgcgctcatagttaatcactttccccttatcccgcagcggcaaaatatcgagcagcagcggtatcggcgcggcttcaccatccagcaggacgatagctggggcgctgtcgaatttttccgcggctttccagctatccagcgagggtagagagaagttcaccagctttaccgaacgcgtgttgaaactcacgaccagcggcggggaaatgtagagccgcatttcatgatttgccccacggatggttttttcaacgcgaaacaccagctggtgcgggccgttatccagctcaatgctgtccgcgccgcgcagcaacagactcgacactttcttgccgtccagcaccagcaaatcaatatcggtggaaaggcgtaaggtggtggcgacgacggtaaccggcaacaggcaaaagatcattgtcatcgtcaggccggttctcatgggtgtctcctgcactgtcgggtgagtcgcgagaatctataaagttttcagcacgcttttgtttactaccatatagagaggcgcagcttttttctctcatgcagaggtatgggataaatggtggcctgcagagctttggcgtacactggatcgactggcccggaggataaaatgaaagaaaccgatattgctggcattctgaaatcgacccataccattgcgctggttggcgcgagcgataagcccgatcgccccagctaccgggtgatgaaatacctgctcgaccagggctatcatgtgatcccggtatcgccgaaagtggccggtaaaacgctgctgggacagcagggatacggctctctggcggaggtaccggaaaaaatcgacatggtggatgtgttccgcaattccgaggcggcatggggggtggcgcaggacgctatcgctgttggcgcaaaaaccctgtggctgcagctgggcgtgatcaatgagcaggcggcggtgctggccggtgaggcaggactgaatgtggtcatggatcgctgcccggcgattgaaattccccgtctgggtctggcgcgctaaataaaaaccccgcacaggcggggttttttcagttgcgcaggcgcggtgcctgaagctgtttacgaatggtctgcgccagttcgtccattgagggctgttcaggatgctcgtcctggatctcactggtaagctgcgcttccgccagataggtatgcaccggctgaccgttgtcgtcttccatcaccacgtgataccagggcgcatcgcgcaaatcatcatcaaccgccagctcatccacagacggcttatcaagtgaatactcaggatcaatgtccaccaccacacctaaatagcctaacagtgtgtggcgcacttgctggccgataccatatttgctggcaatcatactcacctccgtggaaccgttactgacaccaaatatgtgggcaacgatccagaaatcaagttacatgacgcggcaggcaaaccccttcagatacagtccttccgggtaaggggcgatcaccgggtgatcggcagcctgtcggaactgttctataaattgtacatcacgacccgcatctattgcggcatcagcgatgattttctgaaataaatcggtagtcatcaggccagagcaggagaaggttaacagcacgccgccaggattgagcagctggatcgccagcatattaatgtctttatagccgcggcatgcgcccatcagctggcttttgttttcgacaaatttcggcggatccatcacgatcacgtcgaatttctccccctgatcgcggtatttgcgcagcagtttgaatacgtcgtcgcgaacaaattccgctttgctgagatcgagtttgttaagctcaacgttctgacgggccacatccagcgcttcctgcgacgtatcaacactgaccacctgtgcacagccgcccatcagcgcagaaacggcaaagccgccggtgtaggagaagcagttgagcacacgtttaccctcaacatagcggcgggttgccagacggctgtcgcgctgatcgaggtagtaaccggttttatgaccggtctgaatatccaccagcagcttcatgccgttctcttcgattggcagcagcgcgggcggcagatcgccgacaaccagaccctgcgtcagctccatcccctcttttttacgcactgccacgtcgctgcgatcgtaaatggaacaggacggatagcaggcctgaagggctgcaatcagcgccgggcgttgatattccgcgcccgcgctcagcaattgcaggacaagaaaatcgccgaaacgatcgatggtgatgcccggcaggccatcagattcaccggcgatcagacggtagctgtccagaccatcacgcgtcgccagccagtcacgccattgctgcgcctgcttcagacggcgggtgaaaaattcaatatcaatgctttcatctttgtcgaaggtccacacacgggcgcggatctgcgatgccggggagtatgcgccacgggccaaccattttccctgatgatcgacaatatcaatggtttcaccgaggctggctttgccttccatgcgcgcaaccgcaccggagaagacccagggatgacggcgcagtaacgatttttcgcgccctttggttaacactaaacgtacactcataattagcttatttgtcatattgaagaaaatggccgccattttcccgagttcagccgtgaattgcaatgtaccggcagataaaccctccgttcagctcttatgccaggaatgacacgacctgtcagcccccctttatagaatgcctctcaatcgccaatgcattcataatcctggataaaatatgacaacttcagcgtatcgctactcctttatcgccgaaccgttcaccagcctggcaggaaaattactgggtgtggaattacaaacccgccttgaaaaagaggggcagcaggtgctgcatccggagttgatcatcgcgggctgggatacgcagtcaaaacgccagtatttatatgaacagcttgggcaggtggcaaagcagagcgcgtggatccgggatcgcaatgtgctggtatcgctgccgctctatgatgctgagtgtgcggtgttattgagctatgactccgtactgcgtggactgttatccacactgccgtttgtccggctgacgctggcggaaaatatcagcgacgtgcgcgacgaactacaggggatccgcaacgctatgtggctgggggaggtgggcggcggcagagcaaacgttctcgggctgatgagccagcaatttgaagcgctgatccttgacagccatttttttaaggacgaagtgataaagccaaccttcccggtattaatcaaaaatcttcggcgctattgtgacaaggtggtggtgcgcggcgtgaccgatcggcgttatctgccggtattacaggaagcagagatctggggcgtgcagggatcattttatcgccccgtgccactggggaaactggactggttgctgtgaagctggcggcggggcgctaaacttatccgttaccatcatgttgaaaggagcaaaaaatggaaaaccagacctctcagggcgtgaaatgctgggtgcacggcagtgtgcagggcgtgggatttcgttacagcacgcagcatgaggcgcagcggctgggactcaccggctatgcgcgtaatcttgatgacggcagcgtggaagtggtggcctgtggtgatgccggacaggttgaggcgctggtggcctggcttaaggctggcgggccgcgcagtgcgcgggttgagaaggtgttaaccgaacctcatcaacccaccacagcctatacccgctttgatattcgctattaaatgcattttaccggtttaggcaaaccagcaattttggtggcctgttttgccgggcctttggggaaaaggcgatacagatagcggctgttgcctttctcctcgccaaatttgttcgccatggctttcaccagcatgcggatcgccggtgaggtattaaattccaggtaaaattcgcgaacaaaacgcaccacttcccagtgttccggcgtcagcgcgatcccttctttttcggcaatccgttcagccagcgcctcgctccacacggtggtgtctttcagatagccttcgctatcggtttcaatctcacggccttcataagtcaacatagtgcatcgcaaagtcagtcaaaaacggggtcagtttagcaaataaaaaagccccgcataagcagggcttcggtatcaggccgcgagttagtctctgctggagaaaccaagaatgctcagcaggctgacgaagatattgtacagcgagacgtacaggctcacggtggcgcgaagataattggtttcaccgccatgaatgatattgctggtttcatacaggatggcaccggttgaaatcagaataaacaccgcactgatcgccaggtgcagggcaggcagttgcaggaagatgttcgccaccataccaatcagcaccaccacgatacccgccatcagcataccgcccaggaaggacatatccttacgggtggtcaacacataggccgagcagcagaagaaggtcagtgccgtaccgccgagcgccagcccgatcagatcgcccatgcctgccgacagataagcattaagcattggccccaggatataacccaggaaaccggtgaacgcaaaggctgccaggatgccggacggcttattcgccagcctgtaggtcaggaacatcagcccgtacatgccgacaatggtcagcaggaatcccggcgccggcagggcgagcattgtgctgagcgtggcggttaatgcggaaaacgccagcgtcaggctcaacataaaataggtattacgcaacaccttgtgcgtgctgagtagcgaggtacgctcgcgcgaagaacttactatacgatccatgcgtcactctcttatgacagatgtaattagttgtgaagaatagaaaaaaccaggcggcaggagatagcggttttacccatctttactctgacaataatcccatgacgatagcattaaattctttataaaaagcgtctggcagcaggagtgcgttttccgggaaaataatcagatcaagctcttataggtcactgaaaaatattgccttattttgcacccgtcgctaagagtattagtcagagtgtcatcttatacagggataaggcgaaaacaatgaaatcaggtaatacgcatattttcagaatgactctgctcgctggcgcggttttatgcgccagcgccgtaacctttgccgctcaggtgccgccaggtactgaacttgccgcaacgcaggcgctggtcagaaacaatggcagcgagcccgcctcactcgatccgcataaagtggaaagcaatgtcgaattcaatattatcagcgatttattcgaggggctggtggcggtaaaggctgatggcactattgagccgcgtctggcggagaaatgggaaaataaagacagcacggtgtggaccttccatttacgtccgggcattacctggtctgacgggacggcaatcactgcgcaggatgtggtctggagctggcagcggctgattgatcccgcgacaggctctccgtatgccagttaccccggcaatatgcatattctgaacgctgcggacattgcacagggtaaaaaacctgcctcgtcattaggcgtgaaagcgctggacgatgccacgctggaagtgactctgacgcagccgacagccgcctttctggctatgctcgcgcacccctcgctggtgcccgtagataaagtgctgatcggtcgctacggcgataaatggaccaagcctgaacatttcgttgccagcggcgcctataagctcagcgaatgggtggttaacgaaaaaatcgtcgccgtgcgtaatgcgcgctactgggatgatcagcacacggtgattaatactgtcacctatctgcccatcaatgcggaaacagcggatgtaaaccgctacaaagccggtgaaattgatatcaccaataccattccggtgaatcagttcgcccagctgaaaaagacgcttggcgatcaggtacacatttccccgcaactggcgacttattactatcagttcaacaccaccagagcgccattcaacgatccgcgggtgcgccgggcgctgaacatggggctggataaagacatcatcgcgactaaggtgatggggcaggggcagcgcccggcgtgggtcatcagccagcctgaaattggcggggtgagcctgcataatccggattacgccgcctggcctgaagagaagcggctggcggaagccagacggctgcttaatgaggcaggatttaatgacgcccatccgctgtcgtttaatctgctctataacaccatggaaacccatcagcgcatcgctatcgccgtcagctcaatgtggaaaaagaatctgggcgtggaagcaaaactgcaaaatcaggaatggaaaaccatgctggataccatgcataccggcaatttcgacgcggtacgttatgcatggattgctgattatgatgacgcctcaacattcctgaacactttccgcaccggcgacagcgaaaacacgacccagtacagtaatccggcttttgatacggcaatgcaaaacgcggcaaaggcggccaacgttgaagagcgcggaaaatattatcaacaggctgaagatttgctggcgcaggacgtgcccgcggtaccggtttatcactatgtgaggacgcatctggtgaaaccctgggttggtggctttgcacccgatcgcctcggctactttttgacgaaagatctttttatcaaaaaacactgagttttatgctgaataaatggtcattttgttgttatttcagtcgattaaacaggatttgatggtttttcagccaaacgataaaaatggtgctttacatggcgcaccgggatgtttatagtgcgcctcattccggaagtgtggccgagcggttgaaggcaccggtcttgaaaaccggcgacccgaaagggttccagagttcgaatctctgcgcttccgccagattaaacaaggggttaccatttggtaacccctttgtttttctggtctcataacttttctctccccgtacctttcaatgtatcctccttgcttatgctcctgtccaggacaggaaagccaggctgcgcctgatacccggcccatcatgtacttaccgccgggacgccatttttattcgcgataatagggagtattaatggggaaagtattggtaatactcaaaagctggcactggacgagcttgcgatgttcctcataatggaagtaaaaggcctctcttgcctggtcataaatcatcttatccagattcgcaaactccactattaacagcgagcctttgcgtaaatggccgccccccgtttcaaagttattctcaccccatgcctcctgcgtatgttcatagcgatgcaggatgacttctatttgcccgcgcagagggcaacgtaatctgataacagaattttccagggaaaaagcaaaggaaggggaggttaaaatccacaggaaagcgaaggttagaaaaaatctcattatttgaatgccctgactatttttcgcttttatggcattaaaattaaaccccgtccttgagcacaatcatatcgtgagtttgagtgatggcgatatatacagctggtgaatgattaggaccagaatgctatatgctgcgttaaggcgggaagaggatgcggataaaccaggcggaaaagagacatctgttgcagtactggccggtaaacgcccgatgcgtcaaccggccagttaaatagagggtaaatcagtcagcgaccagccacatatcggcttcttcgaacatctcttccagcattctgttcagtttttcacgatcgcttttactggcatcactattgagtgaattcgcctgcatcggtttaacgcgcacatcggcatcgggaaaaatacgatgaacacgatgtgtcagttcgttcagtatgatttcacgagcgccaggcagcccggcgacgttacgcttatcataaactaactctacaaacacacttcctccggaaactggttatttatacagttctcatcatacgagggttgttcgcagaggtaaagagaaagtcaggtcatttgccgtacctgcagggaagcgcatcagtcagcggcgaaaaaaacctcacaaatgaataacggtagcgtaagcagcgcgccagccagagtaatgaatgctacgccgatcaacagaatgctcatcggatacctcgccgtgcagggatacctgatattaaaaaatatagcggctatgtgacaataaattgaaggtatacataactttacccatgttcagcggtgataaatgcaggcaaagccaaactttgcggcatcgcttcaggaaaagcgtcataaatctgtcacacttattttccaacgcaaaagaggacggtggtatgaaaaaaacaattctggcggcgacgcttgccgcgctgaccctgactatattgcctgcgcaggcgcaggacgccccgcagggttatcagttgcagcaagtgctgatcatgagccggcacaatcttcgcgccccgctggcaaacaatggcagcgtgctggaacaatccacaccgaacaaatggccggagtgggacgtgcccggcggacagctcaccaccaaaggcggcgtgctggaagtttatatggggcactacatgcgtgaatggctggcggagcaaaaactggtgacgtccggcgagtgtccggcgccagaaagcgtatatgcctacgcgaacagcctgcaacgtaccgtcgccacggcacaattttttatcaccggcgcgtttcccggctgcgacattccggtacatcatcaggaaaaaatgggcaccatggatcccgtgttcaacccggtgatcacggatgcctctgcggcttttgaccagcaggcagtgcaggcgatggaaacgaagcgtaaagaattccagctcggagagagctatcagctgctggaaaaaattacccattatcaggattcaccagcctgtaaagaaaaacagcagtgctcgcttgccgaagcaaaagatgctttcagcgcaaaatatgagaaggagcctggcgtctccgggccgctgaaagtgggtaactcgctggtggatgcctttacgttgcagtactacgaaggtttcccgatggatcaggtagcctggggcgaaatcaaaaccgatcagcagtggcgggtactatcgaaactgaagaatggctatcaggattcgctgtttacgtcgccggaagtggcgcgaaacgtcgcggcgccgctggtgaaatatattgaaaaggcactggtggatggcgcaggcgggccggcaaaagtcaccctcatggtcgggcatgattcaaacattgcttcgctgctgacggcgctggatttcaaaccctaccagttacacgatcagtatgagcgcacgcccattggcggaaaaattgtcttccagcgctggcacgataccgcgggcaaccgcgatctgatgaagattgaatacgtctatcaaagtgcaaaacagatccgtaatgccgatgtgctgactctcaccgcaccggcgcagcgggtcacgctggcattaaatggatgcccggtagatgcggagggtttctgtgatatccagaaattcaatgcggtgctgaaagcggtaactaaataagatgggaactcccccgccagtgggcgggggaagacagatcagacgttcttacgttcgatggtttgttcgccccagaacaacgaatctttgtcggttttcttgaaggccaggatcaacacttcgtcattgccttcttcccagatttgctctgcgagcttttcgtcatagttggcgagttcgaaaatggcttcagcgatttctggtgaagtattgcgcagggtggcaaattcacccacgcgatgggctttggcttcttgagttggcatgctacgtcctcctgtcagattagtgtttcagtttcacggcaagaccggccacgtattcgccctgatagcgggcaatagccagttcttcggcgctgggctgtcgtgagccgtcgccaccggcaatcgtcgttgcaccataaggtgttccgccgcgcacctgtgaaacatcaaaaagttctttcgccccataaccgatgggcacaatcaccattccatgatgcgcaagcgtcgtccatgtggaagagatagtgtgctcctgaccgccgccagtacctgtagaactgaatacgctggcgatcttaccgtgcagtgcgcctgacgcccacaatccgccggtctggtcgaggaaggtgcgcatctggcccgccatattgccgaagcgcgtgggcgtgccgaagataatggcgtcgtaatccgctaattcctgcggtgtcgctactggtgcggactgcgctttaccccctgatttcgcaaaaagctcaggcggcatggtttcaggcacgcgtttgatggtgacttccgcccccgccactttttccacaccttctgcaatggcctgcgccattgtttcgatgtgcccatacatggagtaatagagcaccagtacgcggacattcgcgccatctgtcgtttgcatgtctctctccttcgctcaacaaatcacaaaataagcgtagcacatggagagttttcgcttatctatcagacgggtcttaggagatcgccgggagtcgtttgagcttcagatttaaatggcaggcattgttgcaaaatgaaacatttttgccgcttcggatttcgcaagtcataagaaaggcttatcaatgtccacgataaattaaatcctgaacggccagtatgatgttgcagaatattaacaacgggtagccggatggctgatgctggctaagctttagtcatgcgatgcgataaacctttccggttcgtgtcgtgaatgggaagtaattccgtgaacgtaatgcagtatgatgtctaatgtttaacaattctggaggtcagaaatggcaaaccatcgtggtggatcaggcaatttcgctgaagaccgtgatcgagcatcagaagcaggtcgtaaaggtggccagcagagtgggggtaatttcaaaaataaccctgaacgcgcatccgaagcgggaaaaaaaggggggaaaaatagtcacggcagccgcggtaacagcgagtagcgctgcgtagctaagacgagtaacacgcctgttatttattatcgcgtgtgaagcgtccccgccgccggattatccggcggttttttttgcccgcaatctgtattcagttaacaggacgcattgccggaaacaggatcacgtcgcggatggtcggtgagtctgtaaacaacatcaccattctgtcgatcccaatccctaatcctgcggtcggcggcaggccatactccagcgctgtcacataatccgcatcataaaacatggcttcatcatcacccgcatcgcgggatgccacctgctcccggaaacgctccgcctgatcctccgcatcattaagctcagaaaaaccgttgccgatttcccgtccgccaataaagaattcaaagcggtcggtaaaatgcggattatcatcgctacgacgagccagcggcgagacttctgccgggtattgcgtgataaaggtcggctgaataagctggctttccgcgaccgcatcaaatatttcggtgatgagccgcccgtgtccccaactggcttccgggacaatacccagtttgtcagccagggcggcggtaagggcaggggaatccagctcttccatcaggatcccgctaccgtatttgacgatggcttctttcatcgtcaaacgggtaaagggcttgccgaaatcaaaggtgtgatcgccgtaggtcacctctgtggcgcccgtcacctccagcgccagcgtccggaacagcgcctcggtcagctcgatcagatcctgatagtccgcataggccatgtaaagttccatcatggtgaactcgggattatgacgcggggaaatgccctcgttacggaagttgcgattgatctcgaacacccgttcaaagccgcctgccaccaggcgtttgaggtagagttcgggagaaatgcgcagaaacatctgctggtcgagggcattgtgatgcgtaataaacgggcgcgccgacgccccgccagggatcgtttgcatcatcggcgtttccacttccataaactgacgggcgtgcataaagctgcggatggccgccatcattttggaacggatacggaacgtgctgcgtgttttttcgttagcgataagatccagatagcgctggcgatagcgacgctcctgatcgattagcccgtggaatttgtccggcagcggcctgaccgctttggtgagcagacgtaattcagtacactccacggtcaactcaccggtttgcgttttaaacagcaccccggctgcgccgataatatccccctgatcgaacattcgcagatgctgttcatagcgcgtcagaccaatgccttttgcgctgatatacagctgaatgcgcccgcccatatcctgcaatgtaataaacgccgctctacccataatccggcgcgtcatcaggcggcccgctacgcgcacgacgatcttttgcgcttgcagcgtttctttgctgaagggatcgtaaagctgatgcagacggtcggccgtggcatcgcggcggaaatcgttcggaaaggcgttaccgttgcggcgcaactgcgccagtttttgcatacgcgcgctgaactcatcgttcagcgtctgcgtttgacccgtcgtgtccatacttgtgtcagcctctttaatagtggtagctgacaggcactttactgccgggagggtgaggaatgcaagtaaaatgatcttcatggagatcgttttgatctccattggcgtaacatgttactcgtctttcgtaccgtaagagtgttttatttcgtccatcagtgatgacgcctgtgcgtagaaacgctcgcgctggctggtggataggctataaagctgctgttcaaaatcactctgcaacagtgaatcatgcaggatccctttcactccctccttgtgaatgactttcagcaacgcctccacttcatttttatccagcgagttgaataccatcgaccaggcgaattccagcggatccttcgtggggcgattttccccggtagtcgcgccattgtcggtcagtaacgccggtggttccttgtgtacgccagaggccagccattccacggagacgccttcccggtcagcgatttttttcgccatgctcagcgagggctcagtaccacggttgaggtaattgttaagtgtggagtaagagagatcccacgctttcgccacggagcgcgtgctgcgtgaaccaatgagcaatcgcagccggtaggccagtccttctacagacgtatcttcatcaccagtcaggggttcattcttcatcgtcttccatcctgcctcatacaactctgcaagttgatgcgcaaagcgaccaaaaatatgcgagacgtgccgcatttatccgattcaggactttttatcgcctcaaaagagatcaatgctatgtctgcttcgttacattgagttcaacccatagggttatgccatggggtaaaagaaagaggttaatcgaataatggctacaaatgaagagcatagggactggaaccggatagatattgtcgccgcgctgcacaagcagggcgtttctatccgtgaactctctgtgcgtgccgggctgaaacccgacacgctaaaaaatgccttatcccgcgcctatccaaaagctgaacgcattatcgccgatgcgctgggcgttgcgccggaacatatctggcccagtcgttatttgaatggcacccgcaagtctgcggaagattcttcactaatcaattaacgctgaaacaaggaggggcaatgcgctgaaaataataaccgctacggcacgatcattaaataaacacacagcttttattatacagagatggaatgatgaataatcccggaaataaaatgggagtcatgcatctgaccatattaaccgcggttaatatgctggggtcaggtattattatgcttcccactaaactcgccgaagtcggtacgatgtctattatctcctggctcgtaattctgcctgggtgccttacaccaatttcagcccaatttatcaggggctctgcggcatgagcggtaaccggataccgggaaaggtgatctacgaaacccagtctacgcacaaactgctctgctgacgccgggtatggatcgcctgggcaacatggaggagcagggtattccggcctctgttgtggcgaaatacctcgatcagcaggggattatcgtcgagaaaaccggtccctataatctgctgttcctgttcagtattggcattaacaaaaccaaagcgctgcgtctgatgcgggcgctgaatgatttcaaacgcgattacgaccgcaacctgcacgtcaaagagatgctgccttcggtataccatcagtagcccgcattttacggcaatatgcgtattcaggtgctcgccaccggcattcatgccctgatccgtcaacaccgtctgcccgagctgatgtttaacgcctttgaaactctgccaaccatggtgatgaatccgcatcattatcctggtttcgaaaccgatattcatggcgcgtatcgccagccggatggtcgctatacggtgaaagtcatcaaaaacctgcgttaatctcactgtccgccatgcccggaacgcgaggggcatggcggttttttttgcttccggtgttgaactccgcaaaccgccatcgcacactacagcgctgatttcattactggttgtcgcatggaaactttcttgtcccgctattccttctccgtcaaaccgcaggaagccctgctgatccttatcactatgttctggggcggcaccttcctcgccgtgcaatatgcggtgacgatgagcggtccattcttttttgtcggcctgcgttttgccactgccgcgctggcggtggccttgctgtcgctgaaagtgctgcgcggcgtcacctggctggaagtaaaagccggtgtggcaatcggggtatccattgcgctgggctatagtttgcagacatggggattacagaccatctccagcagtaaatcggcgtttatcaccgccatgtatgttccgctggtgccgctgttgcagtggctgtgcctcggcaggatgccggggctgatgtcctgtatcgggatcctgctggcctttaccggtttgatcctgctggccgggccagggggcgatctgctggtgccgggggagggggaactgattaccctggcaagcgctgtggctatcgccgcagaaattattcttatcagcgcctgggccggaaaagtggacatccgccgggtgaccattatccagcttgccaccgcctcactggtggcgtttttcgccatgatccctgccggggaagccgtgccgccgttgtcgcctgcgctgctgggtgtcgggctgggactgggcattttcagcgccattattcaggtggtaatgaactgggcgcagcgcagcgtctccccgacgcgggcaacagtgatctataccggcgagccggtatgggcggggatattcgggcgtattgccggtgaacggctgccgctgctggccctgctgggcggcgtctttatcgtactgggcgtgctggttagcgagctgaagttcaacaagaaaaagggcgtgagcgaatgacccggggcgaagtaaaaaagagcggtaaacggtcgcaggcggtgagcgagaaaagggcggcgatccttgctgcggcgctggcgctgttttcccgctcgggcatccacggcacgcgccttgaacaggtggccgagcaggcgggcgtctccaaaaccaatctgctctattactacccgtcgaaggaagcgctttatgtcgccgtactgcaacagatccttgatatctggctggcgccgctgaaagccttccgggaagattttgcgccgctggtggcaatcaaagagtatatccgcctgaagctggaagtctcccgcgatcacccgcaggcctcaaggctgttctgtctggagatgttgcagggcgcgccgctgctgaaagcggagctgaccggggatttaaaagcgctggtggacgcaaaatcggccattatcgccggctgggtggagagcggtaagctcgcgcctgtcgacccgcatcatctgatctttatgatctgggccgccacgcagcattacgctgattttgcgccccaggtggaagcggtaaccggggcgacattacaggatgctgagtttttccagcgcacggtggataatgtccagcggatgatcatcgaagggatccgcgcacgttaattccccggcggcagcggacagctgagatcgccttcctcacactgtaacagcgaggccagccaggcttcgcgctcgacggttttatcatgcagacactgattgttgatcatcggctgcacgctgccgccttcagtggcggagctgataaaggcgcagtcggcgtcgcgcatggtgatccacgcctgttgcgcttttttgagcagctcgcgctgcggcgcgtcggcgcgtttcatggcggtgctgtaggtgtcgttgagttttttatccgccgcctgatattgcgtggcggtgcagctgttcagatcggcctgcgtgctggcgctggcgcagtcatccgcgagcgccggggcgcttaacagcgcagcagcaaaaaagagggatgtgcgtttcatcatgtctcccggagtagcgaaaacaaaagcctacacggtcaggcatggccgggcaagcctgagctgacggggtttatgtcgggtggcgctacgcttacccgacctacagatcgaacggtggttatgtcgggtggcggcttcgccttacccgacctacaaactacaaatctaatggtagataccgtaggcccggcaagcctgcgccgccgggcacccatcacaacttaaccgatggtcatcaggctggcgttgccgcctgccgctgcggtgttcacgctgagagaacgctccacgcacagccgctccagcaggatattgctttcgccgcgggcaaagccctgcaccgacacaatcgccccttcacgctccgccacctgctcgcaccaggcgcgcagctgatcggaatcgccgtggaagatcaccgcatcgaatgcctgggccgcgagggtttccggcgcggcaagctgaatacgcgcagtcaccgcctgcggcagacgtttttgcagatcgcgatgcagaccatcttccggccacagcacctgactacccaccgacagcaccgccgccagctgcgtcagcgcatcctgttcgttatcggcgaggcacagcacgcgctcacgcggtaacagggtccaggtattacgctcaccggtcggccccggcagcacccgctgcgtaccactctgcgcctgttcagcaaactgtgcgcacagcgtctgcaactccgggttgtccttcgcccagctctgcaatgccgccagcggctgcgcgagcagggttttcagctgcgtatccacggcctgcccggcatcatgacgggtgagtgtggtggtcacggcggtttccggacggctggagagcaggcggtacagatacagcgggccaccggctttcggtccggttccggacaagccttcgccgccgaacggctgcacacccaccaccgcgccaaccatattgcggttcacgtacaggttaccgacgtgcgcgctgccggtgactttggcaatggtttcgtcgatgcgcgtatgcacgcccagcgtcaggccatacccggaagcgttaatttgcccaatcagcgcgtccagcgtctcgcggcgataacgcaccacgtgcagcaccgggccaaacacctcttttgtcagttcgtcaaagcgctccagctcaatcagcgtcggcggaataaaggtgccggtgttccactctttcgcgtcttcacggttgtcatacaccgcctggaacaccttgcggcctttggcgcgcatggtctgaatatgattttcgatgctggctttggcttcggcgtcgataaccggaccaacgtcggtggagagacgctccggattgcccatgcggcactccgccattgcgccgcgcagcatggtcagggtatgatcggcaatgtcgtcctgtaagcagagcacgcgcagcgcagagcagcgctgaccggcgctgtcaaaggcggatgccagcacatccaccaccacctgttcggtgagcgcggaagagtcgacgatcatggcgttcatgccgcccgtttcggcgatcagcggcgttgggcgtccttgcggatccagtctggtggcaatggtgcgttgcagcagcgacgccacttccgtggagccggtaaacatcacgccgcgcacacggctgtcggcggtcagctgcgcgcctacggtttccccgcgccccggcagcagttgcaccacacccggcggcacgcccgcttccagtaaaatcgccacaccagccgcggcgatcagcggcgtctgctcagccggttttgccagcacgcagttgcctgccgccagcgcggcggcgatctggccggtgaaaatcgccagcgggaagttccacgggctgatacagaccaccggccccagcgggcggtgggtttcgttatcaaaatcgtggcgcacctgatccgcatagtaatgcaggaagtccaccgcctcgcgcacctcggcgatagcgttgctgaaggttttgcccgcttcacgcaccagaatgccgatcagctgctgcatctggccttccatcagcatggcggcgcgttcgaggatcgccgcgcgctcctgcggcggggtggcgaaccagattggcgcctgatccaccgcgcttgccagcgcgcgctccacttcggcggcggtggcttcgcgggtatagccgacaatatctttcggctcggcagggttaatgaccggcgtcagttcgcccgtctcacagggctgctccagcaccggcagcgcctgccattgttgctgggcgctgttaagcagggcagaggagagggacgccaggcggtgttcattcgccagatccagcccggcagagttgacgcggccattggcgtacagctcgcgcggcagcgggatcttcggatgcggcagtcccacctggccttcctgggcggcgagtttttccacggccttcaccggatcggctaccagctcatccagtggcagggtggtatccgcgatgcggttaacaaaggaggtgttcgcgccgttttccagcagacgacgcaccagataggccagcagggtttcatgggtgccgaccggggcataaatacggcaggggcgattgagtttgccgtcggccactttacccaccacctgttcatacagcggttcgcccatgccgtgcaggcactggaactcatactgacccggatagtagttctgaccggcaagctgatagatcgccgccagcgtgtgagcattatgggtggcgaactgcgggtagatcaggttcggcacgccgagcagtttcttcgcgcaggcgaggtaagacacatcggtgtacaccttacgggtatataccggataaccttccagaccttccatctgcgcgcgcttgatttcgctgtcccagtacgcgcccttcaccagacggatcatcaggcgacggcggctgcgaccagcgagattaatcagataatcaatcacaaacgggcagcgcttcatgtacgcctggatcacaaagccgatgccgttccagcccgccagctccggctcgaagcagagtttttccagcaggtcgagggagatctccaggcggtcggcttcttcagcatcaatgttaatgccgatatcgtactggcgcgccagcagggtgagcgacttgagacgcgggtacagttcttccatcacgcgatcgtactgggcgcggctgtagcgcggatgcagcgccgacagcttgatggaaatccccggcccttcatagatcccgcgaccattagaggccttgccaatggcgtggatcgcctgctggtaagaaaccatataggcctgggcgtcagccgcggtgagcgccgcttcgcccagcatatcgtaggagtagcggaagcctttatcttccagcttgcgggcattagccagcgcttcggagatggtttccccggtaacgaactgttcacccatcaggcgcatcgccatgtccacgcctttacggatcagcggctcgccgctcttgccgatgatgcggttaagggagcgggagaggctggcttcattatgggtggacaccagacgtccggtaaacagcaggccccacgtggcggcattgacgaacagcgacgggctgcggccaatgtgcgactgccagttaccgttgctgatcttgtcgcggatcagcgcatcgcgcgtggctttatccggaatacgcagcagcgcttccgccaggcacatcagcgccacgccttcctgggaagaaagggaaaactcctgcaacaggctttgcaccataccggcgcggccgctggcggttttctggttacgcagtttttccgccagttgataagccagcgaatgggcggcgctcgcgaccggctcaggcaggcgcgcctgttcaagcagcataggtacggcatcggtttccgggcggcgatacgcagccgtaatggtggcgcgggtcaccgactgcggcagaatgtttccggcaaattccaggaagggctgatgcggttcttccgtggcttcactaatctcttccgcttccgcagtttccgcgttaaaaggcgcagcaaactccgctggcgtaccctcggtttccagcttttcaaggtaattaaaaatggcctgtttgatcagccagtgcggggtacgatcgatacgtgaggcggcagttttaattctttcgcgcgttgcatcgtccagcttaacccccatggtggtggcgcccatgtgcgtgactccctttattctgatgtcataccgtattggttaacctgaaatatccactatgttgcaactttgtgcaaccatgttaattgtgacctcgccagcaagctaataaatggcttaattgttaatgaagggtaatgctatttaacgaccttgcgtcgccgtctcacgccttaaaacatgcggcgcttaacactttttcaaggtgcaacctttaaaagcgtgagcgagtgcaacctggcaataaaaaggcataaaacagggatgaaattgatgtgaatggtgtgttaaatcgattgtggttcagaaacgcttccggcaggatacggtcgccccataaaacaatgacgctttttccacgttccggagaaggtgcccgcggcaagcattttatttgccgacgaataaatctggagatcttttcatggcagttagcacaccaatgatggtgacgtttttaatttatatctttggcatgatcctgatcgggtttgtcgcctggcgttcaaccaaaaactttgacgattatattctgggcgggcgtagtcttggtcctttcgtgactgcactttccgcaggggcgtccgacatgagcggctggctgctgatggggctgcccggggcgatttttatttccgggatctccgaaagctggatcgccatcggcctgacgctgggcgcatggatcaactggaagctggtggccgggcgtctgcgcgtgcacaccgaagccaacaataatgccctgacgctgccggattatttcactggccgttttgaagataaaagccgcgtcctgcgtattatttccgcgctggtgatcctgctgttcttcaccatctattgtgcatcaggcattgtggcaggcgcgcgtctgtttgaaagcactttcggcatgagctacgaaaccgcactctgggcgggggcggcggccaccatcatctatacctttatcggtggattcctcgcggtaagctggactgataccgtgcaggcgagcctgatgattttcgcgctgatcctcacgccggtgattgtaattatctccgtgggcggttttggcgattcgctggaagtgatcaaacaaaaaagcattgaaaacgtcgatatgctgaaagggctgaacctggtggcgatcatctcgctgatgggctggggtctgggctatttcgggcagccgcatattctggcgcgttttatggccgccgattcccatcacaccattgttcatgcccgccgtatcagcatggcgtggatgatcttctgtctggcgggcgctgttgccgttggcttcttcgggatcgcttactttaataacaacccgtcgctggcgagcgcggtaaaccagaacgccgagcgcgtatttattgaactggcgcagatcctctttaacccgtggatcgcaggcattctgctgtcggctattctggcggcggtgatgtccaccctcagctgccagctgctggtgtgctccagcgccattaccgaagatctgtataaagcatttctgcgtaaaaacgccagccagactgaactggtatgggttgggcgcgtgatggtgctggtagtcgcgctggtggccattgcgctggcggcgaatccggaaaaccgtgtgctgggcctggtgagctatgcctgggcgggcttcggcgcggccttcggtccggtggtgctgttctcggtactgtggtcacgcatgacccgtaacggcgcgctggcgggtatggtgatcggcgcggtgacggtgatcgtctggaagcacttcgaactgttcggcctgtatgaaattattccgggctttattttcggcagtatcggtattgtggtgttcagtctgctgggcaaagcgccatccgctgcaatgcagcaacgcttcgcggaagcggatgcgcattaccactctaaacctggcgcacccgcgcagggcatccgttaattgtaatttgtgacctcccgggacccggcagcgctgcgctgccgggctattacttcgttacctttccacgctttcctgcttcctgatccttaccctgcaaagcatttacattctgtgattattcaaatcagattttacttgtctttcctcttgccgtaatgataatcactatcattgaaattttacttttctttgcatcagttgacagtcaataacgtttaagggttttccacatgtttgtcccgtttctcattatgttacgcgaggggcttgaggccgcgctgattgtcagcctgatcgccagctacctgaagcgcacccaacgcgcgcgctggtttggtgtgatgtggattggcgtctttctcgccgccgcgctctgtctggcgctgggcattatcatcaacgaaaccaccggcgagtttccgcaaaaagagcaggagctatttgaaggaattgtggcggtgatcgccgtggtgatcctcacctggatggtgttctggatgcgtaaagtgtcgcgtaacgtcagggtgcagctggagcaggcggtggatgccgcattgcagaaggggaaccgtcacggctgggcgctggtgatgatggtgttctttgccgtcgcgcgtgaagggctggaatcggtgttttttctgctggcggcattccagcaggatgtggggatctggccgccgatcggcgcgctggcaggcctggcaacggcagtggtgctcggttttttactctactggggcggcgttcgcctgaatatggcggcgtttttcaaatggaccagcctgtttattttgctggtggccgccgggctgtcggcaggggcgatccgtgcatttcatgaggccgggctgtggaaccacttccaggacgtggcgttcgatatgagcaacacgctcagcacccatacgctgttcggtacgctgctggaagggatttttggttatcaggaagcgccgagcgtcagcgaagtggcggtatggtttatctatctgatcccggcgctggtgctgtttgcgctgccaccccgtaccggcacgcagccatcgcgcatggcgccgtaattattttaaacttgctcaactagttacaacatactatttaagggaaaggtcatggcacttcattttcgtcgtacagcgttgcaggcgggtatcgccacgctgctgtcctgtgcatttgctgcgcaggctgcggatgttccccaggtcaaagtcacggtaaacgataaacagtgtgagccgatgacactcacggtaaacgccggtaaaacccagtttgtgatccttaaccacagccagaaagcgctggagtgggagatcctcaaaggcgtgatggtggtggaggagcgggaaaatatcgccccaggcttcagccagaaactgaccgccaacttacagcctggcgaatacgacatgacctgtggcctgctgaccaacccgaaaggcaagctgatcgttaaaggtaaggccaccggcgatgccgcgcagggcaacgtgctgctcagcctgagcggggcgattaccgactataaaacctatgtcaccaaagagatggacggtctggttgccggcaccaaagcctttaccgatgcggtcaaagccggtgacattgaaaaagcaaaatccctgtacgcgccgacgcgccagcattacgagcgcatcgaacctattgccgagctgttctcggatctggatggcagcatcgatgcccgtgaagatgactacgagcagaaagccgccgatccgaaattcaccggtttccaccgtctggaaaaagcgctctttggcgataactccacaaaaggcatggagctgtacgccgatcaactcaacagcgacgtgctggagctgcaaaaacgcatcagcgaactggcgttcccgccgtcaaaagtggtgggcggcgcggcgggcctgatcgaagaagtggcggcgagcaaaatcagcggtgaagaagatcgctacagccataccgacctgtgggacttccaggccaacgtcgatggcgcgcaaaagattgttgatctgctgcgtccgcaactgcaaaagggcaacagcgaactactggctaaagtggatgcgaactttaaaaaggtcgataccatcctcgcgaaatatcgcaccaaagatggttttgaaacctatgacaagctgaccgatgccgatcgtaacgcgctgaaagggccgatcaccacgctggcggaagatctggcgcagttgcgcggtgtgctcgggctggattaagcagaaatgaaccacgacgaagattacggcgtgagcgagccgtcgcgccgccgtttactgaaaagtatgggcgcgcttggcggcgcgctggcactgaccggcggctgcccggcgcatgcggccaaaccgcagagcgcgccgggtacggtatcgccggatgcgcgcatggaaacccagccgttttatggcgcgcatcaggcgggcattctgacgccgcaacaggcgtcaatgatgctggtggcgtttgacgtgctggcgagcgataaagcggatttgcagcggctgtttcgtctgctgacgcagcgcatcgcctttctgaccaccggcggcccggcgccggacacgccgaacccgcgtctgccgcccacggattccggtattctcggggagtttatcacaccggataatctgaccatcacggtatcgctcggcaaatcgctgttcgacgagcgcttcgggctggccgcccatgcgccgcgcaaactgcaaaaaatgacacgctttccgaatgactcgctggatgcggcgctgtgccatggcgatgtgctgctgcaaatctgcgccaacaccgccgacaccgtgatccacgccctgcgcgacatcatcaagtacacgccggacttgctcagcgtgcgctggaaacgggaaggcttcatttccgcacacgcagcacgcagtaaaggcaaggagacgccgatcaatcttctcggcttcaaagatggtaccgccaacccggacagcaagaatgacgcgctgatgaaagaggtggtatgggtgcaggccagtcaggatgaacctgcctggaccgctggcggcagctatcaggcggtgcgcatcatccagttccatgtggaattctgggatcgcacgccgctgaaagagcagcagacgatttttggccgtgacaagcacagcggcgcaccgctcggtatgcagcatgagcacgatgtgccggactacagccgcgatccggatggcgatgtgatcgccctcgacagccatatccggctggccaatccgcgcacgccggaaacccggtccagcctgatgatgcgccggggctacagctattcgctgggggttactaattctggccaactggatatggggctgctgttcgtctgctatcagcacgatctggaagaaggattcctgacggtgcagaagcggctcaatggcgaagcgctggaggagtacattaagcccatcggcggcggttatttctttgcgctgccgggggtgcctgacgccgatcattatctggcgcaaggcttgctggaagcctgacgccgccaaccctgccggccacggcagggttccttccttacggatcgccgcagcactatcattttttgctatgagcaactcattgttatatttctgtaatataaatgtcagatgctcttagtcacggaagcgctggttgaagttataaaaaagtaatctcaatgttgcacttgtgctaaattgaaaggtaaggaaagcagccagtgttcccggcagtgatgagtcctttcactatggagatcgcgaatggtaaggtcctgtaccggacataacagcaaatcatcccgcaaatcccggtgcggtagatcctctaccggcaatgacttcctcaccgctttattttccatcccctctgaaatccctgatgtatccgatgcggcagatgtcttatctggtcgttctgcggcgtcatgtccaaaagcaagcaatggcttacaaggaagccaaacctcagacgttcgtgcgcataatcgcgtcgctgttgacgcgtgtgatgtaaaccaacaactcaaggtgctatccatgggaagacaaaaagcagtgatcaaagctcgtcgtgaagcaaaacgtgtgctgagacgggattcgcgcagtcataaacagcgtgaagaagaatcggtcacctcgcttgtgcagatgagtggcgtagaatcaattggcatggcccgggactgccgtgatagttcgccaattgccgcgcgtaatgaagctcaggcgcactacctgaatgctattgagagcaagtcccttattttcgcgaccggtgaagcgggctgcggaaaaacctggattagcgcagcgaaagcggcggaggccctcattcataaggacgtggagaggattatcgtcacccggccggtcctgcaagccgatgaagatcttggcttcttacccggcgacatctcggagaagttcgctccttatttccggcccgtctacgatgtgctgctgaaacgtcttggggcgtcctttatgcaatactgcctgcgaccagaaatcggcaaggtagaaatcgcgccgttcgcctatatgcgcggacgtacatttgaaaatgcggtcgtcattcttgacgaggctcagaacgtgaccgctgcgcaaatgaaaatgtttttgacgcgcctcggggagaacgtgaccgtcatcgttaacggtgatgtgacgcagtgcgatttgccgtcgggcgttaagtccggcctgagcgacgcgctggcacgttttgaggaagatgaaatggtaggcatagtccgcttcacgacagatgactgcgtccgctcggccctctgccagcgcacgctgaaagcgtactattaagacagttttttgatgacaaagcccgggataccgggctttggtttttgtagggcaaaataaggacgaaaaaaaagcccgtacgtgagtacgagctcttctttaaatatggcggtgagggagggattcgaaccctcgatacgttgccgtatacacactttccaggcgtgctccttcagccactcggacacctcaccatattgttttgctgccttcccgcagggggcaacggggcgctactatagggattcggcttaaatcggtcaagcaaattttatgcctgccggtgcgttcggttaagcagtgagcgattgctgttaatcactacagttttattacctgcgcgtatatacacgcaaaaaaagcccgtacgtgagtacgagcttttctataaatatggcggtgagggagggattgactcgctgcgctcgccctgcgggcagctttctcgcaggctcgtcagctgtccaaatgcgcaggcgcatttgtcgaaccctcagtcgggggttctcatccctccctctccggggactacaaaagaaaaaagcccgtacttacgtacaggctctcatcctgaatatggcggtgagggagggattcgaaccctcgatacgttgccgtatacacactttccaggcgtgctccttcagccactcggacacctcaccatattgtcatcccgttgttgctgggacggcgctaatgtagggaaatcctcactcagcgtcaatcaactttttcaataaattagcgcgttcagacaaacttccagcaacctgcttcttaatcgcgcgggaattgatttttttatcagcaacgcagacagcccctgcatcaggaagaaatttgttatgctgctacgctgataaatccccttcaaagatagccgcgcggctggctaaaaatcatgcgcttaccaataacagcgccacaacatctggagttgatatggacattcttttctggcatccgacctttgatacccaatactggctaactgaactcaaacgggcgctgccgcaggcgcgcattcgcgaatggaaacccggcgataacgatcctgctgactatgcgctggtctggcaaccgcctgttgaaatgctacagggcagggaactgaaaggcgttttctctctgggcgcgggcgtcgatgcgatattgagcaaactgaaagcgcatccggacatgctgctgccatccgtgccgctgtttcgactggaagataccggcatgggcctgcaaatgcaggaatatgccgtaagccaggtgctgcactggttccgccgctttgatgattatcaggcactgaaacagcaggcgaaatggcaaccgctggaggagtataagcgggaagactttaccgtcggcgtgcttggcgcaggcgtgctgggatcaaaagtggcggaaagcctgctggagtggggattcccgctgcgttgctggagccgcagtcccaagagctggccgggcgtcaccagctttgccggcgaggcggagcttggggaatttttacggggtacgcgggtgctgattaacctgctgccgcgcaccgccgaaaccgaaggcattattaacctcaatctgctcaaccagctggctgatgacagctacttcattaacctggcgcgcggcgcgcatgtggtggaagccgatctgttgcaggcgcttgagcgcggcaagctgaaagctgcgatgcttgatgttttcagccaggagccgctaccggaaaccagcccgctgtgggcgcatccccgcgtaagcatgacgccgcacattgccgcggtaacgcgcccgctggaagccatcgcctctgttgcctggaccattgagcaactggaagccggcaaaccggtaaccgggcaggtggatcgggttcgcggctattgaggatcgcccggctgtcgccgggttttcattataaaggcaggcgatatttgttatccttgcggaaatcaccagaggagagagccatgtatcccgttgacctgcatatgcacaccgtcgccagcacgcacgcctacagcacgcttcatgactatatcgccatcgcgaaaagcaaaggcctcaagctttttgccattaccgatcatggccccgatatggcggatgcgccgcactactggcactttgttaacatgcgtatctggccgcgggtggtggatggcgtggggatcctgcggggtattgaggccaatattaaaaatactgacggcgagatcgactgcaccgggccaatgctcaccgccctcgatctgatcattgccggttttcatgagccggtattcgcgccgcaggatcaggcgactaacactgaagcgatgatcgccaccatggccagtggtcaggtgcacatcatcagccatccggggaacccgaagtatcctgtggatatcaaggcgattgccgaagccgccgccacccatcaggtggcgctggaaatcaataattcctcttttctgcactcccgtaaaggcagcgaagccaactgccgggcgattgccgccgccgtacgtgacgcgggaggctgggtggcgctgggatccgattcccacaccgccttctcgctgggtgattttaccgaatgccgtaaggtgctggacgacgtcgatttcccggaagatcgtattcttaacgtttccccgcgccgtctgctgaatttcctggaatcgcgcggtatgccgccgatccctgaatttgctgaattttaatgtctgttatggaatcaacgaatgaatgagttttcaatcctctgccgcatgctgggctcgctttactatcgtcagccgcaggatccggtgctggccccgctgtatacgctgatccgcgagggcaagctggcagagaactggccgctggagcaggatgagctgctggcgcgcttacaggccagcgcggatctgcctgcgctgaccgcagactacgacgcgctgttcgtcggcgatgactgcaaggtgtcgccataccgcagcgcatgggtggaaggcacaaccaaggcggacgtcagagcatttttgaccgaacgcggtatgccgctgacggatgcgcctgccgatcattttggcctgctgctgctggcggcatcctggctggaagataatgcaggcgaggatgagagtgaagcgctggaaatcctgtttggcgattaccttctcccctggtgcggcaccttcctgggtaaggtcgaagcccacgccaccactcctttctggcgtaccatggcatccctgacgcgcgatgcgctggcggccatgtgggacgatttgcaggacgataccgctgaataacgtgatcaccatcacttatttaatgtaacgagcaattcgttattgcaaataacgtgcggcagatcgcatcttaccggcgcgcatctgctaagatgcgcgccatgaacatactctttgcaatcgcactcactaccggcgttctgtccgcgctctggggttgggtggctgtcactctgggactgttaagctgggcgggttttcttggctcgacggcctatttcgcctgtccgcagggcgggcttaaaggcctgcttattacgctgtgcacgttgctgagcggtgtcgcctgggcgcaactgattatccacagcagcgccatgctgccgcagttgtcgatcgccggctatgccatcaccggcatggtggcctttttcatgtgtatgcaggccaaaaatgtactgttgtcctttgtgcctggcacctttatcggcgcctgcgcaacctttgcagggcagggggactggcggctggtgctgccatctttactggtcgggctgctgtttggtttcgcgatgaaaaatggcggactgtggctggcagggcggcgggctaaagaaagttctggcgcggtggcagcggaataaaaaaggcgtgacgaaaaccgccacgcccgcgcacattattattatcaggactcaggcggtacggccatctggcggtatttctgtagcacggcgtttttcacttcgccggggctttgcaaatcccacagcccgcgatcgataccgtcattgatcaggaagatcaccccggtttcaatggctgacatcaggcacagcattactggttcattagcggtatagccaatttccccctccagcagacgttgataatcaataaagcggaacacgcccgcctggacttcataagacaaaatcgttttgctggtgttgactgacgagaggatctcgccggtgctgacgttaaccacgcgcaggtttaccgccacctgatcgagctgatactgcgtatcgccgccaataccaaagtatcgcgcccccacgccgcccgattttacattgctttcatagccaataatcgagccttcgatcatcacgtttgccgccgtcaacgattgcaggggaacgcgattattcatcgccaccgtgccgttttcctgggcggcgcggataatcttgcgctcgtttaacaggttttgcagaccctgacgctccagcgggataaaccagcgggaatccttcagcgccgtgaccagcatcgccgtggcgctctgcggcaccgccgtggagaagttactcgccggataggctttaaactgcccggtttcatcctgaatgttatacaccgacacaaagactttgccggaagggggtggcagatgcgttaagtcgcgaaaactctgcgcccgtggcatcagggtcggtttggccgcttcttttggcggagcggtcaagcatccgctcaataaacacaccgccagtaaaataagtaagcgctgcatagtcattgtcctgtagtagctgtgtgttaaaaatcggtcgaattgctttgtaaaccggccacctgaatggtcgatgttttgcccgttttacggtcggtgacgtttagctgtaattgcccgtcgttattagcgatatcgacaataaaatcggtggtgaccatccggcctggtttgccggtatttatattggtcagcaggccgcccaacagctgcgactgaatagcctgggtaaagttatccagcgctgacggcgtttcaataccaaaatcatcgtcataactgggatctttataagagttttgcgcctgggcgctattcaataaaaacgcgccgttatttggattccctccaaaattaggattgcgaaactgaaaggtcatatttcctgccgagcacagcggggaaataagcataagggtgacaacggcacaagcgatacgcatgacagcctccggaaaattattaggttttagtattcgtctttcgccagatcgccggtactgagcagagcctgatcaatttgccggcgatccagtgcttcttcggtttgcgctatcgcgatatttacgttgttgtcgaaatcgcgtttggtcggaaataaaaaggtctgataaaccagatcctgattaaccgtaatggtgatccagctgccccagcgcgcacttgggcgttcattgatggttaaattacccgtataactgctttcccatttatcgctaaatgcacgatagaaatcgtgtcccaccgatgacaccgtgtggtcagtcagcaatcccggcacttccacttcaaccgcgtacaggttcccggcagccagcagaagttctgcggctgcaagccaggctatgtaaggtttcatgatgctaacgcctgaggttatcgttagcccaggagaccgcctgcgtacggtttttaaccgagatctttttaaataagttatacagatgcgttttaaccgtgttttcgctgataaacagggcgcgggcaatctcgatgttcgaggcgccgatgcgcagcttattgaggatctctttctcacgatgcgtgagtaaggcagactcagcgctgttatagcgataattacccgagtgggtgatgaggtagctggccagtttctgtgagaagtagcattcgccgcgctggacgctttgcaggccgtccaccacatgcgattcatcctcggtcacataaaaaaccccgttgatatgcggccagttttcaatgtcgcggaaggggtactcgtcgggggtattcagtaacaacaattttatattgttgtttttacggcttaaattttcctgccagtactggataagttttttatccgcttccatcatatcaaagaggatcacgctgccaggattaatatcatccagagatcgttgaatattatggagtttccctgtaattgccagggagttttttaaatgttgtaataaagctgtagcctgtaatgagggtttagtgatcagcaagattgactgagcatgtaaactctggacttcattaaacatgatgaaactccgcttttaggtacatccgcagcctatccccatgacaatatggagacccagaagtactgacagatgttgaactgctgtgtgtaataaaataataagcccgttagtgggcaaaattaacaaagtaaaaacatactgctggtttcaatctagtcattaccaaccttaaatcaagtgttaaacatgtaacaggatgtaaaattaaattattaaatgtgttttttgcatgtttttatccatcggttttaatggttaagttgtacaagttaatacttgtgtatcaaatttaatgtcataaatatttcatgtaacttattgataattaatgcgatatattaaatatgttaaaatttaattgtgcactaatattaaattaccaattccacttttttaatgtgaccacatcgtaaagaaaaagtcgcgtggtgacagattctgtaaaaatcttctttgtaaacgctcaaaagttctatgcaaagcgcaaaaatattcttctggtactgtaaaggtattggtgtttggtgcgaattgtgacagaagtgcaataaatgccagaaagctctccgctccttctcatgctttaaggtgagtatgtggataaaaatacgaatcgcaggtgagatatttaagatatttctccgcacatactctccattgttacgaggcgttaacaaatattgaaatacgttaatgaccccggcagacattatttatgaatgacaatcaggtccaggtgacagcatgaaaaacagactgttatttatggtgttggcaatgttgagtgcgcctggaattaccttagcggcaggttacgatctggcatcttcagaatataactttgcggtgaatgaactgagcagggcttcttataacaaagcagccattatcggtcagcagggtaacaataacagcgctcagctaagccagcagggatcgaaattactggcggtggtttcacaggacggtggaaataaccgggcacaggttcagcagtcaggaaattacaaccttgcgtatgtcgatcagacgggtaattccaatgacgcgactattacgcaaggggcttacggtaataccgcgatgattatccagaaaggctcgggtaacagagcgaatattacgcaatttggtacgcaaaaaacagcagtcgtagtgcagaggcagtcgcaaatggctattcgcgttacccaacgttgaaagcattgagacgcttacatatcaatccgatgggggtttaccatgaaatttatcaaagtggcagttgtagcagcgatcgttgtttctggcagtgcttttgcaggctccattccgcagtatggtcacggcggtcacaatagcggcccgaattcagaactgggtattttccagtacggtagcactaacgctgcgctggcactgcaaactgacgcccgtgattccagcctgaccattacccagaatggtactggtaacggcgctgacgtaggtcagggttcggacgacagcaccatcgaactgacgcagactggctcacgcaacaacgccactatcgaccagtggaacagccgtgattctgaaatcaacgtcaaccagcacggcgtgctgaacggcgcgctggttaaccagactgcctctaactccttcgtggaagttcgccaggttggttttggtaacaacgctaccgctaaccagtactaagacttcagcagtagaaaagaacagggctccggccctgttttttttcatccggagaaacctatgcatccactattattgctggcggcgctctccagccagataacctttgataccgtacagaacggtgacatctacaccattacgccgcaggtgacgctcgcccagtcctgtgtctgccaggtgcagatcagcgccgtccgcaccggcaacggcggacaaagcacctcggtgcagcgtcataccgtcaccatcccggcgcatcagctcactgcgttatcccgtttacgtatgacgctttcaccgcaggataacgtctccattaccgtcaccgttaccgacgggcaatcactgcgcctgtcgcagcagtggggcgggacgagctgatctgctcctctttcagcaatgactggtaagacaatatccctgtcagcggtaaaacactgctgtacacttaccctgtgaacccggttaagagagacgatcatgcactcgcgtataaaggttattaagggtgacatcaccacgcaacaggtggatgtcatagtcaatgcggcaaatccctctttgatgggcggtggcggtgtggatggcgctatccatcgtgcggcggggccagctttacttgaggcctgtaaagtggtgcgtcagcagcagggcgagtgtccgcccggtcatgcggtgatcacccttgcaggggcgctaccggcaaaggcggtgatccataccgtcgggcccgtatggcatggcggcgatcaccatgaagcgcggctgctggaggatgcctatcgcaacagcctgaaactggcggaggccaatggttatcactcgatagcgtttccggctatcagtaccgggatatacggcttcccgaaagcggcggcagcagaaattgcggtcaatacagtttcggaatttctcacccgtcgcccttcgtttggcgaggtatactttgtctgttatgacgatgaaactacccgactttaccagcgcctccttacccaacagggagaaggaggcggcgaataatacacgactggggctggcaatagccccggtctgcgcggcccatccaggggagtgcggtttactggtgctggatgacagcctcgacgccttcgccgcccgctaccggctcgttgagatggccgaacagactctcgacattcagtattacatctgggaagacgacatgtcaggacggttgctgctgtccgtcatcctcgatgctgccagtcgcggcgtgaaggttcgcatgttgctggacgataacaataccgtcggcatggatgacacgctgcgcattctggacgcgcatcccaacgtcgagctgcgcttattcaatcccttttcttttcgcaccctgcgggcgctgggctatctcactgattttgcccgcctgaaccggcgtatgcataacaaaagcttcacggttgacggggtggtgacgctggtgggcggcagaaatatcggcgatgcctatttcggcgcgggggagcaaccgctgtttaccgatctggatgtgctggcgatagggccggtggtgaaagacgtcaccgacgattttgagcgttactggacctgtaaatcggtttccacgctacaggatgtgctggatatcgctgaagaggacatcgtccggcatatccgcatcccggaatcctggtacagcgatgtcaccgcgaaacgttacctgaacaaactggaatccacccgcttcgccacgctgctggaaaccaactcgctgccgatgatgtgggcgaaaacccgcctgctgagcgacgatccgcgtaaaggtcaggggcgggcgcgaaatcatacgctgttgccgcagcgcctcgtcaacgtgatgggcatgccggagcagcaaatcgacatctgttcggcctattttgtccccacgcgctccggtgtggcgcaattgctgcaactggtgcgcaagggcgtcaaaatcgccattcttaccaattcgctggccgccaatgatgtcgctgtggtgcatgccggttacgcccgctggcgcaaaaaattactgcgtcacggcgtggcgctgtatgaactgaaacccacccatgaagggggccgccatccccatgaccgcggcctgaccggtaactccggctccagtctgcatgccaaaaccttcagcattgacgagcgtaaggtctttatcggctcgttcaatttcgacccgcgctcggcgatgctgaatacggagatgggttttgttatcgacagcgaaccgctggcggcacgtatccaccagcgctttgtgcaaagccagcgggatgtggcctgggagctgcgtcttgaccgctgggggcgcattaactggatcgagcagaaagacgggcaggaaatcgttcataaaaaagagccgaaaacccgcttctggcagcgtatgctggtgcgctttgtctaccgtctgccggtagagtggctactctagaggacgagtagccacataggttatcaggcctggctttttaccggctgctgttgcggcttaccggagaacaggaaacgcaacagcggaatgcgcagatgcacttcatagaggatcagcgcgccgcccaccacaaacaccagtcccgtcaaaaagcccagcagattggagtgaatgtgcggggtgatccaggcgccataaaacagcgttaacggatggtgcaccagataaataaacagcgacgcattcacgaaataggtgacgcgggaggactggaaattcagcagacgatgtcccagcgaaaacaccacgttaaccatccacaggcccatcaccatcgtaatcacgctttccgtttcatacatccaggcatcgccgctgccataccgctgattgagcaggtaggcgcaaaacgccagcgtcgagcccagcagacaggcaggggagggggtggtaaacagatctttgagtcgtggacttataaaggtcagcgcgcccagcagaaagaacggcacgtaaaacagcgtctgcatgacggtgaaattaaacaggccatcgctgaggatcggcgaccaggcgatcaacagcgtgcggcgcagcgcggcatagagcacgccgagcagcaaaaacagcaacgtgagtttacccatgccgatgtcagtgaaaaatttaccgggtttgagacggcgctggatcacgccaaacagccagacgccaagggtggtcagcaccaccagcaccagcaggaaccacaggtgagaaaccagttcccagatcagggtgttgtatttgtcataggccgacagcgtatgccagctttccgttttacctttgacatgttgcagcatcataaactgcggcagggtgagcaacggaatggcggttaacatcggaatgccgacacgttcgacgcgcactttccaccagcgttttaccgggtaacgcagaaacagcatgtaggagaaatagccggagatgacaaaaaagacctgcatgcggaacgaatgaataaaatcattaaacagggtcaggccccaggacgggctggcgctgttaacgtgccagacatggctggagtaaataagtgagatatgaaaggggattcccagtaacatcaaccacgcgcggatggaatccagaaaatactcacgctgtgcagggattttgctcatataactccatgcagtatcagacttttcgccttattccataggctaaataaagggtacattcggtggcaaccctacactaagtcagacaatctgtctccaggataaacgcgtaattgataatggtggactttcatttgcttacacactgagccagcgcgcgaacaaagccgggattaagttgtcggaatgccagaacttccattaaaatggatggatcgatttaagcacacaaagggggaagtgcttagttatatgaaacataaacaacaagtgatgaaaatgcgttggttaggcgcagcggtactgttatccctgtactcctcatcgggctgggcttttaccctcgatgatgtagcaaaacaggcacagtcattagccggtaaaggctatgaagcccctaaaagcaacctgccttctgttttccgcgatatgaaatacgcggactatcagcagatccagttcaatcacgagaaagcttactggaataacgttaaaaccccattcaagctcgaattctatcatcagggtatgtacttcgacacgcctgtcaccgtcaatgaagtgacctcgaccgccgtgcgtaaaattaaatacagcccggattacttcaatttcggcaacgtccagcatgacaaggacaccgtcaaggatctgggatttgccggatttaaagtgctgtatcctatcaacagcaaagacaaaaacgacgaaatcgtcagtatgctgggcgcgagctatttccgcgttattggcgcgggtcagacttatggcctctcggcccgcggtctggctatcgataccgcgctgccgtctggcgaagagttcccgcgttttcgcgagttctggatcgagcgtccaaaaccgaccgacaaacgcctgaccatttatgcgctgctggactccccacgtgcggcgggcgcctaccgctttgtgatcattccgggtcgcgataccgtggttgacgtgcagtcaaaggtctatctgcgcgacaaagtgggtaaactgggcgttgccccgctgaccagtatgttcctgtttgggccgggtcaaccgtcgccgaccaccaacttccgtccggagctgcacgactctaacggtctgtcgattcatgccggcaacggcgaatggatctggcgtccgctgaacaacccgaaacatctggccgtcagcagctacgccatggaaaacccgcagggctttggcctgttgcagcgtggccgccagttctcccgcttcgaggatctggatgaccgctacgatctgcgtccaagcgcctgggtcactccgcagggcgactggggcaaaggcaaaatcgagctggttgaaatcccgaccaacgatgaaaccaacgataacatcgtcgcttactggacaccggatcagcttccggagccgggtaaagagatgaacttcaggtacagcatcacctttagccgcgacgaagacaaactgcatgcgccggataacgcctgggcgctgcaaacccgtcgttccaccggtgacgtgaagcaatctaaccttattcgtcagccggatggcaccatcgctttcgtggtggacttcgtcggccaggatatgaaaaaactgccgcaggacacgccggtgacggcgcaggccagcattggcgataacggcgaaatcgttgaacaagccgtgcgctataacccggtcacgcatggctggcgtttaaccctgcgcgtgaaggtgaaagatcctaaagcgacgaccgatatgcgtgctgcgctggtgaatggcgagcagccgctgagtgaaacctggagctatcagctacctgccaatgaataagactactgagtatatcgacgcgctgccgctttctgatattgagaaagcggcgctgccgaccacggacctgcgcgccgtgcacgaagcgctggatgctgagcaccgtcatttcgagcgggacgatgacaccccgctcggctcggtgcagacgcgtctgcaacaggtctggcccgagtccctcggcgaaggtcaactgatcaaagacgatgaaggacgtacccagcttgaggcgatgccgaaagccacgcgttcttccatgttccctgaacagtggcgtactaacccgattggtcgtttctgggatcgtctgcgtggccgcgatgtgccgccgcgctacctctcccgtctgaccaaagagcagcaggagagcgaaaagcagtggcgaatgatgggcacgatccgtcgctacattttactgctgctgacgatctcccagacggtggtcgccacctggtacatgaaaaccattctgccttatcagggctgggcgctgatcaacccgaccgatatggtaggccaggatctgctggtgtcagccatgcagctgctgccttacgtactgcaaaccggcattctgatcctgtttgccgtgctgttctgctgggtatcggctggtttctggaccgcgctgatgggcttcttacagctgctcatcggtaaagataaatacagcatttcgcactcgacggtcggggatgaaccccttaatccggaacaccgtaccgcgctgatcatgccgatctgtaacgaggacgtggatcgcgtatacgcgggcctgcgcgcgacctgggaatcggttaaagccaccggcaatgccgcgcattttgacgtctatatcctgagtgacagctacaacccggatatttgcgtcgccgagcagaaagcctggatggagctgatcgcggaagtgcagggcgaagggcagatcttctatcgtcgccgtcgccgccgcgtgaaacgtaaaagcggtaacatcgatgacttctgccgtcgctggggtaatcagtacagctatatggtggtgctggacgccgactccgtgatgaccggtgactgtctgagcggtctggtgcgtctgatggaagccaatcctaacgccggtattatccagtcttcgccaaaagcgtcgggcatggatacgctctatgcgcgctgccagcagttcgccacccgcgtgtacggtccactgtttaccgccgggctgcacttctggcaactgggtgaatcccactactgggggcacaacgccattatccgcgtgaagccgttcattgagcactgtgcgctggcgccgctgccgggtgaaggctcctttgcaggttctattctttctcacgactttgtggaagccgcgctgatgcgccgtgcgggctggggggtgtggatagcctacgatctgccaggctcttatgaagagctgccgccgaacctgctggatgaactcaagcgtgaccgtcgctggtgccacggcaacctgatgaacttccgtctgttcctggtgaaagggatgcatccggtacaccgcgcggtgttcctgaccggcgtgatgtcctatctgtcggcaccgctgtggtttatgttccttgcgctctcaaccgctttacaggtggtgcatgcgctgaccgaaccgcaatacttcctgcaaccgcgtcagctgttcccggtgtggccgcagtggcgtccggagctggcgatcgcgctctttgcgtccaccatggtgctgctgttcctgccgaagctgctaagtatcattctggtgtggtgtaaagggccgaaagagtacggcggtttcctgcgcgtgaccctgtcgctgctgctggaagtgctgttctccgtgctgctcgcgccggtgcgtatgctgttccacacggtgtttgtggtcagcgccttcctcggctgggaagtggtgtggaactcgccacagcgcgacgacgactccaccccatggggtgaagcctttatgcgtcatggctcgcagctgctgctgggcctggtatgggccgccggtatggcgtggctggatctgcgcttcctgttctggctggcgcctatcgttttctcgctgatcctgtcgccgttcgtgtcggtgatctcgagccgtgccactgtcggtctgcgtaccaagcgctggaaactgttccttatcccggaagagtattccccgccgcaggtgctggtggataccgacaaatatctgaccatcaaccgcgcccgcgcgctggacgacggctttatgcacgcggtgtttaacccgtcatttaacgctcttgccaccgccatggccactgcccgtcaccgtgcaagccaggtgctggaaatcgcccgcgatcgtcatgttgagcaggcgctgaacgaaacgccggataaactgacgcgcgatcgtcggctggtgttgctgagcgacccggtcaccctgtcacgtatgcattaccgcgtgtgggcagccccggagcgttactcgtcgtggatcagccattacgaggcgctgcggttgaacccgcaggcgctcaacggtaagtaagccgcacattaaggaaaataccggcccgcaggccggtatttttttgtctgaatgaataaggagggaggcgtgaaaattttcgctgtcgccattatggcgctgttgctgagcggttgcggcagcattatcagtcgtaccctgccggggcagggtcacggtaaccagtactaccccggcgtgcaatgggacgttcgcgattcaggctggcggtaccttacggtgctcgatctaccgttctcgctggtattcgacacgctgttgctgccgctggatgcgcatcacggcccttatgaataatcagcgctgatcccactcgtcggctgccgcgcggccttcctcggtgtccagcggcggctcaagctgatattcgccttcgtcccactcatgcagggtgttttcttccagccactcctgacggatctcgatctcatcgaaatcacggtcaaacacgctctgcgcggcttcaccggtaagcatcggcagacattcaccgtcatcgctctcttcagctaaaaactctgcctgccacatgatctcaccatcctgaagcacatacttctggatgttaaactgctgtatgttggcgttttcttcatccagttccggattcgccgccagaaactcctcacgtgcagcatcaatggcttcttccagcgtggcatacatagtcattgtcttctccctgtaattggatgtgatgttcagggaaagaatagttgaagatcggaaagtgcaagggcgatcaggcaaaattaagcatcatcacatcgccgtagcttcccgacgacgccgccgcaggctcagccaggagtagatcacgttgaacatcaccaccgaggcggtgaccagaaataccgtgcggaagccatagctggccgagaccgccgcgccaagcagcgggccggtgacgttaccgatatcgcggaacgactggttatagctgaagatgcgcccggcaatctgattggttgagttatagaccagcagcgtctgtacggctggcagcagcgcaccgtccgccgcgccaagcagaaaacgtaatatgcccagctgaaccggcgtctgcacaaaggacatcgggatcagcagcaaaatcgacaccatcagcgcggcgataaggattttttccggcccgatgcgatctcccagtttacccagccggggggcgctgagcagagccgcgacgccgggcaccgaggcgatcatgccgctgataaaggcgatgttgctgacgtcccccgccagatcgcgcacgtacagcgtcaggatgggcgcaatggagccggtggcaacctggataatcatggtggtgacaaacaggctcagcaccagtctggggcttttcagcgaaccaatgacttcacgcgcgtgcagcatctctttcttcgccaccggcgtgaagttttcgcggatgcaaaacagcgtcagtaaaaagcagatgaacagcacggcggcggtgatgaaaaacaccgggcgcaaaccgtagctatccgccagcagtccgcccgccagcgggcctaacagcgccccgctgacgccaccggttgatagtgtgcccagcgcccagccgcttttattgcgcggcatttgcgtggcgatcagcgcattggcgttagggataaatccgcccagcagaccgagacaggcgcgtagcgccagcagttgccagatattctgcgccagccccatcagcatcattaccaccgccatgccgagggccgagcgcagcagcatcagtttgcggcctttacgatccgccagaccgccccacagcggggaagcgacagctgagaaaagaaaggtgatgctgaacaccagaccggaccacatattgagcgcgctgtggccgctgacgcccagctgctctatgtagagcggcagaaaaggcatcacaaggctgaaggccgcgccggtgagaaagcagccgatccaggcaatggcaagattccgtttccagttaaggggcgtcgctgagggtgacataaccgtccggttgcaggcgttaacaggtttaaatagtaagcctgctaatcatacgcctggggagaaggggccgcaaaccggagagcgcttaaagcttaaagcgggggggggggagagaagttgccgggtggcgctgccgcttccccggcttacagatgaatgctaataacgggaaggaacgccttccggacgggtcttgaagcgacgatgcagccacatgtactgctccggggccatcatgatgcatttttcgatcacgccgttcatccaggcggcggtggtttcggcgtcatccagcggcggatcgttttgcggatccagcatcaccagttcgtagcccttaccgccgggtttacggcgcggcacaaagggaacgatgctcgcctgggacattctcgccagcatccaggtgccggaagtggtcgcggcctggtctacggcgaaaaagggcacgaacacgctggcgcgcgggccatagtcgtgatccggcgcgtaccacaccacttcgccgtttttcagcgcccgcaccatgcctttcaaatccttgcggtcgagcatggttttattggagcgcaggcgtccccaggtttgcagcaggtcgattaccgggttgtcattcgggcgataaaccccgatccccggcgtctgcataccaaacatacgtgcgcccagttcgagggtcagaaaatgcaccccgatcagcagaatgccgcgtttctgacgttgcagttcatagaccggctcaaagttgatgatgtccgcccagcgggcgatacgtttgtccgaccagaaccaggccatgccggtttcaaacaggcccatgcccaccgactcaaaattcttcaccaccatgtcgtggcgcgccgcctgactcatttccgggaagcaaagctccaggttacgggtagcgacatgcacacgacgcttcatcaggcgcatcgccagatggccaagacctgtacccatccgataaatcaccgggtaagggagctgaaccagcagccacagcaaaccaataccaaaccaggttaaccagtagcgcggatgaagtaaggcggtggaaaatttgggtagatgtgtcatgtcattcctgtgattcgacaagccgtgcgttaatgccttcgcactaagataaattcaccgacgtttatggcggagaaatcgttctttccagagcctcgttgcctggtattttttctggtgagtgaaatgtagcgcaaaatgtatggatgtaaattaacagtatttgctatatgatgctgcccgtttttcacccatctctcgttattgcaggataagtacaccatgccagtgttacacaaccgcatttcgaatgaggagctgaaggcgcgtatgctggcggaagccgagccgcgcaccacggtctcattctataagtatttcactatctccgatccgaaagccacgcgcgatgccctctatcaggcattaacggcgttaaatgttttcgggcgcatttatttagcacatgaaggcatcaatgcgcaaatcagcgtgccgcaaagtcagtttgatgcgctgcgtgactgcctctatgcctttgatccggcgctggatggtctgcgactgaacgtcgcgctggatgatgacggaaaatctttctgggtgctgcgcatgaaagtgcgcgaccgtatcgtcgccgatggcattgaagatgagacgtttgatgccagcaatgttggggattatctgaaggcggcggaagtaaacgccatgctggacgatcctgacgcggtatttattgatatgcgcaaccactacgaatacgaagtggggcattttgaagatgcgctcgaaattccggcggacacgttccgcgaacagttgccgaaagccgttgagatgatgcaggagcacaaagacaagaaaattgttatgtactgtaccggcggcattcgctgcgaaaaagccagcgcctggatgaagcataacggtttcaacaaagtctggcatatcgaaggcggcattatcgagtacgcccgtcgcgcccgcgagcagggactgccggtgcgctttatcggtaaaaactttgtctttgatgaacgcatgggcgagcgtatttccgacgatgtgatcgctcagtgtcatcagtgcggcgcgccgtgcgacagccataccaactgtctgaatgacggttgtcatctgctgtttattcagtgtccggcctgtgccgagaagttcagcggctgttgcagtgtgttgtgtcaggaggagcgggcgctgccggaagaagaacagcgtcgccgtcgggctggtcgtgaaaacggcaataaaatcttcaacaaatcccgtggtcgtctgaatacccagcttgggatccccgatccggaataaattgttgccgggtgacgcagctgcgcacccggcaatcattctgcattacttcttacgcacgccttccaccgaaataatcagatccacatcctgagacgccggaccgagatcggtagtgatgttgtaatctttcagcttgattttacccgccgcttcaaagcccgcgcgtacgccgccccagggatcatcgccctgaccgatcagtttcgctttcagcgtgacaggtttggtgacgccgttcagcgtcagatcaccggtaatatccagcgcatcgccgtctttcttcactgcggttgacgcaaaggtcgcctgcgggaatttcgccacgttcaggaactcggcgctgcgcaggtgcttatcacgctcggcatggttagtgtccacgcttttggtattgatggtgacgttcactttatccgccgccgggtttttctcatcgaaggtgaaggtgccgtcaaaatctttaaacgtaccgtacagccagctgtagcccaggtgctgaatacggaagttaacgaaggcgtgctggccctctttgtcaattttataatctgctgccacggcagagccggtagtgaacagcagggcgctcagggcgagggcggtaatacttttcttcatcgtcatactccggagtcaggggatgatttacccagcatgcgcttgagggtgtcatctttatcaatgaaatggtgcttgagagcggcaagcgcatgcagcgcggagaagatcaccacgccccaggccagccatagatggatttcacctgccagatccgcctgaaccccggcgtcggcaaaggtggcggggatctcgaaccagccgaaaacgctgatgggttttccgtcggcggtggagatcaggtaaccgctgaacacaatggcgaacagcagggcatagagggcgacatgtccggccacggcggccagacgggtggtgcgcgaccaggatttcagcgccgcaggcggcggcgagatccagcgccacagcagacgcaccaccagccccatcatcagcagaatgccgatgcttttgtgcagttcaggtgcctggtgataccagccgtcataatagctgagcgtcaccatccataatcccagggcaaacatgccatacaccaccagcgccatcacccagtggagtgtcatcgacagcacgccgtaacggcggggagaattacgccattgcatataaatgtccgttttaaataacaaggtgaaagtaaaatggcgcggcgaaaataatattgcaacttataaataacaaaaataaacaatatttttacttattcatttttattgatggattgatggctttggcattcaatgatttcgttataaatcgcggtccggagtggtggcgggcgctacaacagggggttataagttataaccctcattcaaaaatactgggcagaaaagcgcggatcttcaggaaatgtcaatttttgtcaggggattaatcaatataaaagagatagataatatccagtatgcccagcaccagccagaaaatgagatagagcataaaatgctcgcggatattattcataaaaaattcaaatatacgacgcatcgcgttacctgggttcagataatgaaaacaggcccgacgggcgggcctgcggtatcaggatttatcgaaacggctaagggcgaagggcgtcagatcaaaagatggcgtctgcccggcggcaaaacgggcggcaatttcacccagcaccggcgcgaacttgaagccatgcccgctcagtccgctgaccagcagcgtgttgtcatggcccggcagggtgtcgatgataaagtcctcgtccggggaattatcataggtgcaggccgcgccgtgcagacagcagccaatgcccggcaggaactgacgcaggaaaggaaaggcttccgaaccatcggtagccacgctgccaaagggcgtgcgctcctcttctgaagaaataatctgtccgccgttatgcctgccgattttcagcgcgtcatcctcagccggaaaaccgtagaactgatcgccggagggcatctcgccggtaaaggccgggaagttgtttttggcgctgtaacggccatcggcctgataccaggcgaaaatcttgcgtaccggctgcaccggcagggaggggagcagccgcgtgacccaggtgccggcgctcaccagcagcttcgcgccgctgtactgaccgtcggcggtgtcaatggtgacgccgtcatcatgatgatggatagcggtaaccgggcagttaaacagctgggcgcagcccgcttcacgggcgaggcggatccaggttttcaccgccagttcgctgcgcagaaagccggactgtgactcaaacagaccgatatacccttcagggacgcggatctccggccagcgcgccatcagcgctgccgcatcgaggcgttcgacgtcaagattaaattcacgggcgctttgcgccacgtttgcgaggaaagcggaatccgcaggacccaggttgatgacgccggtgcgttcaaagaccgcttcaccgctgtcagcggcaagctcatcccacaggctctgggcgcgcagcaccagcggaacatatttctcgccttcaccataggcgtggcggataaggcgggtgtcaccatgatggctgccgtgctgatgaggcggcagccaggcgtcggtcatcaggacattcagcccggcgcgtgtggcatagtagcctgccgcagcccctacagagccgctgccgacgataatcaggtcatatttcattacgctctcctggcaaattcttcaggcaggagagtaattaacctgtatgggatatacaagccagaaataaatcaggcacccgaatgggtgcctggaggacagaagatactcacgatctagtgtctgcgatactcatctgcctgatagtcaccggattcgatcttggcgatccctgcttccagaatcgaaataaactgacgggcaacttcagtggtgagccacagcgtctggccgacctcagtgtcatcacggtcgggctggcttggggtctgatagtgcaaacgcagcatcatggcatcgtaactgtctacggtgctgatgtcccaccctacgagcggatgagtttgaatgacttcattatttttaaccatttcaacccccatttgcgtacgtgaatacaacgattattgaggttcaatgcgtgtttttctgaagcagcttaagtatatcaataattaacgtgaatgcgttaattattagaactatcggcaattccgtctttttatttaaatttttttgaaagaaacgggcaggagatacgggctgtttttcaccatcctctgatttcaataaggaaatggcggaaaaaaatgcaaaaaagccggggcgacccggcaagaagaacaatgagggtactgcttagtgaggttgtagtttaatcctgtctgaaccagtcatcggcgctttcccaggtttcctggagaatttcgctgacgcggtctttatcttctttcgccgcgccgaacaccgtcaggctgttggcggcggcgaaacgtactgaaactttgccttcgctgtgcggatagtcgtcacagacgcggcgggagagttcctgagccagcgcatcaatagcgcccggcggtaaggcggtggttctggcgatagtcacttcgatacgcatagtagccccctgtataatttactggttatttatacagtcattaccctgcatttacaacagggggcagcgaatttttaacgcttcacgcgccagcgcacggtttctccggcgaggaagggcaccagggtgtcgtcggtaagggcaatgctttccggcacctgctcctcctgacgctccagctccacaaaactctcattgaccggcaggccgtaaaaacgcggaccattcagcgagcagaaggcttcgaagtgcgcaagcgcccccatctcctcaaacaccgtggcatagcttgccagcgccgtcggcgcgttaaagcagcccgcacagccacagcttgcttctttacgatgacgggcatggggggcagagtcggtgccaaggaaagcgcgcgtaaaaccgctggcgaccagttcacgcagcgcctgctggtggatattacgctttaggatcggcaggcagtacaggtgcgggcgcacgccgcccaccagcatatggttgcggttaaacatcaaatgctgtggcgtgatggtggcggccagcagctcattgccgtcgcgcacatagtcggcggcatctttggtggtgatgtgttcaaacaccactttcagacccggcagacgctgacgcagcggctccatcacggtgtcgataaagcgcgcttcccgatcaaaaatatcaatatccgcgtgcgtgacttcaccgtgcaccagcagcggcatgcccagtttttccatgcgcgtcagcaccggcataatggcgtcaatgctggtcacgccgtggctggagttggtggtggcgttagccgggtaaagcttggcggcggtaaacaccttttcgttaaagccgcgttcgatttcgtccggatccagcgtatcggtcagatagcaggtcattaatggcgtgaaatcatgtccggcggggacggcgtcgagaatgcgctggcgataggcgatggcggcatcaacggtagtgatgggcggcaccaggttcggcatgatgatcgcccggccatacagctcactggtgtagggcacgaccgttttcagcatatcgccgtcacgaagatgaatgtgccagtcgtctgggcggcggattttcaaaacctggggttgtgctgtcatgagtgcgctccggcttgcgtggtaatcagtcagtgatggctggttttatgccgggcacaaaggataggcgtaaacgttttcgtttgcatcccttttccgcacaggacgcataaaaaagggcgcctggcgcccctgggttagtcagtaaaagggatgacgatttcgccgggtttgacttcaagccctttcgcgaatttcttcgccagcgcttccccctggctgctatcttccctcagcacataggcgggttgctggttaaagtagttacgcagcgactggttaagatagggcatcagcgtctgaatgacgctctgcattttctgcggcgtgacggtggcatccaccacttccatctcctgcaggtagatttcgcctttctctttattgaaaaccggcagcgctttcagcttcagcgcaatggtggccttctggctgccgaaaagggaattcatatccagattcgcatcgccggtaagggtgactttattgggctcttcgcggccaatcgcgctgctcagattacgcagcacaatgtgcgcgtccgccacgcccggcacgccaatatcgcgggagaaatcgttacgtttttgcagcgcctgattaatttcctgctcacttacggtgtactgggttaacggattacacccggcgagtaaaccactcacaatcagcgtggcggctaagactatcttcttcatcggtttcctcaacatgacacctttatgccaatcgtgacataaaggagcatcccgcaccagtgcggcacatgccagcagaaaacaccgaaaagcatgacgggcgctttcgcacccgtcccgttacgctcagattgccatggatgagagcagattaatctgcgtctgtttggccatattgtcgcggtaatccgccacgcgggtcggccaggtgatgcctgacaccagcgtcaggttacgcagcagcgggaagagatgaatgtcatcctcagagagttcgccattaacggcgttaggcttgacgatgagcttatccagcgcccgcaggtcgtcgctgatgttcttaaccagcccggcggagtgggcgaggtgctccgcaaaatcgccgatagccgcctcctttttcgccacaaaatacgcgcgcgcttccggcgtggcgaactcatcaaagggggatttggcaaagcgcgggatcagcaggcgattcacatagccattcaccttgcgcagccagtcggcaatggccggattctgcgcgccagtgagcagcggctggtggtcaagctgatcaacatagtggacgatatccatgctttccgggagatagcggctgtcgtccttttgcaggatcggcgccatcttctgaccaatcatacgcaccggcgtggcttcgtcatcattgagtaacacgttcagttcgacggggagattcttcaggccgaaaatcatgcgggctttaagacagaacggacagtgatcgtagatatagagcttcacgtttctcctccagatgattgtggttctcactttcagtatggaagagaaaaatgcggctttcaaatcagatgcctggctccggcacctctgtgcgggcgcttttctggctgaactgccaccacaaggcaacaaaggtggcaagaccgattagccccagcatcagccagggcagctccggttgcgccgacagttttccggcgtcaaacagccagccgccgcccgcgtaacccagcgcaccgccaaaagccagccccagtcgactaaagcccatatagctgccccgcgcacgggcgtcagccagatccgcccccagggtttcccgcgccggttcggcgataatcgcgccgagataaaacagacaaatcagcataaacagctgttgcagcgagccgaccatacctaccggcaacaggctgagcgacatcagcagcagcccggccatcaggcgatgctcaaggcgaaaacgcttctcgctccagcgggcgatgggatagagcagggtcagcgacaggcaggcttcaatggcgtacatccatttcaccgcggcaggggatccggcgatatcgttgaccataatcggcagcatcagcatcacctggaccgccagcatgtaataaccggtcagcgtcagcacgtaggtcacaaagcgtttatcgcgcagcacccgctgtagcccttcgcgcaccggcgttttcaccgtcgacagcttccacgccggtaacagccaggcgttaaagcccgcgcagaggataaacagcaccgcgccggtggcgcacaccaggcgaaaatcgtactgcaacagccagcttcccagcagcgcgccaatcaccgccccggcgctgtcctgcatcatcagcagcgagaaaaagcggccgcgctgccggggacgcaccagtttgaccaccagcgccgagcgcggcggatcgaacagcgttccgccaagcccggaaagaatgcaggaaaaccacagcagccagggttcatgcgccaccgccatggcggcaaatccggcggcgcgcagcagcataccggtgacgatcatcggcttggcgccaaagcgatccgccaccgcgccgccgaaaatccccagcccctgctggacaaactgacgcaggccgagggcaataccaaccatcagcgccgcccagccaagctgatcgacaaaacgaatagagataagcgggaagacgacaaagaagcccagcaccaccagcatattgtcgattagcaggaaatatttacccatgctccgtgcctgcgatacgcgggacatctcccctccggggaacaaaaaatcacccgcttattctgcggggtggcgcagcattttcccacccgccgcagcgacaatattttttcatcaaaccaccgctttgattgatgaccttcatcgaaactccattccggcgcagaaaatggtatgttgctgttttcacagaccggcattgcgcaggtatagttaaggaaaaggggtaacaagacgtgagcggaaggagtggttattgatgtttggctatcgcagtaacgtacctaaagcacgcctgaccaccgatcgcctggtagtgcgtctggtgcatgagcgtgatgcctggcggctggccgattattacgcagaaaatcgccagtttctgaaaccctgggagccgatccgcgatgacagccattgttatccttccggctggcaggcccgcctcggcatgatcaacgaattccataaacagggcagcgctttttactttgcgctgctcgatcccgaagaaaaagagatcatcggcgtggcgaacttttccaacgtcgtacgcggatcctttcacgcctgctacctcggctactctattggtcagaaatggcaggggcaggggttaatgtttgaagccttaagcgcggcgatccgctatatgcagcgcacgcagcatatgcaccgcatcatggccaattatatgccgcacaataaacgcagcggcgatttgctggcgcgtctcggttttgaaaaggaaggctacgccaaagcctatctgctgattgacggccagtggcgcgatcacgtgctgacggcgttaacggccaccgactggaccgcagggcgttgacgattatgcatcatctgctgaacaacgaggccgctttagcctccgtatccattactcacacagacgggagaatgaagtgagccgattacgaattggtgtggtagggcttggcggcatcgcgcaaaaagcctggctgccggtgctggcggcggcaacggactggacgttacaggcggcctggtcgccgacgcgggaaaaagcgctgccggtatgtgaaagctggcgtctgccctatgccgactcgctggcgcatcttgccagccagtgcgatgcggtctttgtgcatacctcgaccgcttcacattatgcagtggtcagcgagctgttaaatgccggggtgcacgtctgcgtcgataagccgctggcggataatctggcggatgccgagcggctggtggagctggcggcgcgcaaaaagctgacgctgatggtcggttttaaccgccgctttgcgcccctgtaccgcgatctgaaaacccggctcgaaaaaggggcgtcgctgcgcatggataagcatcgcagcgacagcgtcggcccgcacgatctgcgttttacgctgcttgatgactatctgcatgtggtggacaccgccctctggctggcaggcggcccggcgcagttgcagggcggcgtgctgcacaccaatgacgaagggcagatgtgctacgccgaacatcacttcagcagcgatctgttgcagatcaccaccagcatgcatcgccgcgccggcagtcagcgcgagtgggtacaggcggtgaccgacggcggcctgtatgacgtcaccgatatgcgcgactggcgggaggagcgcgggcagggggtgatccttcgtccggtgcccggctggcagagcacgcttgagcagcgcggatttgtgggctgcgcccgtcatttcatcgaatgcgtgcaaaatcagacggttcccgaaaccgccggtgaacaggctgtgctggcgcagcgcgtgattgaaaaactctggcgcgaggcgatgacggagtaaccgcccgtaacataagccggtagtatttcaccgcaatccaggtagactacccgccataccccccgacgcctgctctgcaggcgttttgccgtcaggttgtggacgaacaacgtaatgaatttattaaaatcgctggccgcagtcagctcgatgaccatgttttcccgtgtactgggatttgcgcgggatgccattgtggcgcgtgtttttggggccgggatggccaccgatgccttttttgtggcgttcaaattacctaacctgctgcggcgtattttcgccgaaggggcgttctcgcaggcctttgtgccgatcctcgcggaatacaaaagcaagcagggcgacgacgccacccgcgtgtttgtctcctatgtgtccggtctgctgacgctggcgctggcggtggtgaccgtgctggggatgctggccgcgccctgggtgatcatggtgacggcgcctggctttgccgataccgccgacaaattcgccctgacatcaaaactgctgactattacctttccgtatatcctgctgatctcgctggcctcgctggcgggggcgatcctcaatacctggaaccgtttttcggtaccggcgttcgcgcccacttttttaaacgtcagcatgattggcttcgcgctctttgccgcgccttactttaacccgccggtgctggcgctggcgtgggccgtcaccgtgggcggcgtgctgcaactggtctatcagctgccgcacctgaagaaaatcggcatgctggtgctgccgcgcatcaatctgcgcgacgccggggcgatgcgggtggtgaaacagatgggcccggctattctgggcgtgtcggtaagccagatttcgctgatcatcaacactattttcgcctcctttctggtttccggttctgtctcctggatgtactacgctgaccgcctgatggagtttccctccggcgtgctgggcgtggcgctgggcaccattctgctgccgtcgctgtcgagaagttttgccagcggcaatcaggacgaatactgccgcctgatggactgggggctgcgtctgtgtttcctgctggcgctgccgagcgcggtggcgctgggtattctggcgaaacccctcaccgtgtcgttatttcagtacggtaaatttaatgccttcgatgcgctgatgacccagcgtgcgctggtggcctattcggtggggctgatcgggcttatcgtggtgaaagttttggcgccgggcttctactcccgccaggacatcaaaacgccggtgaaaatcgctatcgtcacgctgatcatgacccaggtgatgaacctgatattcatcggcccgctgaagcacgccgggctgtcgctgtcgattggtctgggtgcctgtctgaatgcttccctgctgtactggcagctgcgtaagcagaacatctttacgccgcagccgggctgggcgcgctttctgctgcgtctgattgttgcggttgcggtgatgtccgccgcgctggtgggcatgatgatggtgatgccggagtggtcgcagggcaccatggcctggcgtctgctgcgcctgatggcggtggtggtagtgggcgtgatcgcctatttcgccaccctggcggcgctgggattcaaagtgaaagagtttgcgcgtaagacggtataaaaacagcaacagggagtcaaatgactccctgtctgtaactggtaacgcgtacggtcacgatcagatggagattttcttgccgccgcgcgtggtcgaggacgtctgtccgttggccccgtataaccctggctcctgatgcggtttcagcacctcaagcgcttgctggttacggataatctggccttcaagcaaccagccgttgtgctggttaagatcgcgtaaatgctgtgtcttggcggtaatggactgccagcgttctgcaacatcatcattggaagcgcgtctggcgttctgctccgcgcgtcgctgttgctccagatagtccagcgtagcgagcaacgagctcttttcttccgtaatgcgctgcagggcgctgccattgaagtggcctgcggaaagttgctgttgctcagcatccatcacgactttcaggtcgttcaggataactgtcatcttatccagtatttctgacagttgattcatacgcttatttactctgtaagaaactctgtgcttcctgaatcagtgcatcggcgattttgccggtgtccattttcagttcgccgttgcggatcgcggccttcaggctttctacgcgctcaacattaatatcgtcgtcaccggactggaccagacgggactgggcattgctgatggtaacgttagtgctgttagcagtaaccggtttttccaggcgcgttttggttgcctgagtttcgttgctttcgcgctgttgaacagtgttgaccggcttcaggggcgatgtacgttcaatgctcatagtgtggtcctcatcgaggttttgcggcgcagacgcctgccattcatcatatgttgattatttatcggcagatgccgcaaattctttaaagaattatagattaataagaatattcccatcaggaccgaccatcccgctcaccacctggcctgacgccatgcgaacccgggcgttttgcgccacggcagcgttattcatcgcctggccttcgccgttaacgctaaagccgtcgccctgtgcgataacctgcactttctgaccagctttgatacgccaggcctggcgcagcatcgacagctggatcgcctgaccgggggcgacgtcgcgtaaacttaccgcatcctgcgcctgattgatatccagcatggtacgcggcggcagttgatcgagacgaccacgggtgagggtgacgctccccggttgcagcgtactgccacgggttatcggctgcgcggcgacgacataattgcccgtggcctgcacctgcacctgaacgtaacgtttttcattggcgcactgcgccagcacgttcacattcccccagagtttagcacttcccgccacgctgagcgccggttgttcgcaggcgggcagcagatttggcgcgctgcgcacctttaccaccacctcatcgctgaagcctgccagccgctgggcaaaaaacgccgtcagctgcgcattgagatccgccgccagcagcgacgcgctaaaaaacagtaaggtcgcggctaaaccgcctttcagggtgttcatcgcagactcctgcctgtttaaagaatgccgagattctacccgcacaataaatctatcaacgcaataaatagcgacgcattttgcgcttattcagacgatgacgcatggacaacgccatttaagctgtcacctgtcaatttatcatcagcgtaatgtcatcagcgggggagacatgctcgataaactcgatgccgcgctacgttttcagcaggaagcgttaaatctgcgcgcgcagcgccaggaagtgctggcggccaatattgccaacgccgataccccggggtatcaggcacgcgatatggatttcagcagtgaactcaaaaaggtgatggagcgcggtcgtgctgaaaatagcggtgtagccttgcagctgacctctgcccgtcatattccggcgcaggcaatgaccgcgccgtctgccgatctgctgtaccgcattccggaccagccttcgatggatggtaataccgtcgatatggatcgcgaacgtacacaattcgccgataacaccctgaaataccagaccggtctgaccgtactgggtgggcagatcaaaggcatgatgagcgtattgcagggggggaattaacagatggcattactgaacatttttgatatcgccggttccgcgatgaccgcccagtccaagcgtctgaacgtggcggccagtaacctggccaacgccgacagtgtcaccggaccggatggccagccttatcgcgcaaaacaggtggtatttcaggtagacgctgcgccaggcgcggcgaccggcggggtgaaggtctctgaagtgatcgaaagtcaggccccggacaaactggtgtacgaaccgggtaacccgcttgccgatgcaaaagggtatgtgcgtatgccgaacgtcgatgtggtgggcgaaatggtcaactccatgtccgcctcccgcagctaccaggcaaacgttgaagtgcttaacaccgtcaagagcctgatgctcaagaccctgaccctcggccagtaaaggaacaaggcatgtctatttccgttaacgttaatgacactaccgccgccgccggtacttccgccgccacgggcaacagctcgctgaccggcagtaaagcagaagatttacagggcagctttttaacgctcttggtcgcacagctgaaaaaccaggatccgaccaatccgatgcagaacaacgaactgaccacacagctggcgcaaatcagcaccgtgagcggcattgaaaagctgaacaccacgctcggctctatctccggtcagcttaataacaacgcctcgttgcaggccagcacgctgattgggcatggcgtgatgatccccggcactacgatactggcgggtaaagaaaccaccacgccgtttggcgttgaactccagcaggccgccgataaagtcactgccaccattaccgataaagccggtgtggtggtgcgcaccatcgacattggcgcgctgaaagcgggcgtccatagcttcaactgggacggcaccctggcggacggcacggcagcgccggacggttcctataacgtggcgattaacgccagcaacggcaccactcagctggttgcccaaccgctacagtttgcgctggtgcagggtgttacccgcggcagcaacggcaacttgttagatttgggtacctacggtaccaccaccctcgacgaagtacggcagattatctaagccttcatttatcaggagtaagtcatggccttttcacaagcggtcagcggcctgaatgctgcggccaccaacctcgatgtcatcggtaacaacatcgccaactccgccacttacggctttaaatctggcagtgcgtccttcgctgacatgtttgctggttctaaagtcggtctgggcgtaaaagttgcgggtatcactcaggactttaacgacggcaccaccaccaataccggtcgtggcctggacgtggcaatcagccagaacggtttcttccgtctggtcgacaacaacggttctgtttattacagccgtaacggtcagttcaaactggattccgaccgtaacatcgttaacatgcagggtctccaactgaccggctatccggcaacaggtacgccgccgaccatccagcagggcgcgaacccgaccgccatctccgtgccaaacacgctgatgtcggcgaaaaccaccaccactgcggcgatgcagatcaacctgaactcgtctgacaaactgccgaccattgccacctttgatccgaccaacgcggactcttacaacaagaaagggtcggtgacggtatatgatacccagggtaacgcccatgacatgaacgtttactatgtcaaaacggcaaacaaccagtgggatgtgtggacccaggattccagcgtcacaggcgcaacgccggtgaaatctgcccagatggcctttgacaccaacggtaatctggacgaagtgcgtaactacacgctgaacaccaccaccacccctgcaagctgggatctggccgctacgccgaatgcacagccgcaggtcaatatcgtcacgggcgcactgaacggcgcgatcccggcgaccttctcgctgagctggctcggctccatgcagcagaacaccggttctaacaacatcgtggcgaccagccagaacggttacaagccgggcgacctggtgagctaccagatcaacgatgatggcaccgtggtgggtaactactccaacgaacagacccagctgttaggtcagatcgtgctggcaaacttcgccaacaacgaaggtctgcaatccgaaggcgataacgtctggtccgcctccggcgcatccggtgtggcgctgctgggtaccgcgggtaccggtaacttcggttcgctgaccaacggcgcgctggagtcgtcgaacgttgatctgagtaaagagctggtgaacatgatcgtcgcgcagcgtaactaccagtcgaacgcgcagaccatcaaaactcaggatcagatcctcaacacgctggttaacctgcgctaatcgtctgacgggatggcttcatggatcacgcaatatataccgcgatgggcgcggcaagtcagacgctcaatcagcagtctgttaccgccagcaacctcgcgaacgcgtcaacacccggttttcgcgcccagctgaatgcgctgcgtgcggtacccgttgaaggattgtcactgccgacgcgtacgctggtgacggcgtccacgcccggcgcggatatgacgcagggtcaaatggactacacgtcgcgtccgctggatgtggcgttgcagcaggatggctggctggcggtacaggcgccggatggcaccgaagcttatacccgcaacggtaacatccaggttaacccggcaggtcagctgactattcagggtaatccggtaatgggcgacggcggcccgatcgccgtgccggaaggcgcggagatcaccatcgctgccgacggtaccgtgtcggcgcttaccccaggggatccgccgaataccgtgtcgcctgttggccgtctgaagctggtcaaagcggaaggcagcgaagtggtgcgcggcgacgacggcatgttccgtttaagccaggccgcgcaggcgacccgtggcgcgaccttacaggccgatccgaccatccgcgtgatgtccggcgtgctggaaggcagtaacgtgaagccggtagccgcgatgaccgacatgattgccagtgcgcgtcgttttgagatgcaaatgaaggtgatcagcagcgttgacgaaaacgaccagcgcgccaactcgctgctgtcaatgagctaataaacaggaacacccatgatcaactcattatggattgccaagaccggccttgatgcccagcaaaccaatatggacgttatcgccaacaacctggcgaacgtcagcaccaacggttttaagcgtcagcgtgcggtctttgaagacctgctctaccagaccatccgtcagccgggggcgcagtcctccgagcagacgacgctgccgtcaggcttacagatcggtaccggcgttcgtccggtcgccactgaacgcctgcacagccagggtaacctgtcgcagaccaataacagtaaagacgtggccatcaaaggccagggtttcttccaggtgatgctgccggacggtaccgctgcctatacgcgcgatggctcgttccaggtcgatcagaatggtcagttagtgacggccggtggtttccaggtgcagcctgcgatcaccattccggcgaactcgctgagcatcactatcggtcgtgacggtgtggtgagcgtgacccagcagggtcaggccgcgccggtgcaggtcggccagctcaacctgacgacctttatgaacgacaccggtctggaaagtattggtgagaacctctacaccgaaacccagtcttccggcgcgccaaatgacaccacgccaggcctgaacggcgcgggtctgctgtatcagggttatgtggaaacctctaacgtcaacgtggcggaagagctggtaaacatgatccaggttcagcgcgcgtatgaaattaacagtaaagcggtatcgacgaccgatcagatgctgcagaaactgacgcaactctaaggcgtgatccggtgcgctaaccccgcaccggcaccctgtttttgaagatgaaagcaatgtacaaaaccgccgcgtttcgttatccgcttctggctctgctggcaacctcccttaccggatgtgccttgatcccttcgacaccgctggtgcaaggggcgaccactgcccaaccgacgcctggcccggcgccgattgtcaatggctccatttaccagtctgcgcagcctgtgaactatggctaccagccactgtttgaagatagacgtccgcgtaacgttggcgacacgctgaccatcgtgctggcggaaaatgtcagcgccagtaaaagctcctcggcgaatgccagccgcgacggcaaaaccagcttcggcgtcgataccgctccacgctatctgcaggggctgttcggtaatgcgcgcgcggatgtggatgccgacggcagcaacagctttaacggtaaaggcggcgcaaacgccagcaatacctttagcggcaccttgaccgtcactgtcgaccaggttctggtcaatggcaacttacacgttgtgggtgaaaaacagatcgccattaatcagggcactgaattcatccgcttctccggtgtcgtgaacccacgcaccatcagcggcagcaacacggttccgtctacccaggtggcagacgcgcgtatcgaatatgtcggcaatggctacataaacgaagcgcagaatatgggctggctgcaacgtttcttccttaatttatcgccgatgtaactgaggtatcccatgtttaaatctctgattggtatagcgctggtgctggtggcaacgattgcccaggccgagcgtatccgggatctcaccagcgtacagggcgtacgacaaaactccttaattggctacggcctggtggtcggtctggatggtacaggtgaccagacgacccagacgccgttcaccacccagagcctgaacaacatgctctcgcagatggggatcaccgtgccgccgggcaccaacatgcagctgaaaaacgtggcggccgtgatggtcaccgcgcagctgccgccttttgcacgtcagggtcagaacatcgatgtggtggtgtcctccctcggtaacgccaaaagcttacgcggcggtacgctggtaatgaccccgctgaaaggcgtggacagccaggtctatgcgctggcgcagggtaacgtgctggtcggcggcgcaggcgcatccgccggcggcagcagcgtgcaggtgaaccagcttaacggcggccgcatcaccggcggcgcggtagtggaacgtgaactgccaagccagttcggcgcaggcaacaccattaacctgcaactgaacaatgaagacttcaccctcgcgcagcagatcaccgacactatcaaccgttcccgcggctacggcagcgccacggcgctggatgcgcgtaccgtgcagatccgcgtgcccgcgggtaacagttcgcaggtgcgtttcctcgcggatatccagaatatggaagtgggcatgacgccgcaggacgcgaagattgtcattaactcccgtaccggctcggtggtgatgaaccgcgaagtaacgctcgacagctgtgcggtggcgcagggtaacctctccgtgaccgtgaaccgtcaggcgaacgtcagtcagcccgatacgccgtttggcggcggtcagacggtggtgacgccgcagacgcaaatcgatctgcgtcagagcggcggctcgctgcaaagcgtgcgctccagcgccaacctgaacagcgtcgtacgcgccctgaacgcgctgggtgccacgccgatggatctgatgtccatcctgcaatcaatggaaagcgcgggttgcctgcgcgcgaaactggaaatcatctaatgttgaccgacagccgactggcggcgagcgcggcatgggatgcgcaatcgctgaatgaactgaaatcgaaagccgggcaggatccgggggcgaaccttcgccccgtggcccgccaggtggaagggatgtttgtgcagatgatgctgaaaagcatgcgtgaagccttgccgaaagacggcctgttcagcagtgattccacgcgcctgtacaccagcatgtatgaccagcagatcgcccagcagatgaccgccggtaaaggcctcggccttgccgatatgatggtcaaacagatgggcggcgagcaggcggcgcaggccgccgcgtctgaacctgagcaggtgccgatgaagttcccgctggaaacggtcaccacctatcagaaccaggcgctgacgcaaatggtgcgcaaggcgatgccgaaagccccggaagtcaatgatgagccgctgaccggcgacagcaaagacttcctggcccagctttcgctgcctgcccgactggccagccagcagagcggcgtgccgcatcacctgatcctcgcccaggcggcgctggaatccggctggggccagcggcagatccgccgtgagaacggcgagccaagcttcaacatttttggcgtcaaagccacctcaaactggaaagggccggtcaccgagatcaccactaccgaatttgaaaacggcgaagcgaagaaagtgaaggcgaagttccgtgtctacagctcgtatctggaagcgctgtcggactacgtgggcgtgctgacccgcaatccgcgctacgctgccgtgaccaccgccgctaccgccgagcagggcgctcaggcattgcagagcgccggttacgccaccgatcctaactatgcgcgtaagctgaccggcatgatccagcagatgaaagcgatgggtgagaaggtgagtaaagcgtacagcaacgatatcgaaaatctgttctgaaaactctcaagttcagaaaggcgttgccgataatctctatcaggattcatgtctgacagtttataaggaacctccatgtccagcttgatcaacagcgccatgagcgggcttagcgcagctcaggctgcactgaataccgccagtaataacatctccagttataacgtggcgggctatacccgtcagacgacggtccttgcggcagcaaacagtaccctgggcgcaggcggctggactggcaacggcgtatacgtgtcgggcgtccagcgtgaatatgactcgttcatcaccaaccagctgcgtgcggcgcaaacccagagcagcggtctgacaacgcgttacgagcagatgtctaaaatcgacgatatgctctccggcaaaaccaatacgctgtccgccacgctgcaggacttctttaccagcttacagacgctgaccagcaacgccgaagatccggctgcccgtcagacgctgctcggtaaagccgacggcctggttaaccagtttaaagtgactgatgagtatctgcgcgaccaggataagcaggttaacctgtctatcacctccagcgtcgatcagatcaataactacaccaggcaaatcgccacccttaacgatcagatttcccgtctgaccggcgtgggcgcaggtgcatcgccaaacgacctgctcgatcagcgcgaccagctggtcagcgaactgaacaaagtcgtcggcgtggaagtgagcattcaggatggcggcacctataacctgaccatggcgaacggttatacgctggtgcagggcagcaacgcccgtcaactggccgccgtaccgtcatccgccgatccggcgcgtaccactgtggcttatgtcgatgcgacggcaggcaacattgagatcccggaaaaactgctgaccagcggttcgctgggcggtctgctgacgttccgttccactaacctggatcagacccgcaacacgctgggacagctggcgctgagcttcgcggatgcgtttaacacccagcataaagccggttttgacgcggatggcaatggcggtaaggatttcttcaccatcggcacgccgaccgcgctgaccaacagcaaaaacaccagcggtaccacgctgaacccgacggtcagcgacagcaccaaagtacaggcgaccgactataaagtggcctacaccagcaccggctggcaggtgacgcgtctgtcggataacactgcctttaacgtcacgccagacactaccgacggcaccctgaacttcgatggcctgaaaattggcgtatcaggtacgcctaatgtcaacgaaagcttcaccgtgaaaccggtgagcaacgccatcgtcaacatgaagctggcgatctccgacgaatccaaaattgcgcttgcgcaaaccgcgaccggcggcgacagcgataaccgtaacggtcaggcgttgctggatctgcaaaaaagcaaagtggtcggcggcaacaaaacctttaacgatgcttacgcctccctggtcagcaccgtcggcagcaccaccgcgacgctgaaaaccagcagcaccacccagaacaacgtggtgacgcagttaagcaatcagcagcagtcgatctccggcgtcaaccttgatgaagagtacggcaacctgcaacgctaccagcaatattatctcgccaacgctcaggtattacagacagccagcacgctgtttgatgcgttgctgagcatacgctaagtaaggggtgaatgatgcgtattagtactcagatgatgtatgaccagagcatgcggggcattaccaactcgcagagcgaatggctgaagttcggcgagcagatgtctaccgagcagcgtgttaaccgcccgtcagacgatccgatcgccgcgtcgcaggcggttgtggtttcccaggcgcaggcgcagaacaaccagtatgcgctggcccgtaccttcgcctcgcaaaagatttcgctggaagataacgtgctgtcgcaggtggcgacggcgatcacctcggcccagaccaaagtgatcaacgccggcaacgacgcattgagcgatgatgaccgcgcctcgctggctaccgatctgcagggtattcgcgatcagctgatgaaccttgcgaacagcactgacggtaacggtcgttatattttcgcaggctaccagacggataaaccgccgtttgacgccgcgaccggtgcctataacggcggcgctcaggctattacccagcaggttgatgccgcccgtaccatgactatcgcccataccggcactcaggtctttgacaccctgaccggcaatgcggtgaaagagcctgatggttctgcaccggaaaccagcctgtttaaaatgctggatacggccattgcagcgctgaaaaccccggtcagcggcgacgatgccgccaaggcgacctctcaggcggcgctggataaaaccaaccgtggtctgcgtaactccctgaacaacgtgttgagcgtgcgcgcggaagtgggtacccagcttgatgagctggataagctcgacgccctgggcactgaccgtcagttagggttatcgtcgcagatgagcgcgctggtggacgtggactggagttcggcgatttcgtcctacaccatgaaacaggctgcgttgcaggcgtcttataaagcctttaccgatatgcagggtatgtcgttattccagatgaaccgctaagtatcctgatgtaagaaagcccgcgccatcacagcgcgggctttttttatgccggtttacggctgtgtctgtacctgcgtacgggtttccccggcgcgcaggcggatagccagcgcaatcaccccgcagaccgtggcaagagccaccaccgcaggccagcccgccattgagtagactttactgcccagcgccgagcctgcggccatgccgataaacaccacggtaaacagcagggcattcaggcggccacgtgctttaggttcaaggctgtacaccagattctgatgcgccaccaggctggactgcaaacccagatcaaaaccaatggccgacagggcaatcaccaccagctgcgcttcagtggacagcagcggcatgacaaacatcagggcaaaggcgatggtgaccagcagggcgcctaactgagtgacgcgtgccgcaccgactttatctgccagcccaccggccagcggcgcggctaatgcacctgccgcaccggcgatgccaaaagtaccggccaccgcgctgccaaggtgataatgctccagcagcatcaccgccagggttgaccagaaggcgctgaacgagacggacagaaaaccctgagccagcgccgcacggcgcagggctgggtaacgctgccacagctgcaccgtggatttcatcagcgccgggtagctaagctgcgagtggacagcgaaacgcggcagtacgcaccacaacaccacgccaataaaggcaatgctggccgcggcgagctgatacatcacgcgccagccaaaagctgcgccaacaaaaccgctgacggtacgcgacagcaggatccccagcagcaggccggtcatcactgtgccaacggttttgccctgtttgccttccggcgccaggatcgcggcggcgggcacgatgtcctgcgccatggtcgccgccataccgaccagcagactgaccaccagcagggtgttcagttccgacgtcaggctacaggccagcagaaacaccgccagcgccgcgcttttcaacaggatcagcagacggcgatcgtagcggtcgcccagcggcagcagaaataaaattcccagcgcatagcccgcctgcgtcagcgtcggcaccagtcccataccattgatggtgagatgcaggtcactgcccatcaacggcagcaaaggttgcgcatagtagatcgccgcgacgctgaaacccgcgccgatagcaagaataaaaatcaaccagcgtggtacatcaaaaaggggggaatgaccgttcataatagtgtcctctataaggtgtagggtcattttttcctgttccggggtagcgcggtagccagcgcagtggtaaaacggttatacgttaaacgtataggcgtgagaattatgaaacgcactgagcgtatagacagggtggatctgatgcggacttttgtacgcatcgtggaaagcggttccctttctgccgccgcccgccagctggtcaccacccaggccaccgtcagccgtcggttacaatcgctggaaaccctgctcggcgcaaaattgctgctgcgcaccacccacgccatgaagctgaccgatgacggcgagcgctgctatcagcatgcgaaaaacgttatcgacgcctggacgacgctggaagatgagctgagccttgccggagacgagccggtgggcatgttacgggtgcgcgcgccccatgcctttggtcaggaacaactgctggcgccgctgacggcgtttttgcagcagcatccgaagctgtcagtggagtggtttcttaatgataaaagcgtcgactttctcagcgacaatattgactgcgcgatccgcgtgggcgctgaagtggatccgtccacggtgtcggtaatgctggcggaagtaccgcgtcgcgtggtggccgcgccctcgctgctggcaaattatccgccggtggaaaggccgcagcagctggcggcgctgccctgggtggcgctcagcaccttctatcaacacgaggtggtgctgaccgaccggcatggcgcggtggagcatatcccgattacgccaaggcttttcactgacagcctgtatgccacgcgtaataccgcactcaccgggctgggcgcggccattgtctccggctggacggtggaagaggatattcgcgccgggcggctggtggagctggtgccccactggcagcccgcgccgctgccggtacatctggtttatccctgggcgcgttattatccggcgcggttacgggcttttttacagttaatgcgtgatgtgatgcccggacttgcgggaatgcgggtacctggcgggtaagctggagaaatctgcgatgtgagatataaaaaaagccgacccgaaggtcggcttttttacgcaggctgaggattactcaggctgctgcgggcgggtggccggtgctgacgcgtgatgcgttgcactgtgaccaccggccgcgcctttaccgctgaactcaaaagccgggcgtacccagtcgctgtgacgcggcgcttccggaacatactccggcgctggcgcacgggtcataggcgcggtggcggctggctgtgcgctgtgcgctttcaccggctctgcggcaggagcggcaacaggcgctgccacttcttctgctttcaccggcgcaaccggctccgctttcacctcatctgcttcaaccggcagggctgctggcgctgcaacgtcttccgctttagcggtttccgtttcagcggcaggttccgcagcggcaatgatttcttcagcgacagcttcatcggcttcatcaatcaactgcggctcggctgcaaccggggcggcaatggcttcgggatgggtggtttcaaccacaaccggctcaggcgcgctgaccggagtctgcggctcaaccacctgcggctcactcatctgcggttctgctgcctgcgcttcagtggtcacggtttcctgcgcgacttccgcctgctcagctgcggcggtaaccggcagtacagtctgttcgatctgctccgcgatggcttctaccggcgcgttgtcaacgatagcctcttcctgcaccggttccacgctctgggcgaccggataacggatccataccttgccggacgccatttctggcgacgcgcaggcgacggtcatcggcatcggcgactgggtcgggtaacgctcgtcacgataacgacgacggcgctggccgctgacgcgcaggtgacgaggagaacggcgtgaacgacgcggcattcccgcattgtcacgggattccgtcgactcttccccggcagcctgttctgttaccgtaggcagatccacttttgcgatttcggtatgtgccgctggcgcgtcctgaaccggcgcgtctgtaacctcttcggtcaccgcaggggctgcttcgccgaagcgtactttctggctcagctggcgctgtttacggcgcggcagcgtctgcacacgctcttcctgctcaaccacatcctgctcagcttgcggctgcggctcatcgccattcagcactttaacttcctgctgcgcctgacgcttatcatcgttacgacgacggttgcgctcgcggcgggactgctgctgctcgtcacgggatttggttttatccgcctcttcaaccgcagcgaccggctggcgattttcacgcgcttcaccgttctgcgactgcttctcgcgacggttacgacggttatcttcgcggccttcacgattatcgcgggcttcacgattatcgcgtccttcgcggctgtcgttaccctcattgcgatcgcgattatcacggttatcgcaattatcacggcgatcgttgcggtcgcggcgattgttctggcgcggcttacgacgctcctgtgaacgctccggcttcacgtctttaacttcagcttccgctttcacttcagccggtttggcaggttcgtcgtcggcaaagagttttttcagcgcgccaagtatacggctgatgaggccaggcgctgctttttcagcaggcgcggcggcggcaggcttatcagccggcgctgccacagtggcttcaggagctggcggaatttccggcatggcaaaggtagccagcgcaggttgttccggctgcttacgctcggcgtactcttcttccgacggcatcgccatcgcttcttcgtgcagtttaggcagcttgtagctcagggttgaggtttcttcacccttacgcacacgcagcacagagtagtgcggcgtttccatctgatcgtttggcacgatcacgcatttgataccgccctggcgcgcttcaattgcgcttactgctgcacgtttttcgttcagcagataggaggcaatcggcaccggcacgatggcgtgaacttcctgggtattctctttcagcgcttcttcttcaatcagacgcagaatggagagggacagggattcgttgtcacgaatggtgcccgtaccgctacagcgtgggcagacgtgatggctggactcgcccagcgacgggctcaggcgctgacgggacatctccagcaggccgaagcgtgaaatatggctgatctggatacgcgcgcgatcctgacgcacggcttcgcgcagacggttttccaccgcgcgctggtggcgcaccggggtcatatcgataaagtcgataacgatcaggccgccgaggtcacgcagacgcagctgacgggcaatctcgtctgccgcttccaggttggtgttgaacgcggtttcttcgatgtcgccgccacgggttgcccgcgcggagttgatgtcgatggcggtcagggcttcggtggagtcgataacaatagagccaccggacggcagacgcacttcacgctggaaagcggattcaatctgcgattcgatctggtaatggctgaacagcggaatttcaccggtgtacagtttgattttgctgctgaaatcaggacgacccagcgcagaaatgtgctgacgcgccagctccagcactttcgggttatcgatgaggatctcaccaatatcctgacgcaggtaatcacggaaggcacgcacaatcacgttgctttcctgatggatcaggaacggagcagggcggctttcagcggctttctgaatggcttcccagtgcttcatacggaagctgagatcccattgcagcgcttcggctgatttacccacaccggcggtgcgaacaatcagacccatgccgtccggcagttcaagactggccagcgcttcttttaattcggtacgatcgtcgccttcaatacgacgagaaatgccacccgcgcgcgggttgttcggcatcaggaccaggtagctccctgcaagactgataaaggtggtcagtgccgcacctttgttgccacgctcttctttgtcgatctgtacaataacttcctggccttcgcgcagcacatctttgatgtttggacgaccgtgggagctgtaattagaagggaaatattcgcgggcaatctctttgagaggtaaaaagccgtggcgctcggcaccgtaatctacgaatgcggcttccaggctcggttcaatacgggtgattttgcctttgtagatgttcgcttttttctgttcatgtccaggactttcaatatccaggtcgtacagacgctgcccatcaacgagggcgacacgcaactcttcctgctgagttgcgttgattaacattcttttcatcgtaacttactcattattcttacattgacgactaagctacgggcagagtatcgcctttccgggtgtgaaccgatggcctcgtgtctgttcacgtcgccaacctcacggttgtcgtacgcttaagaggcgcagagtgtcggttgcctgtatttcatacggaaaaacagcgcaattattcggggaacagcctgggaaaactctccagagaagattccgtctaccggtaaggactgcaacccgcagcccgctaactgcctgaacgatcaatacgtcttacgccattgctgcgtggatgaacgaacgggcaaaattggtgattccgtaaaattcattgttataacaagcttgaacacggaaagcgtaaacattattccttgctaaccctgttatagcaagatgacttttaccatttatcacccggttactcacagttttttcaccgctgcttcgagattgttctaaaagccatcaaaaagcataacgatgcgcaaaccctaccgggtaatcctaaatataagcatagaaaaatgagtggcgctattcggcgtggctatttagaatcgccaaccatgaaaacagagactccagccgtaaaaatggttgctatttcggctgacgaagccgggcaacgaatcgacaactttttgcgtacccagttaaaaggggtaccgaagagcatgatttaccgcattctgcgtaaaggcgaagtgcgggtgaacaaaaaacgcgtcaaaccggaatacaaactgatggatggcgatgaaattcgtatcccgccggtacgcgttgccgaacgtgatgaagaagccgtgtcgccccatctgcaaaaagtggcggcgctgagcgatgtcattctttatgaagacgatcatattctggtgctcaacaagccgtccggtaccgccgtacatggcggcagcggcctgagctttggcgtgattgaaggcctgcgcgcgctgcgtccggaagcccgtttccttgagctggtgcatcgtcttgaccgcgacacctccggcgtcctgctggtcgctaaaaagcgctcggcgctgcgttcgctccatgaacagttgcgcgaaaagggtatgcagaaagattatctggcgctggtacgcggccagtggcagtcgcatgtgaaagtggtgcaggcgccgctgctgaaaaatattctgcaaagcggcgaacgtattgtgcgcgtaagccaggaaggtaagccgtccgagacgcgcttcaaagtggaagagcgctatgaacatgccacgctggtacgctgtagcccggtgacgggccgtacgcaccagatccgcgtccatacgcagcacgccgggcatcctatcgcctttgacgatcgctacggcgatcgcgattttgatcgccagcttgccggcaccggtctgaatcgcctgttcctgcacgctgcggcgctgaaatttacgcatccgaatacgggtgaagcgatccgcatcgaagcgccgctggacgatcagctcaaacactgcctgcaggtgttacgcaacgcgaagtaacacccgacaggacgagggcttatggcctgagccatttatccagccaggggtaaacctcgtcctgttgttgctgataaaaaacatgcccgagttccggccagcttttggtcactaatctgtcatccgcctgttgcgacgcccagacctctcgggcgcgggcaaaggcatcctcgaccgcctgtggcggaaataacttatctttgccgccgctaaaaatcagcatgggtttcggcgcggcaatgctggcgacatcgggaatatcgagatgtgcaggcataccgggatgaagcatataaaaggcggactgcccgcgcagcacgttattgcccggctgcatcagaccgtcataggtgccaaaccaggaaattactgccgtggccgccaccttgtccgacaaggcggccagctgccaggcgcggaaaccgcccattgagaagcccagcacgccaatgcgtttgctgtcgacgttattaagcgtggtgagaaaatccacggtgcgcatatcttcataggccatttcaccggccagcgagcggccaaggttaaaatagttgctcgccagcgcctgttgctgttcgtacaccagcgggccacgctcgccccagccggtgctgtcgatggcgattaccacatagccacgcctggccagctcatcgccgggaaaacgcccgctgaagaacttgtcggcccacgcctgcgcgctggcgagcgtttcggcattcccccacgggcggatgactttctctttgccaatatcaaactttgaaccgtgatcgtgcaataacaccaccgccggatggggacccgctgctttggggagcagcatcagggcgttaatacggttgtcgtcggtgatgttcagggcgattttgcgggcgaggtaactgccacgatcctcctccatcagcgtctgcggcgcaaatggcttatgtgaatccggcgtcagcagggcgctgcgcaacagctggcgggcgtgctgctgccagcgggtgaagtcagagaaatggctggactgccaggcgtcgggataggtcatctgcgcttttaacgccgccacgttgcccggaagattaccttcgataatgccggtcggcggtttattttccgccatacccgagccgctggttacaaataacatcattgccagaaatgcttttgctgaatatttcatcacccacctttaaattaaaacgcggttttaaaaagtcaggtgatgaataatagagcaatgccggtcttaaaccgtgatccttaaggcattaatataataatggattactgttttcccggcgcagcatctggcacagggcaatcagcggcagacccaccagcgtattggggtcgcgcccctcaaggcgttcaaacagggtgatgccaaggccctcgcttttgaagctgcctgcacagttcagcggacgctctttacgcaggtaatcgccgatctcctgctcgctgaggtgacgaaaatgcacatcgaaaggctcacattcggtttgcagatgaccggtagcggaattataaagcgcaaggccggtataaaaagtaacgatattgccccgcgccttcatcaactggcagtatgcattttcttctgtcagcggtttaccggtaatttcaccatccagtacgcacacctgatcggaaccgataataaggtgcgccggataacgttcggcaagggactgcgctttcgcctgcgccagtcgcagcaccagctgacgcggggtttcgcccgccctgggcgtttcatcgacaccgggggcggcgcactcaaaaggcacgccaattttttccagcagcgcgcgacgataaggcgaagtggaagcgagcacgagatttgacatattttttccaccttttatatagcgtaaccaggtcaggcattttaaactacaggccgcaatgtgtgcgaataattggcaaaaggcaaccgcaggctgcctttttctttgactctatgacattacaaagttaatatgcgcgccctatgcaaaaggtaaaattacccctgactcttgatccggtccgtacggctcaaaaacgccttgattacgagggaatctatactcgcgatcaggctgagcgtgtcgccgaatccgtagttagtgtggacagtgatgtggaatgctccatgtcgtttgctatcgacaaccagcgtctggcggtattaaccggcgatgcgaaggtatcggtaacgctcgaatgccagcgttgcgggaagccgtttccccatcaggtctacacacagtattgttttagcccgatcgtcaaagacgaacaggccgaagcactcccggaagcgtacgagccaattcaggtcaacgaatttggtgaaatcgatctgctggcgctggtggaagatgaaattatcctcaccttgccggtagttccggtgcatgattctgaacactgtgaagtgtccgaggcggacatggtgtttggtgaattgcctgatgaagcgcaaaagccaaacccatttgccgtattagccagcttaaagcgcaagtaacaggttctgcctgttcttacgtggataaccgtaattgaggagtaaggtccatggccgtacaacaaaataaaccaacccgttccaaacgtggcatgcgtcgttcccatgacgcgctgaccgcagtcaccagcctgtctgtagacaaaacttctggtgagtctcacctgcgtcaccacatgaccgctgacggtttctaccgtggtcgcaaggtaatcactaagtaatcacgcttttgcgtgatgaagcttagtgaggatttccccgtgtaagcggggatataccgccttgacacgtctaaccctggcgttagatgtcatggggggcgattttggcccttccgtgacggtgcctgcagcattgcaggcactgaattctaattcacaactcactcttcttttagtcggcgatcccgacgcaatcacgccattacttgccagagctgatttcgaacaacgttcgcgtctgcagattatccctgcgcagtcagttattgccagtgatgcgcgcgcctcgcaggtgatacgcaatagccgtggcagttcgatgcgcattgcgctggagctggtaaaagaagggcgcgccgaggcctgcgtgagcgcagggaataccggcgcgttgatggggctggctaaactcctgctcaggccgattgacggcattgagcgtccggcgctgatgacggtattaccgcatcagcagaagggcaaaacggtggtgctggatttaggcgctaacgtggattgcgacagcacgatgctgatgcagttcgcgttgatgggttcggtgatggcggaagaagtgcttggcattcctcatccccgcgtggcattgctgaacatcggcgaagaagagaccaaaggtctcgacagcattcgcgatgccgcagccttgttaaaatccatcccgtcgattaactatattggctatcttgaagctaacgaattactcaccggcaaaacggatgtgctggtatgtgacggttttacgggaaacgtcacattaaagaccatggaaggtgtggtcagaatgttcctttcgctgctgaaatcgcagggcgaggggaaaaaacggtcgtggtggctgattttattaaagcgttggttacaaaaaagcctgagcaggcgattcagtcacctcaaccccgaccagtataatggcgcgtgtctgttaggattgcgcggcacggtgattaagagtcatggtgcagccaatcagcgagcgtttacagtcgcgattgaacaggcagtgcaggcggtgcagcgacaagtcccttcgcggattgccgctcgcctggaatctgtgttaccggaaaaagactgagcgtacatgcatacgaagattattggtaccggcagctatctgcctgaacaagtgcgaaccaacgccgacctggaaaaaatggtggatacctccgacgagtggattgtcacgcgcacgggtatccgcgaacgccgcattgccgcgcctgatgaaaccgtgtctaccatgggtttcgaggcagcaaaacgcgcgctggaaatgtcaggtattgataagaatgaaattggcctgatcatcgtggcaacgacgtcagcgacgcacgcctttccgagcgcggcctgccaggtgcagagcatgctggaaattaaaggctgtccggccttcgacgtggccgcagcctgtgccggtttcacctatgccctgagcattgccgatcagtacgtaaaatccggcgccgtgaaatatgcgctggtgatcgggtccgatgtactggcccgcacctgcgatccggcggatcgtggcaccattattatttttggcgatggtgcgggtgccgtgctgctcggcgcgtctgaagagcagggcattatctccacccatctgcacgctgacggcagttacggtgaattactgacgttgccgaacattgatcgcgtgacgccggacaacccgacttatctgacgatggccggtaacgaagtctttaaagtggccgtgacggaactggcgcacatcgtcgaagaaaccctggcggcgaataacctcgaccgcagtgaactcgactggctggtgccgcaccaggctaacctgcgtattatcagcgcgacagccagaaaactgggcatgtcgatggataacgttgtcgtgaccctggatcgtcatggcaatacctctgcggcttcggtgccatgcgccttagacgaagccgtccgggacggacgcatcaagccggggcagctggtgctgcttgaagccttcggcggcgggttcacctggggttccgcactggttcgtttctaaaatttaaggataaaaacatgacgcaatttgcatttgtgttcccgggacagggctctcaggccgttggcatgctcgctgaactggctgccgactatccggtgattgaagaaactttccgcgaagcgacagcggtgctgggctatgatctgtgggcgctggctcaacagggcccggcagaagaactgaataaaacctggcagacgcagcctgcgctgctgacggcttccgtggcgctgtggcgcgtatggcagcaggcgggcggtaaaacccctgccatgatggcaggccacagcctgggtgaatactctgcgctggtgtgcgcgggcgttattgatttcgctgatgcggttcgcctggtcgagctgcgcggtaaatttatgcaggaagccgtgcctgcgggtacgggcggcatgtccgctattattggcctggacgatgcggccatcgctaaagcctgcgaagaatctgccgaagggcaggtggtttcaccggtgaactttaactcgccgggccaggtggtgatcgccggtcataaagaagcggttgaacgtgcaggcgcagcctgtaaagcggcgggcgcaaaacgcgcgttgccgttgccggtcagcgtaccgtcacactgcgcgctgatgaagcctgcggcagagaagctggcggcagagcttgagaaaatcacctttaacactccgtcagttccggttgtgaacaacgtggatgtgaaatgtgaaaccacgcctgcggccatccgtgatgccctggttcgccagctgtacagtccggtacaatggacgaagagcgttgaattcatggctgcgcagggcgtggagcacctgtatgaagtcggtcctggtaaagtactgaccggcctgaccaaacgtattgttgacaccctgacagcgtcggccattaacgagccggcggcgatgtcagcggcgcttgagcaataacagaggaaaaccaaaaccatgagttttgaaggaaaagttgcactggttaccggtgcaagccgtggcattggccgcgcaatcgctgaaacgctggtcgcccgcggcgcgaaagttgtcggtacggcaaccagcgaaagtggcgcacaggcgatcagtgattatttaggtgctaacggtaaaggtctgatgttaaacgtgaccgatccggcatctattgaatctgtactggaaaatattcgcgcggagtttggcgaagtggacatcctggtcaataatgccgggatcactcgcgacaacctgttaatgcgtatgaaagatgatgagtggatcgatattctcgaaaccaacctttcatctgttttccgtctgtcaaaagcggtaatgcgcgctatgatgaaaaaacgtcatggtcggattatcactatcggttctgtggtcggtaccatgggaaatgcaggtcaggccaactacgctgcggcgaaagcgggtctgattggctttagtaaatcgctggcgcgtgaaatcgcgtcccgcggtattacggtaaacgttgttgctccgggctttattgaaacggacatgacgcgtgcgctctctgacgaacagcgtgcgggtattctggcgcaggttcctgcgggtcgcctcggtggcgctcaggaaatcgccaatgcggttgcatttttagcttcagacgaggcgagttacatcacgggtgaaactttgcacgtcaacggcgggatgtatatggtttaaccacgttatttcctaaaacacatttagggaataattttatttgcgttatcaggccaaaaggcctcaaaatagcgtaaaatcgtggtaagaactgccgggatttagttgcaaatttttcaacattttatacactacgaaaaccatcgcgaaagcgagttttgataggaaatttaagagtatgagcactatcgaagaacgcgttaagaagattatcggcgagcagctgggcgttaagcaggaagaagtgaccaacaatgcatcttttgttgatgacctgggcgcagattctcttgacaccgttgagctggtaatggctttggaagaagagtttgatactgagattccggacgaagaagctgagaaaatcactactgttcaggctgccattgattacatcaacggtcaccaggcgtaagtgaacatctccaggcggtcattcgaccgcctgagttttatcttttagtcccacaaaatctttttttccctccctggaggacaagcgtgtctaagcgtcgtgtagttgtgaccggactcggcatgttgtctcctgtcggcaataccgtagagtccacctggaaatctctccttgccggtcagagtggcatcagcctgatcgaccatttcgatactagcgcctatgcaacgaaatttgctggcttagtaaaggactttaactgtgaagacattatctcgcgcaaagaacagcgcaagatggatgccttcattcaatatggaattgttgcgggctggcaggccatgcaggattctggcctggaagtcactccggagaacgcagggcgcattggcgcggcgattggctccggtattggcggtcttggcttaatcgaagagaaccacacttccctggtgaatggtggtccacgcaaaatcagcccgttcttcgtgccgtcaacgattgtgaacatggtggccggtcatctgaccatcatgcttggcctgcagggtccgagcatctccatcgccacggcctgtacctctggcgtgcataacatcggtcatgcggcgcgtatcattgcttatggcgatgctgacgtgatgctggcaggtggcgctgagaaagccagtacgccgctgggcgtgggtggttttggtgcagcacgtgcgctgtcgacgcgtaacgataacccgcaagcggcaagccgtccgtgggataaagagcgcgatggttttgtgctgggtgacggcgcaggcattattgtgcttgaagagtacgagcacgcgaaaaaacgcggcgcgaaaatttatgcggaactggtgggttttggtatgagcagcgatgcttaccatatgacctcaccgccggaaaacggcgcaggcgcggcactggcgatggccaatgcgctgcgtgacgcgcagctcgatccggctaaaatcggttacgtcaacgcgcacggcacctcgacgccggccggcgacaaagcggaaactcaggccgttaaatcgatctttggcgagtcagcccgtaccctgatggtcagctcgactaaatcgatgaccggacacctgttaggtgccgcaggggcagtagagtccatctactccatccttgcgctgcgcgatcaggcgatcccgccaaccatcaacctggataacccggatgaaggttgcgacctggattacgtgccacacactgcgcgtcaggtctctggtcttgagtacacgctgtgtaactccttcggctttggtggtactaacggctcgttgatctttaaacgcgtctgatccccgtagcctgaaaaggcccgctctgcgggcctttgttatttccatttcagctttctccgcttgtccttcttctttcatcctgccagactggcgtgccatgcaaacaggagccgctatgttcttgataaatggacgtgaacaagactcgcttgccgcgaacgaccgcgctatccagtttggcgacggctgctttaccacagcccggatccgccaggctgaagtccagctattaccggcccatattcgtcgtctgcgtgaagcctgtgagcggctgatgctgccatttactgactggcaggtactggaagccgagatgcgccatctggcgcacggccatcaacagggcgtactgaaggttatgcttacgcgcggcgcgggcggacgcggatatagcgctgccgcctgtcatgcgccgacgcgcctgctgtccgtgtcccccctgcctgcacactatgatcgctggcgggaggagggcatcaggctcgccttaagcccggtgcgtctcgggcgcaatcctcatctggcgggtatcaaacatctcaaccggctggagcaggtgttgatccgtactcatcttgagcagacgaccgccgacgaagcgctggttcttgacagcgacgggttcattacggaatgctgtgccgcgaatctgttctggcgaaaaggcaatgacgtctttaccccgaatctggatcacgcaggcgtgaacggtattatgcgccagcactgtattgcgcagctggcggcgtcaccctttcgtgtggtggaagtccatgcggcagaagaagccctggcagatgccgacgaagtgctcatctgtaatgcgttaatgccggttattgcggttcgtgcatatggcgaacggacgtggacgtcacgcacgctgtatcaatttttagccccactttgtgagcattcgatttcgtcatgaagaaactgtttcggttcgtgctgatcctcgcggtgatcctggttatcgctgcgggtgcgggtctgtggaaagtccgccagatggcgaacagcccgatccttgtaaaagaagagactattttcactctgaaagctggcacgggccgcatcgcccttggcgatcagctgcatgctgagaagatcattaatcgcccgcgcgtctttcagtggttattacgcgtggagccggatctgtcgcacttcaaggccgggacctatcgcctgacgccgaaaatgaccgtgcgcgacatgctgttgctgctggaaagcggcaaagaagcgcagttcccgctgcgtctggtggaaggcatgcgcctgagcgattatcttcgccagctgcgtaacgcgccctatatcaggcacacgctgaaggacgacagttatcagaccgtcgccgctgcgctcaagttcgacaacccggaatgggtggaaggctggttctggccggacacctggatgtataccgccaataccacggatattgcgttgctgaagcgcgcgcatcagaaaatggtggcggcagtggacagcgcctgggaagggcggatggaaggactgccctacgcggataaaaatcagctggtcaccatggcgtccatcattgaaaaagagacggcggtcgccagcgagcgggaccgcgtcgcctcggtgtttatcaaccgcctgcgcattggcatgcgtctgcaaaccgatccgacggtgatttacggcatgggtgaaaaatataacggtaaactgtcgcgcagcgatcttgagacgccaaccgcgtacaatacctataccatcaccggattgccgcctggccccatcgccacgccaggcgaagcctcattgaaggccgccgcgcatccggccaaaacgccgtatctctattttgtggctgacggtaagggagggcataccttcaacaccaatctcgccagccataaccgttcagtgcaggactatctgaaagtattaaaggaaaaaaatgggcagtaaatacatcgttattgaaggtctcgaaggtgcagggaaaaccacggcgcgcaacgtcgtggtggaaaccctggagcaacttggcatcggcgagatgatcttcacccgcgagccgggcggcacccagctggccgaaaaactgcgcagtctggtgctggatattaaatcggtcggcgatgagatcattaacgataaagccgaagtgctgatgttttacgccgccagggtgcagctggtggaaacggtgatcaaaccggcgctggatcgcggctgctgggtgattggcgaccgtcacgatctctccacccaggcctatcagggcggcggacggggcattgataacgcaatgctcgccacgctacgcgacgcggtgctggggagtttccgcccggatttaacgctgtatctcgacgtcacgccggaagtgggcctgaaacgcgcccgcgcccgcggtgaactggatcgcatcgagcaggagtcgctggatttctttaaccgtacccgtgcgcgctaccttgagctggcggcgcaggacgcaagcattaaaaccatcgatgccacgcaatctctggacgatgtgatccgcgatatccgccacaccgtgaccagctgggtgcgggagcagggcgcatgaaatggtatccatggctacgcccggactttgagcaactgattgccagctatcagaccggacgcggacaccatgcgttattgatccatgcgctgcccggcatgggggaagatgcgctgatctacgccatcacccgctatctgatgtgccagcagccggtggagcacaaaagctgtggccagtgtcgcggctgtcagttaatgcaggcgggcacccatccggactattacgccctgacgccggaaaaaggcaaagcgtcgctgggtattgatgcggtgcgcgatgtcagtgaaaagctctatgagcacgcccggctgggcggcgcgaaagtggtgtggatcagcgacgcggcgctgctcaccgatgcggctgctaacgccctgctgaaaacgctcgaagagccaccggcgaacacctggtttttcctcgcctgccgcgaacctgcgcgcctgctcgccaccctgcgcagccgctgccgtattcatcatttatccccgccgtcagaaagctacgccagcgcctggctggcgcgggaaaccaccgccagccctgaggccagccttgcggcgctgcgtttatgcggcggtgcgccgggtgcggcagcgcaactgttacagactgaaagcgccgcccagcggcagacgctctgtaccgcggtaaataccgcgctggacagcgccgactggctctctctgctgggcgtgcttaatcacgatcaggtggcggagcgcctgcactggctggcctcgctgctgatggacgcgctgaaaatgcagcagggcgcgaccctgctgaccaacgtcgacgcgcagccgttagttcaccgtctggcgcagcatctgccgacggcgcgcctgcaggcgatcctcacggcggtatttcagtgtcgcgggcagttgctggacgtcaccggcataaatcgcgaactgctgttaaccgatctactcttatgctgggagcactatctgcaaccgggcaccgtgcttcctgtatcccacttctgaaagagatcttatgtttttagttgactcacattgccatcttgatggcctggattatcaatccctgcataaagacgttgatgatgtgctggcgaaagccgccgcgcgcgacgtgaaattttgtctggcggtcgccactacgctgccgggttaccgtgccatgcgtgatctggtgggcgagcgcgataacgtggtcttctcctgcggcgtgcatccgctgaatcaggacgaggcttatgaagtggaaaccctgcgtcagtgggcggcggaggagggcgtggtggcgatgggcgagacgggtctcgactatttctacaccccggaaaccaaaacgcagcagcaggaatccttccgcaaccacatccgtattgggcgcgagctgaacaagccggtgatcgtccatacgcgcgatgcccgcgaagatacgctggctattctgcgcgaagaaaaggtgacggattgcgggggtgtactacactgcttcactgaagacaaagaaacagccggtaaattgttggacatgggcttctatatctcattttccgggattgtcactttccgtaacgcggagcagctcagagatgccgcgcgttacataccgctcgacaggctgctggtggaaacggattcgccgtatctggccccggttccccatcgtggtaaagaaaaccagcctgcgatgacccgcgatgtcgcggagtacatggcggtactgaaaggtgttccggttgaagaactggcgcaacaaacgacacaaaactttgccagactcttccatatcgaccctgcccgcctgcaattttcctgatcgcacagtttttttaaagctcgtaattaataggctttgcgagtaaagttcaccgcctcaaacggggcggtgacactcttttttgacacattcagacaagacttttgtaaaatagtgcaagttttaagaacggtcctggctgaaacgtgatagccgtcaaacaatgttacgctgatttattttactctgcgtaataaataaagggcgcttagatgtcccgtccagggcgcggttctccccccgcgccaatgcgtgaaaacgtaaaaaaaagcacaaatactcaggagcactctcaattatgtttaagaatgcatttgctaacctgcagaaggtcggtaaatcactgatgctgccagtatccgtactgcctatcgcaggtatcctgctgggcgtcggttcggcaaacttcagctggctgccagaagttgtttcccatgtcatggctgaagcgggcggttccgtttttgctaacatgccgctgatcttcgctatcggtgttgcgctgggcttcaccaataacgacggcgtttctgcgctggcctctgtggtcgcttacggcatcatggtgaaaaccatggcggtggtagcgccgctggtgctgcatttacctgctgaagaaatcgcggctaaacacctggcggataccggtgttctgggcgggatcatctccggtgcgatagcggcctacatgtttaaccgcttctaccgtatcaagctccctgaatatctgggcttctttgcgggcaagcgcttcgtgccgatcatctctggtctggctgcgatcgtaatgggcatcgtgctgtccttcatctggccgccaatcggtaccgctattcagaccttctctcagtgggctgcttatcagaacccggtcgtggcgttcggtatctacggcttcattgagcgctgcctggtgccgttcggtctgcaccacatctggaacgttcctttccagatgcagattggtgaatacaccaacgccgcaggtcaggtattccacggtgacattccgcgctacatggcaggcgacccgactgcgggtaaactgtccggcggcttcctgttcaaaatgtacggtctgccggctgcagcaatcgcgatctggcactcagcgaaacctgagaaccgtgcgaaagtgggcggtatcatgatctccgctgcgctgacctcgttcctgaccggtatcaccgagccaatcgaattctccttcatgttcgtggcgccggtgctgtacgcaatccatgcggtactggctggtctggccttcccgatctgtatcctgctgggtatgcgtgacggtacgtccttctcccacggtctgatcgacttcgtggtactgagcggcaacggcagcaacctgtggctgttcccggttgtgggtctgtgctacgcggcggtgtactacaccgtgttccgtgtgctgattaaagcgctggatctgaaaaccccgggtcgtgaagacgcaaccgaagacgcaaaagcgaccggcaccagcgaaatggctccggctctggtatcggctttcggcggtaaagataacatcactaacctggatgcctgcattacacgtctgcgtgtaagcgtggctgacgttgctaaagtggatcaggctggcctgaagaaactgggcgcggcaggtgtggtggttgcaggttccggcgttcaggcaattttcggtaccaaatccgataacctgaaaaccgagatggatgaatacatccgcaaccactaagaaatagtctggggagactgagggagccgaatggctcccttttttacgtctggtgaatgtgaagccgggtggcgcttcgctgacgctggcctggggactgggattgtgccgggtggcgcttcgcttacgccggcctacataccgggaactgtgccgggtggcgcttcgcttacaccggcctacataccgggaccggcctacatttatggggtttggttactgtaggcccggcaagcttgcgccgccgggcaagtcatttacgcggagtatcagaagctgtagttcgcgctaaccgagaagttacgcggctcgccgaacacataggtgcggctgttgacgttggtttcgtaggttttatcgaacaggttatccagattcgcctgcaccgaaagcgctttggtcacgtgataacgggcgaacagatccaccagcgcgtagctgccttgttctgaacgcagcgtgccgctggcaacaggtacatcagcccatgtgtggttctgccagttcacgccaccgccgaccgtcaggtcctgcagcatcggcaggcgatagctggtgaacattttcaccgatgtgcgcggcagatctgagtttaccgcgacaccttcgctgtcttccgccacataacgcgttgcgccgaaggacatctgccagttgtccgtcagtgcgccgttcacttcaaattcaacgccgcggctgacggtaccattcgcttcacgatatgcggtttccccgttgctgccgggaaccacgccgcctgtggactgcgccagatgatcctgctcaatgcggaatactgccagcgaagtcgtcaggcggctgttcatccagtcagctttcacacccgcttcgtagttgttaccggtgatcggcgacaggtatttaccctgactatcacgttgcgtctgcggctggaaaatcgaggtatagctggcataggtggaccaggtatcgttgatgtcaaacaccacgcccgcatacggcgaagtattgttcttctccagatcctgggtcagggtatgcagcgtgtaattggtatagcgcgcgcccataatgaggtgcagcggatccgccagcgaaatgcgggtcgccatatacgcggatttctgacgcaccgtatcttcctgcgcgaggctcaacggcgaccagtcggtttccgggaagttaccggtataatcgctgtagttgcctaactgcgtatcgccgatgttctcccacgagctgtaatagatattgtgctgtttagtgtaattggtgcccaccatcagctcatgctgacgaccaaagagttcgtaattgccgttagcaaaggtatcgatggcatccactttacgcttgccggtgttgtagccggtgccgccaacaaagggataggacgcgccatacgggctgaccatcaggccggtggttttatcaacctggccgtccagatacagcgccttgctgtcgagctcagtttcggtatgcgtaccgtttaccgtaagctgccagttatcgcccagcttttgcttcagagtgacaaaagtacgctgcgtttcggtatcgctgtaggcccagtcaggcgccgtactgtcgctgcgatcggccttgattttgctgccgtcggtataccagcgcggcaggccgccccaggtctgatggtcagtgttgttttcctgataatcgtaacccacggagaacgccgtggcgtcagtgagatcggcatccagcacgccgtagaagaattttttcttctgaccgtaatgatccagccagctgtccttatcctgatagcccgccaccatacgaccacggatgttaccgttttcggtaagcggggtggagagatccgccacgtaacgttgcttgttccagctgccgtactctgcgctgacgttggtggtgaattcacggctgtcagcgtgcttacgcaccatattaatcgccgcagaagggttgccggaaccggtcgtcagaccattcgcgccgcgcaccacttcaatacgctcatacatagcggtatccgacatcgcatcgcccaggttccagcgggattcaaacagcgtcggaatgccatcgaccatatagttgtcgatcagaaaaccgcgggaatagaaggtgctgcgatcggaatccgccacgctctcagaaataccgatggtatttttcagcacgtcgcccagcgactccagcttctgatctttcatccgctgttcgctgaccagcgtcaccgactgcggaatatcgcgctgaaccagcagcattttggtgccggaggcggtggttttaacgctgtaatcttcactttctgtggctgccgtcgtgcctgaggacgaaccatcgacaaccagcgtatcttccggcgctgccgtggtggccgcaaagcccgccgctggcgtcagtgcaaaagcaatacaaaccgccagcagtgacggatgagtggcaggcggacgttgtccgtccctggcgtgaacggtgaaagacatcattaacccttctgagtgttggtcataaagcaccccgtcaatacgttgtcggcgcggtgcaggatagttaattattcagttatgaaacgcgcatggaaatgcaaatgcgaaatatacgcattacagttcaccctgtaaacagatgtaatatttattaatgaaacccggttttactcagcacgatgaacagggggatgacataagctttcggcagggtaagaaaatgaggtttatagttgaaacatcaggagattgtcactcatactctctggcaatattatgcagtcataaagaaggaagacgacatggcagaagaaactattttcagtaaaattattcgtcgcgaaattccgtcggatattgtctggcaggatgagctggtcaccgcgttccgcgacatttccccacaggctcctgtacacattttgattgtgccgaatattctgatcccgaccatcaacgacgccaccgaagcccatgagcaagcgctgggccgcatgatgaccgtcgcggcgaaaatcgcaaagcaggaaggcattgccgaggacggttaccgcctgatcatgaactgcaatcgtcatggcggccaggaggtctatcatattcacctgcatctggtcgggggccatgccctgggtcctatgctgtctcacaaaggccgctaagatgaccaaagggcgtactgccgtattactggcggcgattttacttgccggatgcagcgcaaaaccggcgatcccggtcagcgatgagcaaacgctggtgatggagtcaaccgtcctcgcggcggggatctccgccgaaaaaccggaattatcccgctcggaaattcagtcttctgcgtcctcaactctctacaatgaaagaaacgtgccggtaacggttaactatcgtttttactggtatgacgccagaggccttgaaatgcatccgctggaagcgccgcgaaccgtcactgtgcctgcacacgcatcggtgacgctttatggcagcgccaactacctgggcgcacataaagtgcggctctatctctatttataaggggtgatttgaatgagaatgatgggacgttacgccctgcttgccacactggcattgatcctgaccggctgtcagattaatcaggaacaacccgcgccggtcgaccaggcgacgccggtaccggaacaaccgaccacgccgcagcaaccgctgccgaccgtgccgtcagtaccgaccatcccgtcacagccagggccgattgagcatcaggacgaaaccgtgcagccgacgccgcgcgtacgtcactacgactggtccggcgcgatttcgccgatggtcagcaaaatgctgcaggcgagcggcgcggcaggcggcagcgtgctgctggtggacagcgtcaataaccgcaccaacggctcgctcaataccggcgaaggcaccgatgcgctgcgcaatgcgctggcgaacaacggcaaattcacgctggtatccgcgcagcagctgggcgtcgccaaacagcaattggggttatccccgcaggacagtctcggcacccgcagcaaagccatcggcatcgcccgtaacgttggcgcgcagtatgtactctattccagcgccagcggcaacgttaacgccccgaccctgcaaatgcagctgatgctggtacagactggcgagatcgtctggtcaggtaaaggcagcgttgcacaacaataaacctgagcgtgacgctattctgtcacgctattttccgcagtttacgcccgccgcagatcagacaacgtccggtctgtccggcgggagtatcattattgaacgcgggcagcagcgtctggtgctccgtttccgtcacgcggccacccccgccgcgccttttctgcgtcagtatcatgtcctgaaacgtctccctgtttcgcttgcgccacagccgctgcgttacggtgaaggctggatggccgtcgattttctgcgcggtgaggtaaaaactgcgctaccggctaccgatgcgctggcagaggtgttgtatcatctgcaccagcagccctgttttggctggcgcattacgctgctgccgctgcttgaaggctactggcaacaggccgcgcccgcgcgacgcacgccgttctggttgcggcaactgaaaaggctgcgcaaacagagggagccgcgcgtgctgcggctggcgccgctgcatatggatgtccacgcgggcaatctggtgcacagtgcgcaggggctgcggctgatcgactgggagtacgcgggagatggcgatatcgcccttgagctggcctcagtgtggatggatgacgccgcgcgacaggggctggtggcggattatgcccgccgggccagcatcgatcccatcatgttacagcggcaggtgcggcgctggcggccctgggtgatgatgctgatggcgggctggtacgagtaccgctggcaacagacgggcgaacaacaatttataacgctggccgatgaaatatggcgccagttgcagactaaaggataagagaggtcagtgtgggtccggtaatgttagatgttgaaggctatgagctggatgccgaagagcgcgaaattctggcgcatccgctggtgggcggtttgatcctgtttacccgcaattatcacgatcccgcccaattgcgcgagctggtgcgccagatccgcgaggcgtcacatcaccgactggtggtggcggtggatcaggaaggcgggcgcgtgcagcgctttaaagagggtttcacgcgactgcccgcggcacagtccttcgccgcgctgctgggaacaaccgagggcggcaggctggcggaagaggctggctggctgatggcaagcgagatgatcgccatggacatcgacatcagctttgcgccggtgctggatgtgggacatatcagcgcggccattggcgaacgctcgtaccatgccgatccggctaccgcgctggcaatggcgacccgttttatcgacggtatgcacagcgccggaatgaagaccaccggcaagcattttccgggacatggcgcggtaagcgcagattcccacaaagagacgccgcgcgatccccgtgatgaagcggagatccgcgccaaagacatgtccgttttccgctcgctgattacggataacaagcttgacgccatcatgccggcgcatgtgatttacagcgaggcggatccgcgtccggcaagcggttcaccctactggctgaaaaccgtgctgcgcggcgagctgggctttaacggcgtgatcttctccgacgacctgtcgatggaaggggcggcgattatgggcagctatgcggagcgcgggcaggcgtcgctggatgccggctgcgatatgatcctggtttgtaataatcgtaaaggcgcggtcagtgttctggataacctgtcgccgatcaaagcagaacgtgttacagagttgtatcataaaggttcatttacgcgtcaggaattgatgtcatccgcgaagtggaaaacggtcagcgccgcgctggaacagctgcacgaacgctggcaggaacataaaacggcgcattaatccatcggtgcgttgcagtgtggtgagggcacaatgatcatctatttacacggttttgactcgaacagtccgggtaatcacgagaaagtattgcagcttcagtttatcgatccggatgtgcggctgctgagctacagcacccgccatccgcggcatgatatgcagcacctgctgaaagaagtggataaaatgttgcagcttaatgtcgatgagcgtccgctgatctgcggcgtcgggctgggcggtttctgggccgagcgtatcggctttctgtgcgatatccggcaggtgatgtttaacccgaatctgtggccgcaggagaatatggaaggcaaaatcgaccgtcctgaagagtacgccgatattgccaccaaatgcgtgactaattttcgcgaaaaaaaccgcgaccgctgtctggcgatcctgtcccgccgggacgaggcgctcgacagccagcgttcggcggcattgctgcaacctttttacgaaatcgtctgggatgaagagcagacgcataagtttaagaatatctccccgcatttgcagcgcatcaaagcctttaaaaccctcggttaatccggcgtacattcttaaaagtcagcttaatcgctgacttttttttcctttactgcggatcacgcttatcttttaagcagcaaaacttgatgtacatcaattttggtatgaccaatgcaccgaacatgctattctcgttaccggtaaggcgttttcctgctggtaacttgttgttaaataaaacttatttttataacttttacttaacaattggttaataattttaagggggtcaccttgactacaccattgaaaaagatcgtgattgtgggcggcggtgcaggcggccttgagctggccactcaactgggtaaaaagctcggacgcggtaaaaaagcgaaaatcacgctcatcgaccgtaaccacagccacctgtggaagccgctgctgcacgaagtggcgaccggctcgctggacgaaggcgtggatgcgctgagttacctggcgcacgcgcgtaaccatcacttccagttccagcttggctccgtgatggatatcaatcgcgaaagtaaaaccctgacgctggctgaactgcgcgacgagaagggcgatctgctggtgccggaacgtaaaatcgcttacgacaccctggtgatggcgttgggcagcacctccaatgatttcaacacgccgggcgtaaaagagcactgtatcttcctcgacaacccgcaccaggcccgtcgtttccatcaggaaatgcttaacctgtttctgaaatactccgccaacctcggtgccagcggcaaggtcaacattgccattgtcggcggcggcgcgaccggcgttgaactgtcagcagagctgcataatgcggtgaaacagctgcacagctacggttacaaagggctgagcaacgaggcgctgaacgtgacgctggtggaagcgggcgagcgtattctgcctgcgttgccgccgcgtatttccagcgccgcgcacaacgaactgactaaaatgggcgtacgcgtcctgacgcagaccatggtcacaagcgccgacagcgaagggctgcacaccaaagacggcgaacatatcaaagctgatctgatggtgtgggcggcagggatcaaagcgccggactttatgaaagagattggtggcctcgaaaccaaccgcattaatcagctggtggttgagcagaccctgcaaaccacccgcgacccggacattttcgccatcggcgactgcgcctcctgcgcccgtccggaagggggctttgtgccgccgcgcgctcaggctgctcaccagatggcgacctgcgcgctgcacaacattctggcgcagatgaagggcaagtcgctgaaagagtatgtctataaagatcatggctcgctggtgtcgctgtcgaacttctccaccgtcggcagtctgatgggtaacctgatgcgcggctcgatgatgattgaaggccgcatggcgcgctttgtatacatctcgctgtaccgtatgcaccaggtggcgctgcatggctatttcaaaaccggcctgatgatggtggtcggcagtattaaccgggtgatccgcccgcgtctgaagctgcactgacagaccatgccccgcttcgcggcgggcgttcagcatatccttctgcccgacagggctatgtggtcagacttctctgaatcaccgcatttccccgcacaataccccgcaaacttcctgaattctgattggcgtacgctgcctttgattgcaaaattgttaccaatagcaaaaaagggagatgatcctgtgaataaatcaatgttagcgggtataggaattggtgtggccgctgctctgggtgtggcagcggttgcaggccttgatgtcttcaaaagcggcccacaatatgcgcaggtcgtctcagccacaccaatcaaagaaacggttaaaacgccgcgtaaagagtgccgtaacgtgacggtaacgcatcgtcgccccgtgcaggatgaaaatcgcctgacagggtcggtgctgggcgctgtcgcaggcggcgtgattggtcaccagtttggcggcggtcgcggtaaagatgtggcaactgttgtcggcgcgctgggcggcggctatgccggtaatcagatccaggggtcactacaggataatgacacctacaccagcacgcagcagcgttgtaaaaccgtgtatgaaaaatcggaaaaaatgctcggttacgacgtcacctacaaaattggtgaccagcagggaaaaattcgtatggataacgatcccggcacgcaaattccgctggatggcaatggccagctgatcctgaacaacaaagcgtaaaaaagaagttctgcattaattgactccccaatcgctcaggctggggagtccttttttatttctgccttataccgcagtatcgcgactctgcttcaccagcagacctgccgtaatcaataccgagacgaaagcgaaaagcactgaactgccgcacaacaaccacagactaaacaacaatgtaattactattagcactttgagtaatggtaatagcaaaaccatttcattttccttctgcatgtgaacagccataaatcgcgtcttcatgacctgcaagcgtctcccgttgtgatactgctaatcattagcagaaaaataatcacaataagaatagcaaagcgaagcggaaaacagaaaggcctgacctattgctgcaaaaggtcaggccaatcaaacgaaagaaggggattacagtcaggatttcagcaattcaggccacagtcgcagggtggtgtgggtgatttgcagcagtttttccatgcaggcgccttcacgcgcgctcacggacatgccctgcagaatacagctcagaaactgtgccagcgcgaccacatcgcggttggccgggatctcgccccgcgcctgtcgctgctgtaaaaacttcaacagcgtctgctcctggagggcgtggcgggatttgatcgtccgggcgatttcgtttgaggaggcggcgagcgtcgcggaggtgtttatcataaagcagcccgccggggtatccttgctggtaaagcaggtggcgacagaggtgaagtagtcccgcagcgcctgctccaggggtttttcctcgcacaacagttgcgcgtcatgctgcgccgtgaagcgagcgatatagcgatcgagcacggcgcggaacagcccctctttgttcgtgaactctgcatacagcgtcggcgctttggcgcctgtcgcctcaaccagatccgctaacgaggtggcctcatacccgtgctgccagaatagcgtcatggctttatcaagcgcggcgtcccggtcgaaggttttcggtcggccacggctttttttagtaccgcaggtcacgtcgttggtcatagcgccgcctgaataatgatgtttgttgaacgatcattataaaaattaccggcaggcattacaaactttgcgcaacctcctgatgttccgtgacatctaccggcattccggaacgaacctgcatcacttcatccatcagcgcggtattcgtttgcgcatcggctttaaaggattccattgcgctgctcagtacaattggctgggttttcggatcgtcgttaatggatttagacagcggctgatgcacctccaccaggcgacggccgtccggctcgacagaggccttgatcggcgtattgatgatgttcactctggtgcccggcgtgacctttttaaacagcgtggcgatatcgccatcccgcagacggatacagccggagctgacgcgcatgccgatgccaaaatctgcgttagtgccgtggatcaggtacacaccgccgtaggccgccagacgtatggcatgatgccccattgggttatccgggcctgccggcaccaccgcaggcagatcgataccctgcgctttatagcgggcgcgaatattcgcggtcggcgtccaggtcggatttgcgcgtttgtccgatacggtagtcaccatggtgggcgttaaggtatcgcctcccagctggccgatgccgatagggtagatcgtcacttcgcttttacccggagggtaatagtaaagacgcagctcggcaaggttaataacaataccctcgcgcggtacgtccggcagcagggtttgcagcggaatggtcagtacgctgcccgcgcgggggacgtaaggatcgacgccggggttcgcctgtaacagcgcaaggaatccgacattgtattttttggcaatcgcttccagcgagccgccatcgttttccacgagatggaagcggttttcaccgaccacccggcttcccgccgcgggcagcggccaggtattggcctgagcgggaagggcgagcgccagagtcgaggcaacggcaataaaagccagccaacgggcaaaacgcgaggttttcattagtatcatcacccacaggtatattcaggttattgttattcaacataaaccttaattatggatggtgggcgtgtcgggaaatgcaggggaagtgcaaagagtttgtaaaggctggcgcaccgcctgaagacggcgcgccagtgagatcaggcgacggcgttttctgccagtttctgcataaactgacgcacccactcgatacgggttttccgctcgccgagatcctggaagaacttcagtcgtgtcggcccgtcgaggcggaaatgctgcggctgcttttgcagcaaaccaatcagccacaccggatccacatgattcttctcggcgaactcaatagtgccgcctttgtcgttaccttcgatcttgcgaatgcccaggtgctgcgcctgttgacgcagtaacgccacctcaagcagggtacgcgccggatccggcagcaggccgaagcgatcgatcatctccaccttaatttcatccagctcgttctcacttttcgcactggccacccgtttgtagaacgacaggcgcgtattcacgtcaggaatgtaatcatccgggatcagcgccggcatacgcagttccacttccgtctgctggctggtgagatcttccagagaaggctcgcgcccggctttcagcgcatcgaccgcgttttccagcatctccatgtacagcgagaagccgatggtttccatctgaccgctctgatcttccccgagcagctccccggcgccgcggatctccagatcgtgggtcgccagcgcaaagcccgcccccagatcttccagcgaggcaatggcttcgaggcgtttctgcgcatcggtggtcatggctttcggatgcggcgtcagcagccacgcataggcctgatgatgcgaacgcccgacgcgcccgcgcagctggtgcagctgcgccaggccaaaatgatcggcccgctcgatgatgatagtgttggcggtgggaatgtcgatcccggtttcgattatggtggtgcacaccagcacgttaaaacgctggtgatggaaatcattcattacgcgctccagctcgcgctcgcgcatctgtccgtgaccgattgtgatacgcgcttccggtaccagatttgccagacgttgcgccgccttctgaatgttttccacatcgttataaagataatacacctggccgccacgcaggatctcacgcagcatggcttcacgtaccaccagatcgtcatactcgcgcacgaaggttttcaccgccagacgacgggcgggcggggtggcgataatcgacagatcgcgcatgccgctcatcgccatattcagcgtgcgcgggatcggcgtcgcggtcagcgtcagaatatcgacgtcggcgcgcatcgctttaatgcgttctttatggcgcacgccaaagcggtgctcttcatcgacgataagcagtcccaggtcacgcatcttcacatcgctttgcagcagcttgtgcgtgccgaccagaatatcaattttaccctcggcgacctgctccaggatctgcgcctgctctttggcgctgcggaagcgggagagcatctcaatgcgcaccggccagttggcgaagcggtcgcggaagttatcatagtgctgttgcgccagcagggtggtcggcaccagcacggccacctgcttgtggttttccaccgcaaggaaggcggcgcgcatcgccacttcggttttgccaaagcccacgtcgccgcacaccagacgatccatcgccagcggctgagacatatcgctgagcaccgcattgatcgcctgcgcctgatccggcgtggtttcaaaggggaaaccttcgcagaacagctgatactgttcacgatcgtgtttgaacgcgaaaccgcttttcgccgcgcgctgggcgtaaatatccagcagttccgccgccacatcgcggactttctccgccgctttctgccgcgcccgtgaccaggcatcgctgccaagtttatgcagcggggcattatcttcagcgccaccggcgtagcggctaatcagatgcagggacgaaaccggcacatagagtttggcgtcaccggcataggtgagcatcaggtattcgcccttgatgccgccagcttccagggtggtcattcccgcatagcgtccgacaccgtgctccagatggacaaccggctggccgggatgcagttcggcgaggttacggatcagcgtatccgggttaatggtgcggcgattatcctggcggcgacgggacacgcgctcgcccagcagatcgccttcacagatcaaggcccggttgcgcagggtgtcgataaagccgcgctccgccgcgccaatgatcagataacgcccgttaccggtcgcttcatccagacgctgaatgcgcttcggcgcgatcttgatgcgtgccagcagttcgcctaacgcctcgcgacgcccctcgctttccaccgagaacactaccgggccgctgaaggattcgataaatttacgcaacgcgtcgagcggcgatttctgctgcgcctgcaccgccagatccggcagcgtctgatagcccagattggtgttggcggctttgtcagccagcttgtcggttttcagctgaatgcgcggccagcctttcagcgcgccgaacagttcgtcagcgcgcagccacaggcgggacggcggcagcagcggtcgcatcggatcgacgccgcggttttcatagcgcgcctgggtgtcgttctggaaacgctccgcgctgctttccagatcgccggtattcacaatcagcgtattcgccgggaaatagctgaacagcgccggcagcggctcgctgaagaacagcggctgccagtattcaataccggtcggcagggtgcctttgctcacctgctgatagatgtgctccgcatcgcgcttcacgtcaaaattatcgcgccactggctgcggaacagctcgatggcagctttatccgtggggaattcgtgggcaggcagcagattgatggcctccacttcctccagcgtgcgctgcgtgtcggcgtcaaacagacgcagactgtcgatttcatcatcaaagaaatcaatacggtaaggctgctcgctgcccatcggatagagatccagcagcgcgccgcgggtggcatattcaccgtgcgccatcacctgatcgacatgccggtaacccgcgttatccagctgcgcgcgcagcgcatcccgtgacagccgctggcctttgttcatcaccagcgcgtgaccgtgcaggaagctgtgcgggcaaacgcgctgcatcagggtgttgaccggcatgatcagcacgccgcgctgcatggcgggaagctggtacagcgtcgacaggcgcgatgagatgatttcctgatgcggcgagaagctgtcgtagggcagcgtttcccagtcggccagattcatcaccagatgatcggtaaactgcctgatttcatcgtgcagacgcagcgcgttttgcatatcgggcgcgatcagtaccaccgggccggtatgacgttcaacgatttcagccacttcggtggcacaggcgctgccagtaagttcgcccagctgacgctggtcgcccgctctggagggcagggcataacggaattgttcaggcatagcggatgtcatgatctcttaagggtacgcccccgatatgggggcatgccactgaaacacaatgcagtttattatcctcgatcatgccattttagcaaaggcaaccgtcaccgggcggctactgccggacgtaaatccaccggcggtgagaagaacagatcgccaaacagacgcgtcgagagtttgcgcaccagcagtcccgccgcggtgcaaatcagcagactgataaagggatacaccagcagcagcgccagttccaccattggcggcagccgcgcctgattaagcagcgggatcagcgccaggctgaagccttcaatcagaatacggtgagtggtgtaaatagcgatagtattagaacccactacattaagcagattgttttcacccggcgggaatcgctgctccagctgcaaaaacagcttcatgatcagcacaatggagaacagtgacagcagcagcggcacgtttttaaaccacagcagcaccgacgccaccagagcgatccccagccacagcgcatagcggcgcagcggcacgtttttaatgatgtccatcaccgccacgccataccacgcgcccaggctgtaatagatcatattgcgcgccacgctgttcagcccccaccagggcagcggcaggaaattaatggcgacggagaggataaccagtaagcccattaccggcgctttccagcgttgcagcgccttgcagagcacgaaatagaccagcagcgcatacagataccacaggctggtgctggcagtaagcataccgtgcaggaagccggtaaaggatccggcataggcggcgttggcggtggcgctgagatcccgctccggcgccagccagtcgtttaacgcgccaatcgccagccactgcaccacgccccacagcgccagcacatagaaaatactccacagccgtttatcgatgcagccttcccactgcacctcttccacataccggcggatcaggtagccggagataaagaaaaacaccggcatacggaagggggcgaggtacaaattaaaatagatccagcacttggacagggtctccgacagcggatgttgcagcccttccaggtgcggataaaacgtaattaccgagtggtaaatcaccaccagacagatacacaaccctttgatctggttaatccatactgctttttgtttcatgcttaccacgtgcctgttatatccaagttcaggcgttaattgtgatgatgagaggagacagcggtaatgcgtaaaggtctggatttggacgggctggcgcaattttcggaacaatattaaacgtaactttgcagccactgcgcgcatttaatggaatagtggtttgatttttcagaactttttaagtgcattcgcgacaattcttcacgtttaagcgatttaccatccccggtttcgcttatatactcccaagtctgctcatagctaccagacggatttcatgtatcaacctgtcgcactattcataggccttcgctatatgcgcgggcgtgcagtcgaccgcttcggtcgctttgtctcctggctttccaccattggcattacgctcggcgtgatggcgctggtaacggtgctatcggtgatgaacggcttcgaacgtgaactgcaaaacaatattctggggctgatgccgcaggccgtgctgagtgccgatcatggctcactggatcctgaaaaagtgccggaaagcgccgcccgtctgccgggcgtcaaccgcaccgcgccgctgaccaccggcgatgtggtgctgcaaagcgcgcgcagtgtatcggtgggcgtcatgcttggcatcgatcctgcgcagaaagatccgcttacgcccttccttgtcaacgtacagcaaaacgatttgcagccgggcaagtacaacatcattctcggcgaacagctggccgggcaactgggcgttaaccgtggcgatcagctgcgcgtaatggtcccttccgccagtcagtttacgccgatggggcgtctgcccagccagcgcctgtttacggtgatcggcaccttcgccgccaacagcgaagtggatggttaccagatgctggtgaacattcaggacgcctcgcgcctgatgcgctatccggcgggaaatatcaccggctggcgtctgtggcttaacgagccgctgaaagtcgacgaactcagccagcaaacgctgccccagggcaccgcatggcacgactggcgcgatcgcaaaggcgaactgttccaggcggtgcgcatggaaaaaaacatgatggggctgctgctgagcctgatcgtcgctgtcgcggcctttaacatcattacctctctcggcctgatggtgatggagaagcagggcgaggtcgccattctgcaaacccagggcctgacgccgcgccagatcatggcggtgtttatggtgcagggcgccagcgccgggatcatcggcgcgctgctcggcgcgctactgggcgcgctgcttgccagccagctcaataatctcatgccgatcattggcgcattgctggatggcgctgcattgccggtggtgatcgagccgttacaggtgatcgttattgcgctggtggcgatggccatcgcgctgctgtccacgctttacccttcctggcgcgccgccgccacccaacccgctgaggctttacgttatgaataagatcctgttgcaatgcgacaacctgtgcaaacgctatcaggaagggaacgtgcaaacggatgtgctgcacgatgtcagcttcagcgtggggcagggcgaaatgatggcgattgtcggcagctccggctccggcaaaagtaccttactgcatctgctgggcggcctggacacccccacctccggcgatgtgatttttgacgatcagcggatgagcaaactatcgtccactgccaaagccgagctgcgtaaccgcgaactgggctttatctatcagtttcaccacctgctgccggactttaccgcccaggaaaacgtggcgatgccgttgctgattggcaaacataaaccggcggaaatcgagcgacgcgcccgggaaatgctggccgccgtggggctggaacaccgtgcgaaacaccggccttccgagctgtccggcggtgagcgtcagcgtgtggctatcgcccgtgcgctggtgaatagaccgcgactggtgctggcggatgagccgaccggtaaccttgatgcgcgcaatgccgacagtatttttgccctgttgggtgagctgaatcagacgcagggcacggcctttctggtggtaacgcacgacctgcaactggcgcgtcgtatgacccgccagctcgaaatgcgcgatggccgcctgactgctgacctgacgctgatgggagcgcagtaatggcctcgcctttatcccttctgattgggctgcggttcagccgcggccgccgccgcagcggcatggtatcgctgatttcggtgatctcaaccgtcggtatcgcgctgggcgtggcggtgctgatcgtcggcctcagcgccatgaacggcttcgagcgcgaactgaataaccgcattctggcggtggtgccgcacggtgaaatcgaagcggttaaccagccgtggaataactggaccgaggcgctgacaaaagtcgaaaaagtgcctggcatcgtggccgccgccccttatattaactttaccgggctggtggagagcggcgctaacctgcgcgccatccaggtgaaaggcgtcgatccgcagcaggaaacgcggctcagcgcgttgccacgctttgtgcagaacaacgcctggtctggctttaaagccggtgaacagcagatcatcatcggtaagggcgtcgccgacgcgctgaaggtgaagcagggcgactgggtgtcgatcatgatcccgaacgccagcgccgatcacaaactgcaacagccgaagcgcgtgcgtctgcacgtcagtggtattttgcagttgagcggtcagctcgaccacagctttgccatgatcccgatgaaggatgcgcagcagtatctggatatgggtgacagtgtcacgggcatcgccctgaaagtgaacgatgtctttaacgcgcaaaaactggtgcgcgacgcaggagaggtgaccaacagctacgtttatatcaaaagctggatcggcacctatggctatatgtaccgggacattcagatgatccgcgccattatgtatctggcgatggtgctggtgatcggcgtcgcctgtttcaatatcgtctccaccctggtgatggcggtaaaagacaagagcggggacatcgcggtgctgcgtacgctgggggcgaaagacggcctgatccgcgccattttcgtctggtatggtctgctggccgggctgttcggcagcctgtgtggggtggtcatcggcgtactggtgtcgctgaatctcacgccgatcatgaatggcctcgaacgtcttatcggccatcagttcctctccggcgacatctattttattgatttcctgccgtcagagctgcatgcgctggatgtggtgtacgtgctggttacggcgctggtgctgagcctgctcgccagctggtatccggcccgtcgcgccagcaacatcgatccggcgagggtgctgagcggccaataaccaacaaggagtggcgatgtattacggatttgatattggtggtacaaaaattgcgatgggcgttttcgacgctgaccggcggttatgccatgaaacccgtgtcgccacgccccgtgaaggttatgacgcttttcttaaagcggtaacgtcgctggtgctggaagccgatgaacgctatggcgtcaaaggctccgtcggcatcggcatccccggcatgccggaaaccgcagacggcacgctgtacgccgccaacgttccggccgccagcggtaaacccctgcgcgcggatctctcggcgctgctggcgcgtgatgtccgtctggataacgacgccaactgctttgcgctgtcggaagcctgggacgatgaatttaagcaatacccgctggtgatggggctgatcctcggcaccggcgttggcggcggtctggtgctgaacggcaaatccattacaggacgcagctatatcgccggtgagttcgggcatatccgtctgacggtggatgcctttgatgtggtcggcttcgacttcccgctgacccgctgcggctgcggcaaactcggctgtattgagaactatctttccggtcgcggctttgcatggttgtaccaacacttctacgatcaatccttatcctccccggaaattatcgcgctctatgagcagggggatgccagggcgcgcgcccatgtggcgcgctacgcggatctgctcgcggtgtgccttggcaatatactgacgattgtggatcccgatttgctggtgataggcggagggttatcgaatttttctgcgctgaccacccttatcgccgaccgcttaccgccgcatctgctgcccgttgcccggctgccgcgtattgaacgcgcgcgtcatggcgatgccggtgggatgcgcggagcggccttccttcacctcaccgactagcctaaagaggttgctatgcagtcgcgccggttacatcgtctaagccgttttcgccgtaacaaacgtcgtctgcatgagcgtttacgccagcgaatttttttcagagacagagtggtgcccgaagtgatggaaaaaccgagagtggtggtactgaccggagcggggatctccgccgagtcaggcattcgcaccttccgcgcggccgatggcctgtgggaagaacatcatgtcgaagacgtggccacgccggaagggtttgcccgcgatccggcgctggtgcagtcgttttataacgcccgccgtcggcagctgcagctgccggagatcgcgcccaacgccgcgcatctggccctggcagagcttgaagccgcgctgggcgatcgttttctgctggtgacgcagaatatcgataacctgcatgagcgcgccggcaataaaaacgtgctgcacatgcacggcgaactgctgaaagtgcgctgcactaccagtggccaggtgctggagtggaccggagatatcacgccggaagacaaatgccactgctgccagttcccgtccaccttacgcccgcacgtggtgtggttcggcgaaatgccgctggggatggatgagatttacagcgcactggcgatggccgacgtgtttatcgccatcggcacctccgggcatgtctaccctgcggcgggatttgtgcatgaggcgcgtttgcaaggggcgcacacggtggagcttaatctggagccaagccaggtcggcagcgaatttgaagagaagcattacgggctggcaagcgtggtggtgccggagtatgtggacaagctattgaaaggtttgtgagatggtgcagcctctccctgcgggagaggctggagaaggttatcgcccggctttcagcttctggtaatactcttcataaatggcgctggcggcgccgacatcgttctgccattcgcctttactgatagtatctgcatccggatacagcgatttgtcgttcgccacgtccggggccagcagcttacgcgccgccaggttcggcgtcgggtagccgatggtttccgccacctgcttcgccacgtccggacgcagcaggaagttgattaacttcagcgcgccctcgacgtttttcgcgttagccgggatcgccaggctgtccatccagaaaatcccgccttctttcggccagacgatctgcaatggtgtgccggactgacgggcaacataagctgagccattccagaccatacccagattcacttcgccttccatgtacgggttcgccggattatccgagttgaacgccgccacgtttggcatcagttttttcagctcctgataggccgcttcgatctcttttggatcggtggtgttgccggacagtcccagtttacgcagcgccacctggaacacctcgcgggcatcgtcggtcagcagcaggctacttttgtattccggtttccacagatcgccccagccggtgatggtggcgggatcgatagcctcgctgttcacgccaatggcggtcgcgccccagatatagggaatggaatagtcgttctgcggatcgaagggcttgttcagcatgtccggatcgagattatggaagttggtgagcttcgttttatcgatcttctggatcatgccctctttgcgcattttatcgacgaaataggtggagggcaccaccagatcgtacgcgccgtctttataggttttgagcttggcatacatggtttcattcgactcataggtcgaatagatcaccttgatccccgtctctttggtgaactgttccagcaggcctggcggcacgtactcggtccagttgtagaagtaaagcgtattgttgtccgcgtgagcagcgctcattcccattgccagagcgcccgcagcgagcaggtggcgtgaccatttgatcattttaacgtcccctgagatttggttttatcacgtgcaataagctggctggcgatcaccagaaccagcgagagtactaacagaatagtcgccagcgcgttcacttccggtgacacgccgactttcaccattgaatagatcttcagtggcagaatttcatagccaggcccggtgacgaaagacgaaacgaccacgtcatccatcgacagggtaaagctcagcacccagccagccgccaccgcaggcattgccagcggcagaatgattttgcgcagaatggtcacttcgctggcaccgagatccttcgccgcctccagcatccgcacatcaaaccctttcagccgcgaatagacggtgaccaccacaaacggcaggcagaaagtgatgtgggaaaacagcagcgaccagaagcccagctgaatgccgataagcataaagagcaccagcagcgaaatggccatcacgatgtccggcgacatcattaccacaaacagcatgccgctgacgaaaggcttgccgcgaaaacggtaacgatagagcgccaccgccgtcagggagccaatcagcgtggcaaaggtagccgacagcaccgccatggtcagcgagtggcgggcggcctgtaacaggctgtcattgttcatcaacaggctgtaccagtcggtggtgaagccctgccagttgatgccgaagcgcgcctggttgaaggaattgacgatcagaataatgatcggaatataaagataagcgtaaatggcggtcataaaaccgccgcgcagcaggcgaccgatcattccagctccacctttttattcagaaaacgcatcgcccgccagtaaaccagcagcatcaggcccatcaccaccgtcagcgtaatgctggtggcggagccgaacggccagtcgcgaatgttcaggaactggcttttaataacgttaccaatcagcaggtttttcgcgccgcccatcagatccgagacgtaaaacagccccatcgccggaagcatcaccagcagacagcctgcgataatgcccggcatggtcagcggaataataatgcggataaaggtttgcaacttactggcgcccagatcgcgggcggcctccagcagcggtttgtcgagtttttcaatgctcgaccacagcggcatcaccataaagggcagcaggatatacaccagcccgatgatcaccgcgcccggcgtgaacatgatacgcagcggcgtatcaatgacgcccagccacagcagaaacgcattcagatagcctttggtgctgagaaacagtttcaggccataaatgcggatcagggagttggtccagaaaggcacgatcagcaaaaacagcagcagcgggcgcaccttctgcggcagcttggccagaaaccaggcaaagggatagccgagcgcgaggcaggcgagggtggcgatcaacgccatattcagcgagtgcaacagcacatcgaaatagagcggatcgagcagacgcgaatagttgtccagcgtaaacaccagactgacaaaggaggcgtcatcgcgggttaaaaaactggtgacgatgatcatcaggttgggcagaaaaacaaacagcaccagccagccgacgacggtcgcgatcaccacattctggaatttactggtgctcttcatcaggcagtacgacctcccagctttccacccagttgatggccatcttttgatccagcgagtggtcaaaatccggatcgtcttcgttaaagaattcgctgaccatcaccattttgccgttttccagctccaccaccgactccagcgtcatacctttgtaattgcgctcgcgaacaaagccaatcagaccgtccacctcgcggctgtcgttgatctcctccacgcgcagatcttccgggcgcagcatcacgttcaggcgctggcctttttctaccgggaaatggacgtggatattgcattcgcggccttcgacgctggcgcgcacgcgctgttcgtccagacgttcgatcaccgtggcgttgaacaggttgatctcgccgatgaagcttgcgacaaacaggttttttggctcttcgtagatttcacgcggtgtgccgtcctgctcgatcttaccctcgcgcatcaccacgatgcggtcggacatggtcagcgcttcttcctgatcgtgggtgacgaacacaaaagtgatgcccagtttacgttgcagggctttcagttcgttctgcatctgtttgcgcagtttgtaatccagcgcggagagggattcatcgagcagcaacaggcgcggtttattgaccaccgcacgggcgatggcgacacgttgctgttgcccgccggatagctgatgcggtttacgttcggcgaagctgtccagttgcaccatgcgcagggcttcggtcacgcggggagtaatttgatcggctggcgttttttgcattcgcaggccaaaggcgacgttttcaaaaaccgtcatatgcgggaaaagcgcgtagctttgaaaaaccgtattgacgtggcggtgttcagccggaacctgggtgatgtcctgatcttcgagatggatatgaccggcatcgacattttccagtccggcaatcaggcgcagcactgtggttttaccgcagccagaggggccaagcagtgtcagaaattcgccattattgatggtgagattaagatcggaaatgacatttttaccatcaaagcttttccgaatccccgccaggtgcaccagcggcgaaagcgaacgcgtttgtgtattcaattttttactctgtcccgtgtagacgcaatggatggcttaccattgcggggtttgtgattaaccaccttagggtttgacacattaatgaggcctggcattctacggcaaaccactgaaatcgccaatccttgtgagatattccctttcagaggtggaatttctcaaccatgcttaggtctggggtcgcgaaagctaaaaaattctcgtttgcacgggtaaaagtgacctgacgcaatatttctgttttcacgcttatcaataatgttgtctcaaatagtgagggtggcccgcatggataaattactagagcgttttttgcactatgtttcgctggatacacaatcaaaaccgggcgtcagacaggttcccagtaccgaagggcaatggaagctgttgcagctgctgaaagatcagctggaagaaatggggcttgttaacgtcaccctgagcgaaaaaggcacggtgatggcgtccctgccggctaacgtgccgggcgatattccggccattggttttatttcccatgtcgatacctcgcccgatttcaccggtaaaaacgtcaatccgcagattgtcgagaactatcgcggcggcgatattgctcttggcgtgggcgatgaagtgttatccccggtgatgttcccggtgctgcatcagctgctgggccagacgctcatcaccaccgacggcaaaaccctgcttggggccgatgacaaagcgggcgtggcggagatcatgaccgcgctgtcggtgctgattaataaaaacattcgtcacggtgatattcgcgtggccttcacgccggatgaagaggtgggtaaaggcgcgaagcacttcgacgtcgaagcctttgacgcccgctgggcctataccattgacggcggcggcgtgggcgagctggagtttgaaaactttaacgcggcatcggtaaccatcaaaatcgtcggcaacaacgtacatcccggtacggcgaaaggggtaatggtcaatgccctctctctggcgagccgcattcatgcagaagtgccgcccgcggaaagcccggagcagacggaagggtatgagggtttctatcacctgaccagcatcaaagggacggtggatcgcgccgagatgcactacatcatccgcgattttgaccgccaggcttttgaggcgcgcaaacgtaagatgatggagatcgccaaaaaggtcggcaaagggctgcacccggattgttacattgaactggtgatcgaagacagctattacaatatgcgcgagaaagtcgccgagtttccgcacatcatcgacattgcgcagcaggcaatgcgcgattgcgatatcgaacctatcatgaaacccattcgcggcggcaccgacggtgcacagttgtcctttatgggattgccctgcccgaacatcttcaccggcggctataactaccacggcaagcatgaattcgtgacgctggaaggcatggaaaaagcggtgaaagtgatcgtgcgtattgcggagttaacggcgaaaagccattaacaccggattgggacgaccataccgttgtaggcccggtaagcgcagcgccaccgggcatcacaattcccccaggtaaaggattaccccatgtcaaattatcgtcggcattacatccccggtggcagctggttttttaccgttaacctgaaaaaccgacaaagcgatctactgattcgtcacattgctctgctgcgccgcgcaacgtcctttgttaaacatcacaaaccctttcatattgacgcctgggtgatcctgcccgagcacatgcactgcatctggacgctgccggaaaacgacagcgatttttccggccgctggcgggatcttaagaaaatgtttacccgttcgctgaacagccgcgatatctggcaaccgcgattctgggagcatacattgcgggacgaggaggatttccggcggcatcgggattacatcaatattaacccggtgaagcatggctgggtggtgcgggtgagcgactggccgtattcaacttttcatcgtgatgtgcgggacggcatttatccgctggactgggcgggtgagatagcggatttgtccgcgggggaacggcgggaagagtagtaccgccgggcggcgctgcgcttgcccggcctacgttcgaccataccgttgtaggcccggtaagcgcagcgccaccgggcatcatattcacatcttaatcttcaaagaaccagtagccgctgttcaccagcgccgcgagcatcgcgaggaaagagggatcttccagcgcgtcgcccagcgtgtcggcggtgatcaccatcttgctggcaagcgctgccagcgccggacggtgcggcgactcgatcttctcgccattggcaaagacatcatccccaatgcgcaacacccgtaagccgcccagacgcaccagtttatcgccctgttgcagcgcatcgtagatctcatccggctgatacggcggttccggcggcgcgacgtccagctcgtgacgcgactgggaaataaactcgccaaaccactgctggaaatgctccggctgattgatcagatcgagcatggtagcgcgcacacgatccagctcctgcggcagaatgtctgccgggtgttcgcgggacggcacgtcaggatcggtgtaacgaagcccacccagttcccgttgcagcacataatcggcaaagccgctgatcagctcgcggccactcggcgcgcggaagcccaccgaatagttcatcgaattttccagcgaatagccttcgtgcgggaatcccggcgggatatagagaatatcgcccggctccatctcttcatcgatgatggcatcgaacggatcgacctgtaacagatccggatgcgggcagtgctgtttcatcggcactttctcgcccacccgccagcggcggcggccggtaccctgaataataaacacgtcatactgatcgaaatgcgggcccacgccgccgccgggcacggagaaggagatcatcaaatcgtcaatacgccagtcaggcagcgtacggaaggggcgcatcagcgccgcggttggctggtgccagtgatccaccgcctgtaccagcagcgaccagttggtttcgccgaggtgatcgtagctctcaaacggaccatggctgacctgccatttcccctcctgatggctcaccaggcggctgtccacttcgctttccatagccagtcccgccagttcgtccggcgaaagtggatcgacaaaatttgcaaaaccccgcttcagcaccacagggcgtttttgccagtagcgtgcgatgaagtcgggccagtctaacgttaaatggtagtccatataattttccagggcttacgtacctgaaacggattataacggaaggatgacaggctgcgtgcagcggcagcgcttattttctgcggatgctctaattatcagcggatatgagctgctggcgggcaaaaatcacttccatgcgcgcgccgccgagcagactttcccccgccaggatcttaccgtcatactgctcgacgatttcgcgggctaccgacaggcccacgccctggccgggacgcagcgtatctgcccgctggccgcggtcaaataccatgtcacgcttgctggcgggaatgccgggaccgtcgtcttccacgatgatatgcagccgatcatcgtgctgatgcgccgaaacctccacgaactccagacaatatttacaggcgttatccagcacgttgcccatgacttccataaaatccgtctgctcgccgacaaagctgatctccggcgaaatatcgaggctgatatccacgcctttacgctggtaaaccttattcagcgccgaggtgagattatccagcagcggggcgaccgggtgtaattcacggctcagcaacatattgccgctgcgcatactggcgcgatgcaggtaatagccgatctgctgcgaaatgcggctgatctgctcaagcatcaccggttccgcttcgctgaccgtcagcttttcgctgcgcaacgagcgcagggtgctctgcagcactgccagcggcgttttcaggctgtgggtgaggtcggtcagggtggtgcggtatttgtcatagcgatcccgctcgcttttcagcagacggttgagattgctcaccaggctggtcagctcgcgggtggtttccgggttcagccgttcccgatggtgctcttccagctcgcgtacctcgcccgccagcgcttcgatggggcgcaggctccaccaggccgcgatccacagcagcgggatcaccagcaacaggtttgcggccagcacataaataaaccagctccacaccatataggagcgcttaagctcaatgggaatggtgtcgatcaccacaatggttaactgcggcatacggggcgtggcgggatagacgttaatcgccaccgagtgcgtcatttcgctgtcgctgtcatcctcacggatcgcctggagacgttgttgcgcatcgtggtcgctgctcagcagcagacgcgaagcatccacatccgcttcgatttcatgaaagccgttagcctgtaaccattccggacgaatacgtttgataagccagggcacctcgcgctgagcccacagcagtttgccgtggcggtcgtagatcagcgccatggacgggctttgcagattgagattttcagggatctcaatgctgaactgattattttcccagcgggagagggtatagaacagattgctttcgccgcgtagcaggcggaaggtggttttatcgaagctgacgctgtaacccaccagcgccaccatgccgtaggccagcgacagcaccatcaccacggcggcggtagccagcagaaaacgtacccgcagcgagagcggtaaaaggcgacgcagcagttttctcattcgcgcagttcgaacaggtagccctgaccgcgaacggtagtgatcacatcctccgggtactgcacctgaattttcttgcgcagacggcccatcagcacgtcgatggtgtggctttcgcgcagctccgcatcggggtacagctgcaacatcagcgaatctttgctcaccactttgccgctgttgcggatcagcgtttccataatggtgtattcaaaggcggtaagtttgatcacttcgccattcaccgacagctcacggcgggagagatccacctggaaaggcggcatggagatcacctgcgacgccagcccgctgttacggcgcatcagcgcctgcatccgcgccgccacttcttcaatatgaaacggcttggtgacatagtcatccgcgccggcgctcagcacttcaactttatcctgccagccttcgcgggcggtcagcaccagtaccggcagcgacacttcattgctgcgccagcggcggatcagcgacagtccgtcttcatccggcaggccgaggtccaccagcgcaatatcgggaatatgctcgtttaaatagtaatccgcttcttttgcatcttcggcatcgtcaacctgatggcccagttcctgaagctgaactttaagatggtgacgcagaagggcattgtcttccacaacgagtacgcgcattgtctggcctcgcttttgtctttgataagatgagtttaacgcggattatgttacgcaaggcataaacatttactaaacagccccctttccgggcgggaagggggcgaagggcagggaaattacttcagctcatcaaccatggtgacggcacgaccgatgtaattggccggggtcatggctttcagacgggttttctcgtcttccggcagttcgaggctgtcgataaactgcttcatgccttcagcgtccacgcgtttgccgcgggtcagctctttgagtttttcatacggcttctcgataccgtaacgacgcatcaccgtctggatcggctctgccagcacttcccagttatgatccagctcgtccagcaggcgctcgcggttcacttccagtttgctcacgcctttcagcgtcgactgataggcgatcaacgcatagccgatacccacgccgaggttacgcagtacggtggagtcggtcagatcgcgctgccagcgggacaccggcagtttgctcgccagatgctgcaacagcgcgttagacaggcccaggttgccttcggagttttcgaagtcaatcgggttcactttatgcggcatggtggaggaaccgatttcaccggcgatggttttctgtttgaagtggttcagcgccacgtagccccacacatcacggtcgaaatcgatcaggatggtgttaaagcgggcgatacagtcaaacagctcggcaatgtagtcgtgcggctcgatctgcgtggtgtacgggttccactgaatgcccagcgaggtcacgaactcttcgctgaactggtgccagtcaacttccggataggcggcaatgtgggcattgtagttacccaccgcgccgttgattttgccaaggatctccacctgcgtgagctggcggtactgacgctccatacggtaggcgacgttcgccatctctttacccatggttgacggcgtggccggctggccgtgggtgcgtgacagcaacgggatatcacgatactgcaccgccaggtctttcaccgcgtcgatcagtttacgccagtatggcagcaccacttcttcacgggcggtttgcagcatcagggcgtgagacaggttattaatgtcttccgaggtacaggcgaagtgaatgaactcagacacggcatgcagttcagggatatccgccactttctctttcagaaaatattccaccgcttttacgtcgtgattggtggtgcgttcgatggttttaatgcgcgcggcatcggcttcattaaattcagcgacgattttatcaaggtaaccgtttgcgtcggcagcaaaagctggaacttccttgacagctgcatgcgcggccagcttttgcagccagcgaacttctacctgtacacgaaacttcagcaaaccgtattcgctgaaaatcccgcgcagcgcgctgactttatcgccgtagcgtccatcgacaggggatacagcggtcagtgaggataattccataggtcacaactccgggagttaacaatgagcaagaatttgtttagcctgcgtggacaggcgattacgggaaaacattaattgcagacggccgccgccaacctggtgccacagcaccgcggcacggatcccggccagcagggcagcgcgcactttcgcctgcacctgcgaactttgcagcaccgccggggaaccggtaacctgaatgcgcgggccgaggggactgatcacgtccacatagatagcggccatgctgctcagcagggtgtcggactgcaaatcgaaatgatcgagctggcgctgtaagccgtcgatgcggcttcccagcgtgtccatcgcgcctttactggcggccagtttacgctccagcaccatcaggctcagggtatagcgcgtcagttccgcattcagtccctgacggctgccggcattcagcacgccgagcagggtttcaaggccgaggcgcaggttggcttcgctgccgccaaatacgccgagcgtggagtccgggcttaaatcaatcacgctgttgagcgacacatgcagcgcgtcggcatcgcaatgcccgtgatgtgcaagctcctgcaccaggcgggctgactggcaaattcccgccagcgctatcgtgatgtcataataattttttgccaccttgtctccttactttcgctttaatcaggcgttaaacgggcagcggcagacgctgctcaatgatgccgccgccaaggcacacgtcgcccaggtaaaataccgcggactggccaggggtaacggcagcaacaggttcgtcaaagcgaacgtcaatcctgtcttcatccagcgccgtcaccgtgcagggaatatccgtctggcgatagcgcgttttaacggtgcagtgcagcgtgccggttaacggctgacgatccacccagtgcagctgttgggcaatcagacccaccgacatcagacgcggatgatcgtggccctgagcgacaatcagcacgttgttttcaacgtccttgtcgaccacgtaccacggatcttcgctgccttctttggtgccgccaatgcccagacctttacgctgacccagcgtgtgatacatcaggccctggtgctcgccgatggtgtcaccgtcgacggtcacgatcttgcccggctgggcaggcagataacggccaaggaattcgcggaatttgcgctcaccgataaagcagataccggtggagtcttttttcttcgcggtgatcagccccagctcttcagcgatctgacgcacctgcggtttttccagctcgcccaccgggaacaggctttgcgcgatctgttcgtggccgagggtgtagaggaaatagctctgatctttgttgccatccagacctcgcagcagacggcttttgccatcgacatccgcgcgacgcacgtagtggccggtggcgatataatccgcgcccaggtcttcagcggcaaattcgaggaaggctttaaatttgatctctttgttgcacagaatatccgggttcggagtgcgcccggctttatattccgccaggaaatgctcgaacacgttatcccagtattctgcggcaaagtttacggtatgcagctcgatgccgagtttgtcgcacaccgcctgcgcatcggcaagatcggcggcggcagtgcagtattcctcgccgtcatcttcttcccagttcttcatgaacaggccttccactttgtagccctgttgttgtaacaggtaagcagagacggaagagtcgacaccgccggacatgccgacgatcactttttttgggctatcagacatagaatactcacgacattgaacttcaaggcggcgtattctatcacgcgttagcgactcaggcatcccctgtaaacggccagttaaattcaccgatcagcgccagcgggtggcgctgcccggtctgccagctacgaatactttccgcaaccagcggggagcgcaggttgtcggcggtgaggatctcctctgcgctgacccacaggcagcggtcaatatcgctgtcatggggttcagtagcgcacagagtgtcaagttcaatggcgaaaagaaaacgcaggaaaggcgtgcggtcaggggcgatccactgatgcatgcggataaagtgctgcgggtcggcaacgatgccggtttcttcatagagttcgcgttttgccgcctgcaccagggtttcatcggcttccagatgcccggcgggctggttccaggtggccttgcccctgactttttcttccaccactaaaaatttgccctgcgcatggacgacgcaggcgacggtaacatgtggtttaaacatagtgttgtccttattcggtggcgtcgcgccactcgccattagcaagagaatccagcgtgtatccacccatcgcataacggatcagccgcagcgtggggtggcccacatgggcagtcatacgacgcacctgacggttacggccttcatagagagtgattttgagccagctggtgggaatggctttacgctcgcggatcggcggattacgcggccacagccattcaggctcagccactaactccacgcctgcggccagggtagggccatcgttaagcgtcacgccgttgcgcagcgcggccagcgcctcgtcattcggttcgccttcaatctgtacataatagattttgccggtgcgtttaccgggttgcgtcagctgcgcctgaagcgcgccatcattggtcagcaccagtaacccttcgctgtcgcgatcgagacgaccggcggcatagacgcccgccaccggaacaaaatccttcagcgtgcggcgtccggcttcgtcggtgaactggggcaacacatcgtagggtttattgaacaggatgacccgtttcggcccgctttctgtagggcgcttagcagtatgtcgtgagctgaatcgcttaacccggtgatttctattagaagttttcagcatggtattttcagaagttatcaattgccgcattataaccgaagaacgagtgcctttcatgaaacccaacaatcagttagtattgacaggctcattacaattcattaacaaaaaatcagtcataaccagaagcgctcgaaggagaggtgaatggaaagcaaagtagttgttccgacggaaggtcagaagatcaccctgcaaaacggcaaactcaacgttcccaataatccgattattccgttcatcgaaggcgatgggatcggtgtggacgtgaccccgcctatgctgaaggtggttaatgccgctgtggaaaaagcctacaaaggtgagcgtaagatttcctggatggaaatttacaccggtgaaaaatccacccagatttatggccaggacgtctggctgccaaaagagacccttgatctgatccgcgaataccgcgtggcgatcaaaggcccgctgaccaccccggtaggcggcggcattcgctccctgaacgtggccctgcgccaggagctggatctgtacgtgtgcctgcgtccggtacgttattatgaaggcgtgccaagcccggttaaacgtcctgacctgaccgacatggttatcttccgcgaaaacgctgaagacatctatgccggtatcgaatggaaagcagacagcgccgaagctgaaaaagtcatcaaattcctgcgcgacgaaatgggcgtgaagaaaatccgcttcccggaacattgtggtatcggtgtgaaaccgtgttctgaagaagggaccaaacgtctggtgcgtgcagcgatccagtatgcgatcaccaacgatcgcgactctgtgaccctggttcacaaaggcaacatcatgaagttcaccgaaggcgctttcaaagactggggctaccagctggcgaaagaagaattcggcggcgagctgatcgacggcggcccgtggcagaaaatcaagaacccgaacaccggcaaagaaatcatcattaaagatgtgattgccgatgcgttcctgcaacagatcctgctgcgtccggctgaatacgacgttatcgcctgtatgaacctgaacggcgactacatctctgatgcgctggcagcccaggtgggtggtatcggtatcgcgccgggcgcgaacatcggcgacgaatgcgccctgttcgaagcgacccacggtactgcgccgaaatacgcaggccaggacaaagtgaacccaggttccgtgatcctgtccgctgaaatgatgctgcgtcacatggaatggttcgaagccgcagacctgatcgtcaaaggtatggaaggcgcgattgctgccaaaaccgtaacttatgacttcgaacgtttgatggaaggcgctaaactgctgaaatgttcagagtttggtgacgcgattatcagccacatgtaattcgccaggcgggttatatgcacaacgggagccgaaaggctcccgtttttttttgccacaaataaaacatcactattgagcagcgttgcgtctgcggcggcaataaaaaaacattacaaaggttgaaaaaattatttgtcggcacgcttgaaaaaccgccagcagatattatttttaatcacggacaagcaatgcttgcctgaacattaaacttttgaacaggaattcgggagattaatcatggcactcagaactttgtcagcatttccaacattagctgattccctcttttccgatcgctttaaccgtatcgacaggctgttcagccagcttaccggtgatacgccggtggcggcagccccgtcctacgacgtgaaaaaacgggatgccaaccactatattatttcggtaagcgtgcccggctggaaggagagcgaactggaaattgaaacggtcagtggaaacctgacaatttccggtaaacgtgaagaagagtcctccagcgaacaggagagctggatccatcgcggcatctatcggcaggatttccagctgagtttctctctgccggaacatgccaaagtcagtaacgccagcctggcggacggggtgctgacgttagatattcatcaggaaatccctgagagtgaaaaaccgaaaaaaatcgccatcggaaacaatcaaaaagtgctcgaacacaaagcgtaattgttagccttgtttttacgttggcccgctaatgcgggcctttttttcgccgctttaatggctttaaaacccgtcattttctgatttctggacgccatcagggaagataacctaagctttataacaggttaatcttagttagatgagagttctggcatctgatgtgtgcggaacagtattaaaggagtagcaagcgatgaaacaagaagaactgacacgtaaagctgaagaagagatttccgcgctgatagctaaaaaaatcgctgagatcaggaagaaaaccgagaaagaggtttctgagatagaatttgttccccgcgagacgatgaccggactcgaaggttatgacgttaaaataaagctgctgtgagctgcagccaacgacgccacaggaattgccgtaataacgggaacataccgttcccgtttattatttaaccggctcaattaattccgtcccctggtttctgatattgcccaccgcacgggtaaccggatgccagataaattcttccgccggtatcgcaccatcagcggcaatatcactggcttcgctgccgctaatctcctggcgcatccactccctggccgcgtctggcgttaacaccagcggtcgacggtcatgaatatccaccagccctttatccgccgctgcggtgacaatcaaaaagccttccgcttcatcgccgcgctcaaagggcgtgctgccgatggcggccataaagattggctgaccattagcacgatgaataaaataaggctgttttctatcgccttcttttttccattcaaaccagccgtccgcaaagcagatcgcccggccatgcagccagagcggtttaaacattctgctggtggctgcggtttcgacacgggcattaataagcggcgctttgctccaccagccgggcgcgtacgaccacagcacaggatcgagatagagcttttcgtcgcgctcgctcatcagtaaaacctttgttcccggcgcgacgttataacgacctataggttgtggatcgaaggcaatgtcgcgctccgtttcctccaccagaaaggcgaggtactcttcccggctctgtgcctgggcaaatcttccgcacataaacttctccggtgataacaacgtgcccggcggcgctggcttgccgggcctgattaaatacaaaacaaacaccccggctcagggccggggcgtttatttttaaatatcagtgtgcgcctcagaaccagtggtatttggacgatagcgtcataaccagtgcggcagcggcaagcaaattaagaagaacggcagttctgctggaaatattcatcttcgcatccttcacgtgacaacgtggatgttggtaatacagtaaggccaaaacaacttccctgagtgtagtgaggactgacgattttgcctcgtcaaatagtcttattttttgtcggaaaagaattttcggacaagtttgatgactatcaatcttcagaggcgtcagattcgtcttatctgttatcatcaccggcgcctgaaattacataaaacggagaacagacgtgaccatttttgacaccctgctggcgtacagtcttgccgccacgttactgacgctgacccccggtctggatacggcgctaattctgcgcacggcctccgtcgagggaaaaagagcggcgtttaacgcggctatgggtattaacgtaggttgttttatctggggagcgatggtggcctttggcctcggcgccctgattgcggtgtcggaactggcgtacaacatccttaagtattgcggcgcagcctatctttgctggctggggatctctatgttgctgcgtccgggtagcggtttacccgtcagcgaaagtggcaaaaccacgcataactggtttctgaaaggtatgctggggaatgtgctgaatccgaagatgggtgtgttttatgtctcgttcctgccgcagtttattccccacggacagccgctcattgcctggaccttcgggctggtggcgatccatgtaatgatcggtatgagctggtcaacaacgctgatcctggcaacgcgtccgctggcgagcttcctgaagcgcgaaaaggtttcccgctggatggatcgcagcacaggcacgctgtttattctgtttgccactaagctggcgctgagtaagcgctaagcaaaaacgggcgcgcgatgcgcccgttcctgacattatgctgcgctatcacgcagcttaaacacctgcaccatctccagcagcctgtgcgcctgatcctgcatggcgtgcgccgcggcagaagactcctgcgacagcgtggcgttctgctgcgtggcggtgtccatatgcgtcattgcgatatgcacctggtcgatccccacgctctgctcattgctggcaattgaaatggtgtccaccagttggctcacgcgctcgacgctgcgcacgatctcctgcattgcgctaccggcgttattcaccagtttattgccgtcgctgatccgatttaccgagcgttcgattagctcaccgatctctctggcggcagtagcagagcgctgcgccagggcgcgcacttcgctcgccaccaccgcaaaaccccgcccctgattgccagcccgcgccgcttccactgccgcattgagcgccagaatgttcgtctggaaggcgatgctgtcaatcacgccgataatgctgctgatctcgctggcgagcaggttaatatcgcgcatggtatccaccactttctccaccacgttaccaccctggcctgcggtggcgcaggcttcgcgggtcagggtgctggcgatgcgcgagttctcggtgttgtttttcaccaccgaagtcagctgttccatcgacgccacggtctgctccagcgcgctggcctgcgcttcattgcgggccgacagctccaggctaccggtggcgatctgcttcgaggcgctggcgatagtctcggtgccattgcgcacgccgttgacgataccggtcaggttatcgttcatctcccgcagggcgcgcatcagcagggcggtttcatcgcgtccgctgacggcgatagtggtttgcaaatcgccggcggccacgcggcgcgccacggatacggcctgcgccagcggacgagtaatgctgcgtaccagccaccaggtgatcatcagaccggctatcagcgtcagggccatcgccagcaacaacagatatttagtttgctgatacagcgccatgttgcgatcgtgcgtctgctggcggatgcgatctgcctgtttgagcgtggcggctaccgtctcgtcgatcatgcgcgtcggttcccgatcaatgccggacaccagcttatccacccgctgcgcgctggaaggatcctggatatcgtactgggtcagcgcagcgagataatgcgcctcaagctcgctatgcagctggcgggttcgttccaccagcccggtatccagcccgatttgcggcagcagggtagcaagttccgtcagcagcgcctgggttttctggctctgggcgacaaatgcatttttatatttatcgaagctgtcctgtccctgaccgccgcgcagcagcgtatttttccactcctgcacctgaattttgaactgtacctgtgcatttcgcgccgtatcgatactttgcgtcacacgtttttccgtcgccataatgtgctgattctgcgtcagcccgtcggcgttaatcactaatcctctgctgccgataaacagcgtcgccagcagcagtaccgcagccagtaaaccgagccgctgcccgatagtaaggtggttaagtttcattgtatctgtagttcctgaggtcaagggtgccatcggaatgacgagcacacaggtatcgacccggcggcgacgggctttaatggcgggagtgcggtaaaaagcagcaaagtggcgttaatcggttgatatgcaataactatataattttatgacatatttatgacaggcggcaaaatagccaaaagccgcctgtttaacccgctacaggaaattgcgcagcgacgccacgtcaagaggactggcttcggtgagccatgcggggattgcctctggcggcaccgggcgcgagaaaaagtagccctgcgcttcgtcgcagccataggactgcaacagcatggcggtctctttatcttccacaccctcagccagcaccagataattcagatccttgagcatcataatcacgtgacgggcgataatgcggctgccgggatcggtggtcagctggctaatcagcgaacggtcgagcttgataatatcaatgggaatacggcgtaagtagctgatattactgtaacccgcgccaaagtcgtcgagcaggatcttaaagcccttcattttcagccgatccagttcacagagcgcctgctcgctctccagcactttttctgtttccaggcattcaatgcgaatatcctgcgccaccaggcctgcctcaaggatctgctgctccagcatatcggcaaaaccggggcaggaaaaatcgctgaccgtcacgttgatggataccggcagcagaatgcccgccgccctccagcgcctgagctgagcgatcacggtgcggatcacccagtgggtaatgtcgttcatcaacgtggttttctccgccagcgccacaatggtggcgggggaaatattgcccagcacaggatgctgccagcgcagcagcgcctcgcatccttcggtgaaaccggtgtgcagggatattttcggctgatagaccagataaaactgatccggcgctttgatggcctcgctcaaatcgtaaagcaatttaaaatcgctgttgcgcttctcatcgaacgcgcggtcgaagggcaggacaggaatatgctggcgaatcgcttcatgcagtgcgctgatcccctggcgtaatatctctttcggatcctcaataccgggccggaaattcacgtagccggtaaagattttcaggcgaatgtcgatgtcgccgcgaattttcgcctcaatgtccggcaggttttccgcttttttgatcaatgtttttgcgtattcgctgtcaattaacagcgcaaagcgtcccggtgcgaaagcatataacggcgtggtggccggtaattttaaccgcaggcgtaaaagtggcccgaagccgcgcagcattttctccacggcgctcagcccaagatagcgtgaaagctcgtaggcctgtggcatatcaatgcagtcaaacaggataagcgtagagggacgatgagcggtctccagccctatgcgctccatctctttcagtaaaaactgccggttgggcaggccggttaacgcatccacccgccctaaagagtaccaggcttccagataggtgcaggccagcgaagcgatacgcaggaaattttccgtttgctgtgcatcaggttcaagcggcgtcggatggctgacgcacagcgtgccaagcacgaacccctctttggtctgtaatggcgcagcggcataaaaaataacgtgaccgttcagcgacagttcatgatcgcgaaagcgatcgtcaaggcgcgtatcgttacagataatggcattgcagctttttactgaatgctggcacatcgaatctacaatcggcattttcagcggaatagccggattgtttttcacaaatttaatgtactgatgctgatcatcaaaaatagtaacaaaacagccatcaacgcccatgatttcactggcgagacaggcaaattcgcccagcgcagcatcacgggcgctgtcctgttccttaagtaacgccagggccgccagtcgtttggtttcatttttattcaggccggtgaacataaggcgctcctgctcagaacggtgctgagtctggggaagaatttttgcagggaagagttatttttagcgtatggcggggatcaccaccagccgaactgggatccggcaacggcggcgatagcaataatcagcataataatggtggtttttctcacgtaagtctcccgaaaggcgctgctggccggacaatgtacataatggcaatcagtattttcttatacgataacggattactgcgccgcgttaaatgagactttcattgccagcgtgaaaaacccggcccggtggcatcctgaggggagggtgacagaacggccttcgccagggtaaacttcgttttcggatttatcttaaacatctttaacgaagcacgagagcagcatgtacttgttaaaaccgggcagccaggccttaatcattggcgcgcagacccctgtcggtcgtcgtaatattggtaaatcggtagagctgttcggcctctgccagccgggtgagcgttttctcaaccccgtgaatggggtgatgacgcagatgccagataacgcgccgcgcgcgctgtggctggtgatcggcgatgtctttacctttgacggccagcatggtttcgcctttgtgcgcgccgaacacctgatgccgctgctgccggatgccatgcctcaggaagccgacgcccggattatgtattaagcacatagcacctctcacttttaaggtgttgtgatagcgataaaagatcattattctgatgttccttatgttacccataaattgcacaacatagggaacccccatggaccacctgcctgtcaaagaaaccctgcgtatcgctctcgtcggtgattacaatcaggacgttattgcccaccgggctattccgctggcgattgatgatgccgccgccgtacaaaacatcactgctgattatgactggctggccacgaccgacatcaccagcgccgaggacttggttggctacgatgccatctgggtggtgcccgccagcccttataaaaatcctgaaggcgcatttatcgccattcgctacgcccgtgaaaacagcatcccgttcctcggcacctgcggcggttttcagcatgcgatgatcgagtacgcgcgtaatgtgctgggctggggagataccgcgcacgcggaaaccgacaccgaaggccggatggtgatatccgccttacagtgttcactggtggaagaaacaggggtgattgaactgcgcccgaacacgctgatcggcaaggcctatggccgcgacagtattgaagagggctatcactgccgcttcgggatctcacccgaatttgccgatgccctcagcagcagcgattttcgcgtcaccggctgggacgaagagggcgagatccgcgcggtggagctgatcagccatccgttcttcgtcgccaccctgttccagcatgaacgcggcgcgctggccggacgcccggtgccgctggtgcacgccatgctgcgcgcggccagcaactaactttcctgatagtcgcggggtcagccagcgttgatctcgcgatcctgtccggcaaaagcgccgaataccgccatcgccaccgctaacagcgcacaggcgagcagcggaatatgccagtcgccgctggcatcatgaattttccccatcagcggcggcccgcaggcggccagcagataacctaccgattgcgccataccggataaagccgccgcctggtgcgctgaactggcgcgaaggccgataaacgtcaggccgaggatcatggttgcgccggatccgaacccaaagatcaccgtccacagcaccgcctgcgccgggaacagccacagcccgacggcgctgaaggcgcacagcagcgagacgatagcggcgatgccgcgttgatcgcgcagacgatgcagcaccagcgggatcagaatacccggcgcggcggtcgccagttgcaacagaccatgcagcgatcccgcctgcgcctcgctgtagccgtggctgatcaaaatcgcaggcagccagccgataatcacataataaatcagcgagttaatgccgaggaacagcgtgacctgccaggcaaggcgcgagcgccagataccgcgatcgtgcaggccgggcgtgctgctgagtgcggcaggcgcgctggcgcgcaactgcggcaaccacagggcaagggcgagcagcggaaacgccatcagtgccagcagtgcgccgcgccagccgaaaccgtgcagtgcaatgggcaccaccagcgccgagccgagcgccgccgccgcgcccatggtcagggaataggcgccggtcattttcgccacctgaccggcgaaatcacgtttgatgatccccggcagcagcacgttacccagcgcaatgccgcagccgatcaccgccgtgccggtaaacagcagcgccgccgagggcagggagcgcacggcgataccggcgcaaatcaataccatcgccaccagcagactgcgctccatgcccagacggcgcgcgatgcccgccgccagcggggacaccagcgcaaaggccagcagcggcagcgtcgtgagcaggccggtctgcgcggtggtgaggccgtagtcgtcacgaatagcccccagcaacggggccgcgccggtgaaagtgacgcgtaacgtggtggcaatcaacaggatcccggtaaacagcagcaatccctgccttgtgcgaagtgaaatagcggtagtcattatattctctgttttctggcttattgagccgcgtcagtctaatcccagaacgtccacccgccaaatctggcagcgcatcatgccgatgattttctgcttgtcagaccattcttaaggtgtggttattccgggtttatgctgccggaaaggaaattataagaggatcctttcgtgcaggcgtttttcataacttttttcgatatgtaatgcactttttgatatttgtctgtgcggggagagctgtgtgaatttagcagcaatttcaataacaacggatcaccattagcatggcaactttcgcacagaccaaaaaaaccgtcgcgctgactgcgctggcgctgctgaccacgctctcctttgcggcgcatgccgataaactggccgacatcaaagccgcgggcgttgttaaagtcgccacttttgatgccaacccgccgtttggcgccatcgatgcaaaaacccacgacatcgtgggctacgacgtggatttcgccaaagcgcttgctaaaagcctcggcgtgaagctggagctggtggcgacaaaccccgccaaccgtattccgctgttgcagtccgggaaagtggatctgattgtcgctgacatcaccatcacgccggagcgcgcgcaggtgatcgatttctccacgccctattttgtgaccggacagcaattcctcgtccccgctgacggcaaagattcgctggatgcctacagcaaagcccgtatcggcgcggtgaaaggcaccaccggcgagcaggcgctgcaccagcgtttcccgcaatcccgcgtgctggcctatgacgatatcccgctggcgctgaccgcactgcgtaacggcaatgtgcaggcgatcacccaggatagcaccattcttgccggtctgctggcggaagcgccggacaaagcgaagtttaaaatcctgccggatctactgtcgaaagaagaaatcggcgttggcgtcagcaaaggcgaaaccgcgctgctgaaggcggtgaatgacgaactggtgaagcttgagcagagcggcgatgccgcgaaaatctacgacgcctggtttggcccgcaaaccaaaaccccgcagccgcgcagctttaaaatagaagcgaagtaattatgtttgcaggtttattttccacctccgtggcgtcggccacggaggcgtttgccgtgcaaaaaggtacggtcgaattccgtcaggtgagcaagcgttacggcgatcatcaggtgcttaagaatattgatttgcaggtgcgcgccggggaagtgcttgccgtctgcgggccatccggatcgggaaaatcaacgctcattcgcctgatcaaccagctggaaactctgaccagcggcgagatccttatcgacggcaaccccaccagcgggctgaaaggccgcgccctgcggcagatccgccgccaggtgggattcgtgttccagcaattcaatctttacgcccatctcagcgcgctggataacatcaccctggcgctgacccgcgtgcatggtaaatcggcagtggatgcgcagcagatcgccctcagcctgctggagcgcgtcggtctgctggataaagcccatcatttcccggcgcagctctccggcgggcagcaacagcgggtggcgatcgcccgcacgctggcggccagcccgcatattattttgtttgatgagcccacctcggcgctggatccggagatgatcggcgaagtattacaggtaatgaaatcgctggcgcacagcggcatcacgctgatcgtcgtcacccatgaaatgcagtttgcccgcgaaatcgccgaccgggtgatctttattgatgacggtgaaatccttgagcaggcggccccggcgcagtttttcaccgcgccgcagcatccccgcgcgcagcggtttctgcaaaaggtgcttaacccgctacatgcagaaagcagggacggctgatgaactttcatcctgactgggccggcgtgctgaccggccagccggcgcagtggatcctctccggttttttgaccacggtgtgggtaacgctggcgggtatgctactcgcgaccttattgaccgtgctgttgctggcgttgcgtctgaccggcgggcgcgtggggcgggacgtggtggcggtgtgggtgtcactgttccgcaatacgccgctgctggtgcaactgctgttctggtatttcgctgcctggaatctgctgccactggcatttcgtcagtatgtgaatgacgagcacgtcttctcggtgctgccgggggacgtatggtggtttacgccggagtttctcagctcagcctgggcgctggggctgtttaccgccgcctttctggtggaggagatccagtccgggctgcatgccgtgccgcgcggccaggtggaagcggccaccgcccagggttttagtccgctggcgctgttccgctggatcttactgccgcaggggctgaaaaatgcctggcagccggtggtcggccagtatctcaatctgatgaaactctcctcgctggcgaccggtattggctttgcggaactgacctaccagacacggcagattgaaagctacaacgcccatgcgctggaggcgttcgccatcggcagcgcgctctatttgctgctcggcctggtgatgagtctgctgctcaatgcccctgtctggtggcgggcgcgtaaggagaaaacacaatgatcgccagtattacggtcattaccgacaatctggattatctgctgctcggacgtaccgcgcagggcgagccgggcggcgtgctgctgtcggtgctgatgacgctgggggcggcggcgctggcctttcccggcggcatactgcttgcctgttgcgcctggcgtttcaaaggctggccgcgcagggcgctctttttctgggcggagctgatccgcggcattccgctaatcttcgtcattttctggctgtggtttttactgcccgcgttgaccggtgctgatctgccgggggcggtgaccgtcacgctggcgctggcatggttcacctcggcctcggtgatgtattcgaccctcgccgccctgggagcgctgccgaaagggcaatatgaggcggctgtcgccgggggattcagcagtctgcaactgttgcgctgggtgctgctgccgcaggcgctgcgcaatgcgctgccgtcttatgtcggcctgctcatcgccctgctgaaagatacctcgctggcgtttatcgtcaatgtgccggaactgaccaccgtcgcaggccaggtaaacagccgcgtacaggtctatccggcggcgctgtttatctttaccggcctggtttattacctgatgtgcagcctgctggagcagtcggtgaaacgctggcagcggcgacgtttactgccgtccaattaacagcgacaccaggcctgcggcgatcagcgggccgacgggcaccccacggaacagcgccacgccgagcaccgtaccgaccagtaatccggccaccagcgacggctgcgagctcatcagcgtgacgccacgcccgccaagccaggagacaaaaacgccaaccgcaatagcgatcagggatttccagttggcgaaggagtgcaacagggtggaaggcggcaggctgccgctggcaatgggggccatcacgccgatggtcaggatgatgatgccgatggtcagcccctgtttttcgatccacggaaaaaaggcgttgagcggcgtcacccgcacgataatcagcaccagaatggagatcgccacggtggtgttgtggctggcaaaacccagcgcggcgagggcgagtaaaataaacagcgtggtatcgaacatggcggcatcctgaccagaaaagttagcctgcttactttacgcgcatccgcgtgaagaaacaggcgttttttagttcagatgattttcaactttgtaccagcaaatccaccagcgggctgttttcccgtacgaataccggaatggtttcaagggacgcatcaacggtgatttgctgctgcccctgataacgctcgccgttaagcgccacccagccgtggacgcccggcagccagacgtcacgctggcgctgaccggcatgcatcaccggcgccaccagcagatcctcgccaaacagatactgatcttccacctgccagctttgcggttcgtcaggataatgccagaacagcggccgcatcagcggatcgccatgctggtgggcgttgtcaaacagcgcatcgacatacggacgcagcgattcacgcaccgaaagccagtgctgcataatggcgaaattctcctcgccatagctccacagctcgttcggcgaaccgctgttacactgcggaatgccgttgcggtagctttccggcggctggatctgcggctcgcgatagccgtgcatacgcagtaccggacagaagactgcccattggaaccagcggatcagcagttcatggaacgccggatcgttcacgttgccgccctggaaaccgccgatatcggtggtccaccagggaatacccgccagccccatattcagcccggcggccagctgattgcggaaggcgtggaaggacgagtgcacatcaccggaccaggccagcacgccaaagcgctggctgcccgcccaggaacagcgcaccagattcacaatctccgtttcgccgttagctaccagcccatcataaaagccctgcgcaaaatcgcgcggatactggttgccgacttccagtaccggcccggcgtggtagcggtagttatcgaagtcataggcgcggtattccggctcggcttcgtccagccagaacagcttaatgcccagatcgtagtaatttttcttcaccgtctcccagacaaattcccgcgcctgtgggtgggtggcatcaaagaaggtggtgttgcccataaaatcgagattcacctgtacaccgcgatcgctggtcaccagccagcctttggctttcatcaccgggaacagggggctgcgcgcttccaccgtcggccagaccgacaccatcagttcgatgcccagcgatttcagttccgcgaccatcgccgccggatcgggccagtccacaggatcgaagcaccaggtgccctgatttggccagtggaagaagtcgatgaccatcaccgacagcggcagatggcgacgacgatattcacgggccacctccagcacttcctgctgggtgcggtagcgcagtttgcactgccacaggccgctggtgaatgccggggcggacggcggggtgccggtggctttcgcgtactggcgggtcagttgtacgatgttgtcgccggcggtgatccagtaatccatctcctgagtaacccgcgcctgccattcggtgtggtttttcgcaaagctcgcctcgccgatggccggattattccacagcaggccgtagccgaggctcgactgcatgaacggcacgctggcctgggagttacgctgggccagctccagcacacagcctttcagatccagccacggctgttggtactggcccatgccgtagattttttcgtcattgcgcgattcaaagcgcacggtgagctgatatttgccgccgggcagcggtttgaattcccgaccgtccagcttcagggcgctgacgtatttatcctggcttttctcgctggccccaatgccgacggtggagcgctgccgccacatctcttccagcagcagctcgccgcgctggttgtaaaaggccagctgacccttcaggttcagcaccgcggtgatattaccgttgcgcagcgtcagggtttccgcgctggcggtgatctcacttgcaccggcgtcgtttcgtggcagcagggcatgcagattatcggtgaacgccggggcgcaggtggcgcgcacgcgcaggctgtgttcaccccagggttccacgcgcaggatttgtcgctcaaagcgccattcgatgctgtcaggatgttggatcagttcgctcataaataatgcgtccttttatgcagccgtttgcttagctaaatggatggatttcatggtgttgtcgtcgagcttgtaccagcgcagcatggcgaaggcgcacagggagagaacgcccggcaccacggtaaagagcgcgacaatgcagtacatggcggtgctgttctgcgtcggggcattagcgacataaccgctgaagcccagcgtccagccaacgatagcgccgctgatcgccatgccaagtttcagtaccgcgaggaaggtggagaagatcacgccatccatgcgtttgccctgcaaccattcgccgtagtcagcgacgtccgccatcatcacccacatcagggtggtggtggcctggtagagagtggagacgataaaggtcagcggcaccagcaccagtacggatttaggtgcgaagaacagcgcaatactcagtacgcccgccagcaccgcacagtaaccaaacatctgcactttgctgaaattacgcgtcagacgtttcgccagcgcgctgcccgccgctttgccgagaatatgcgcccccagcatccacataaaatagctggcgctgccaagataataagtgacgaaatacatcatcgcgccaagacgtaccaccccaaatccaatattggtcagcaccagcacggcgacaatgcgccactgatcgttttttaataaatcgcgtaattccgcgagataattattatgcgtggcgggagcattgatacgttcacgggtattggtaaaacagatccagaacatgatcaccgccgccgcggccataatcgccattgccgcacggtagccgagtaatttgtcatcgccgccaatatattctgccagcggcatcataaagaaggtcgacatcgcgccgccgagggtggctaaaaagaaacggtaagactggagtgaaatacgctcttcgttattgggggtgatcaccgcgcccatcgaacagtagggaatattaatggcggtgtacatcagcatcatgaaggtataggtcacggaggcaaagatcattttccccgtcagggtgagggattccggcaccgcgtaggtcagcagacagctcgcgccaaagggcagggccagccacagcatccacgggcggaacttgccccagcgggttcgggtgcggtccgcaagataacccatcgccggatcgataatcgcatcggcggtacgcgccagcaaaaacatcgtgccgacaaaggccgccggtaagccaaccacatcggtgtaataaaaggtgagaaatataatgacattatccagcccgacatggctggccatatcgcccagaccataacttattttttctttacgggtgatcttttcctgcatcttattcacctgtctctgtaagggtattttgtcgatagttcagagactattgttgatgcatgttgtcaggcttaacaattgcgagatttactaatggggttatggaaacgcattttcgtgataccggtaacaataatggcggtaatttccatattttaagtgcttttagtccatatcctaaaagcaggaaataacgcagcgcaggaatcgtttcagcggaataatattcatattaatacaggaaaaacgacataaatttgtcatgcgcgctggctgataatggcgcatcgtccgtaaaagcgacaggtgtgacaatgaacgatcccatgctaatggaaacgctgattatcacctccacttttttagccattatcatggtgctggtggcatcagtactgattctggagcgttccggctgaagctgccgggcgggaaaagaaaaagccgccacgggggcggcaaaaaggtaacgtgtttcttagttattgtttctgtaataagtagctgttttcgtaacccggtacgacgccaatgacgtcaaagccccggaagtaacctccggcacgcagcagatccaccgcaggacccacttccggcgaatactgatgatcgcgatagtcatcaaacacaatgtagccgccgctgatcaccgttggcgaatagagcaggaaatccatcagcacatggcgtcccaggtgaccgccgtcgatatgcagcagcaaggttttcgggttgaatgccagaacgcgctcaatgctgtgctctgaataaccgcgtaccagattcacttccgggaacaggcgctcgtgatagaagcccagttcattagcctgattcggcaactccatcggatcgacgctgatgattttgcgtttacgtttacacatttcgttcatgaaagcgctggatttacccttccacacgccaatctcaatgatgtcgccttcggctttagaattttccagcagccagcacagatagccgaggaatttcacatgcgtgtggaaagaaagctctttgcgcggcatcgccagttccggcggcagcgcggcctgcgcttcaaccatggctgcgccaaccgaatcccagacgtcatcaatgacccgttgtaattcaggatcttctaaaaataatttcaggtctgaaatttcgagcatcagggcggtttccttcgtgtagtgagttggtggtatttacctgacgttaaatttgccacagaaggcgcgggtacaaggcgggaaatagctggcattttgccgggcatttaggcggatagcggaaatgaaaaagccggtggactgaagttcaccggcttttttgcaaaaaacatcaattatgggcgtcgctggcctgtttgtggaacagctcgcggaacaccgggtaaatatcatcctgatcgcgaatatgctggatagcgaagttatcgaagcttgcctgtaaatgctcatattcacgccacagcgtctgatgggcgcggcgggtgatctcgatataactgtagtaacgcaccaccggcaggatcttcttcgccaggatctcatgacacagcggtgagtcatcggcccagttatcgccgtcggaggcctgcgccgcgtaaatgttccactgcgccggatcgtaacgctccttcaccacctcatccatcagcttcagggcgctggaaacgatggtgccgccggtttcctgcgagtagaagaattcatgctcatccacttctttggcctgggtgtgatggcgaatatacaccacttccacgttcttatacgttctggaaaggaacagataaagcaggatataaaaacgcttcgccatgtctttggtggcctgatccatcgagcctgacacgtccatcagacagaacatcaccgcctggctggacggctccgggcgcttctcatagttcctgtaccttaaatcaaaggtgtcgataaaaggtacacgttcgattttcgcccgcagttcggcgatctcccggcgcagctgttcctcttccagtaattgcgccggttcgctgttcgccacctgttccaggttttcttccagctcgcgcagctgacggcgcttgcccgcggtcatcgccgtacggcgcgccagcgaattttgcagtgaacgcaccacgctgatatttgccggtacaccgttcgcggtatagcccgcacgatgggttttgtattcgttaagctggcgatgctgattctttttcaggttcggcaatgccagatcttcaaacagcagatcgaggtattcatctttggagatctgaaagacgaattcgtcctggccttcaccgtcctggctggcctgaccctgaccgctgccgccgccaccgccgcccccctgcggacgttcaatgcggtcgttctgcacaaagtgatcgttgccgggatgaacgcggttacgcaggccgccgcgtccctgatgaaacataggttcgttaatatcttcagacgggatggaaacggactcgccgctgtccacgtcggtgaccgagcgcttgttgatggccccggaaatcgactgcttgatttgcgatttataacggcgcaagaagcgctggcggttcaccgtgctcttgtttttgccgttaagacgccggtctataaaccaggtcatacgccctccgtactgccaactgttcgcaggatctgtaggtgccgggctacgcggaggcaaccccggcctacggagtattattgttggcccggcgtgcgccgggcggctgtcaggacgatttacgcacgcgcagataccattcgcacagcagacgaacctgcttgcgggtatagcctttttccatcatgcgatcaacaaaatcgtcgtgtttcttctgctcgtcggttgaggttttggcgttaaaggagatcaccggtaacagctcttcggtattggagaacattttcttctcgattaccgtgcgcagtttttcatagctcgtccagttcgggttgcgaccgctgaagttcgccctggcgcgcagcacaaaattgacgatttcgttacggaagtctttcgggttgctgatcccggcgggcttctcgattttctccagttcggcgttcaacgattcacgatcgaacagctggccggtatccggatcgcggtactcctgatcctggatccagaaatcggcgtaggtgacataacggtcaaaaatgttctgtccgtattccgaataggattccagatacgcggtctggatctccttgccgataaattcggcatatttcgggatcagatagcctttgaggaactccagataacgctccgcctgttcctgcgggaactgctcgcgctcgatctgctgctccagcacgtagaacaggtgcaccgggttagccgccacttcggtatgatcgaagttaaagacgcgggacaaaattttgaacgcaaatcgggtcgacagaccgttcatgccttcgtccacgcccgcgtaatcgcgatactcctgataagatttcgccttcggatcggtatctttcaggctttcgccatcatagacgcgcattttggaatagatgctggagttttccggctctttcaggcgcgagaggatcgagaagcgggacagtgtttccagcgtcccgggtgcgcagggcgcatgggccagctcactgtgattgagcagtttctcgtagatcttcatctcttccgagatgcgcaggcagtacggcaccttgacgatatagacacgatcaaggaaagcttcgttattcttgttgttacggaacgtcacccattcggattcgttggagtgcgcaagaataatgccgttaaacggcagggcggaaatcccctcagtaccgttatagttaccttcctgtgtcgccgtcagcaggggatgcagcaccttgatgggcgctttaaacatctcgacgaattccattacgccctggttggcgcggcacagcgcgccggaatagccgtaggcgtccggatcgttctgcgcgtggttttccagtttacgaatatccaccttgccgaccagcgccgaaatatcctggttgttttcatccccgggctcggttttggcaatggcgatctgctccagaatcgacggccagactttcacgacgcggaatttagtgatgtcgccgccaaactcgtgcagccgcttcgccgcccatggcgacataatggtgccgagataacgccgcggtacgttgtactctttttccagaatttgcgcatcttcctgcggattgaacaggcacagcgggtggtcgttgaccgggctgcgctcgccgttagcgctcagcacgtaaatggggacgcgctgcattaaggatttcaggcgctcggccagcgacgatttaccgccacctaccgggccgagcaaatagaggatctgtttcttctcttccagcccttgcgcggcgtgtttgagataagaaacgatttgttcaatggcttcttccatgccatagaactcttcaaaagcggggtagcgtccaattaccctgttcgaaaacagacgggaaagccgtggctccagagcagtatccaccatcactggctcaccaatggccatcaacaggcgttctgccgcattggcataagcactgcgatcctgccgacatatggaaagaaactcctgcagtgtgaactcttcgtccttggcagcttcatagcgctggcgatagtgatcgaatatattcatggcatgccgtcctttcgttttttagcacaggttaagagccgttcatatgaattgtggaggctcccggaagaggtaggttgaacgttgctgatgagtaccaacaacccgcgtgccaggtgacaggacgcccggcgctcgcgtgctcgcgatacaccttcttaaaattaagcgtagatggcatttgcaaaacttgcatgccaccgcaaaccaatttcaatgacatatcaataactcatctgatgtttttctgtttcgtgatataggccgcgccagcgcttcatcgcagcgtcatatcattgcaaacgcgctgtcattatcagaccgcaagatgatgtgttgagttttgtaatattcgggtaaaaaaatttgggaagcacggcgcggacagttacacttcactggccccattatttgacgataggaaagaaaggattgtgaccaaattcaaagttctggcgctgggcgttctgaccgccatcacagccacttcagctctggctgacaataatttctcggtaggtgccggtgttggtgtccttgaaacgccgtataaggactacgatcgcgatgtggttccggtaccggttatcacctatgaaggggatgacttctggttccgcggtctgggcggcggctattacctgtggaacgatgagagcgacaaactctccatcaccgcctattactctccgtttgaattcaaacctaaagacagcgacaactggcagctgcgtcgccttgataaacgtaaagcgacgctgatggcaggcttgtcctacgtgcacaacacccagtacggcttcctgcgcaccagtctggcgggcgatactctggataacagcaacggtatctcctgggatctggcctggctttatcgctataccaacggcggcctgacgttaacgccgggtatcggtcttgagtggagcagcgaaaacatgaacgaatactactacggcgtttccggtaaggaatcccgccgcagtggtctcgatcgctacgatccggacagcgactggagcccgtatctggagctgagcgcgagctataaactgactgatgcctggagcgtttacggcgttggccgctacacgcatctgtccagcgaagtcaaagacagcccgatggtggataaatcctgggcgggcgcattgtccgcaggggttacctacagcttctgattgtgcaatgacattgtgcattcagtgaataacagggcgcttttgcgccctgtttgcattggagtggaacaacactcacaggagacgagcatgagcgataaaaccgtgatgtttgagcgcgaactggccctgcccgccatcgggcagggcacctggtatatgggggaggacgccagccagcggcaaaaagagatcgccgcattgcgtgcaggcattgacgctggcctgacgcttatcgacaccgccgaaatgtatgccgatggcggcgcggaggaggtggtcggcgaggcgcttcagggcttgcgggagcaggtatttctggtctcgaaagtctatccatggaacgccggagggcaaaaagccattgccgcctgcgaagccagcctgcgccgtctgcaaaccgattatctcgatctctatctgctgcactggcgcggcaattattcctttgtggaaacggtcgaggcgatggaaaggctgatccgcgagggcaaaattcgtcgctggggcgtttcaaatctcgattatgacgatatgcaggaactgtggagcgtgacgggcggtcaggcctgcgccactaatcaggtgctctatcacctgggatcgcgcggcattgaatttgatctgctgccctggtgtcggcaacagcagatgccggtgatggcctattgtccgctggcccaggccgggcggctgcgtgatgacctgttcaacagtcgcgccgtacaggaggtggcccatgcgtatcaggccacgcccgcccaggttttactggcgtgggcgatccgcgagcaggggttgatggccataccgaaagcctcaagcgcagaccatgtgaaagagaatgccgctgcgctggcgctgaacttatccgccgaagccattgccctgctggacaaggcgtttccggcaccggggcgcaaaacgccgcttgacgtggtgtaatttttcccctctcgcagggagaggggagatgtcttagcgtttaaccacgcgaatggtctgcgccaggcgggacggtttttcttccgtggctttctgggctttagtggcgcaggcagtttccacgcatacaaaagtcttatagccgtcgtccggcatatcgcccatgctggcggagagcgccgggccagggttccagccaaccacgttacagtgatgatggtggatcacttcaatggtgcggttcagcgcgccgtcgttgatgatgctgcacgcttccggattcaggtagacgcgatcggtacggtccgggaaggtttgcacgccgtcagtcagcacgtcttctttcgcgccgttcactttatcaataaagcgatcgccgaggccgctaactttcaccgcgctgatatcgccaacgttgaaataggtgtgcagggcagagaaggtttcgaattcgccatgggcttccagctcgatttcacaggttttgccgagcttaaagcgggcatagagggtgaagtcatgcggccagtactgacgggtggcatcgctgctttgcagttcaaaagtcagcaccacgccgttatcgtcttcgttatgggctttcagcgtccacggcaggttacgggcgaaaccgtgtgccggcaggccttccttcgccgccgggccaaaccacggccagcagatgggtacgccgccgcgcagcgccacgccatttttgaacggcgtagtatcgctcagccacagtacttcttcagcgccagcgggtttccaggagagcagatgcgcgccctgcagggcaaaggaggctttcacctgcgggtgatcgacaacaatgaggtccagatcgtccagcacgcggcgggaaagggcggtggtgaactggtcaacgaccggaagagcaaaaattttagtaatcatcatgatattcctcaatcctctgtcttcaatgcaaaaaaaagagcgaccgaagtcgctcttttggatcagattctcatctcaacttatttggagatgtgagcgatcaggtccagaactttgttggagtagccagtttcgttgtcgtaccaggaaaccagtttcacgaagttgtcgttcagtgcgatacctgctttagcatcgaacacggaagtgcacacttcgccgttgaagtcggtagaaacaacgtcgtcttcggtgtaacccagaacgcctttcatttcgccttcagaagcggctttgatggctttcttgatttcttcgtaagaggctgctttttccagacgaacggtcaggtcaacaacagatacgttcggagtcggaacgcggaacgccataccagtcagtttgccgttcagttccggcagtactttacctacagctttagctgcaccggtagaggacgggatgatgttctgtgctgcgccgcggccgccgcgccagtctttgtgagacgggccgtcaacggttttctgagtagcggtggtcgcgtgaacggtggtcatcagaccttcaacgataccgaagttgtcgttgataacttttgccagcggagccaggcagttggtggtgcaggatgcgttagaaacgatgtcctggccttcgtatttgtcaaagttagcaccacgaacgaacatcggggtgttgtctttggaaggaccagtcagaaccacttttttcgcgccagcggtgatgtgcttacgagcagtttcgtcggtcaggaagataccggtagcttcagcaacaacgtcaacgccgatttcgccccatttcaggttagccgggtctttttcagcggtaacacggatggttttgccgttaacaaccaggtggccgtctttgacttcaacggtgccgttgaaacgaccgtgtgttgagtcatatttcagcatgtacgccatgtactcagcgtccaggagatcgttgatgccaacgatttcgatgtcagaacgttcctgcgcagcacggaaaacaatgcgaccgatacggccaaaaccgttgatacctactttgatagtcatatattccaccagctatttgttagtgaataaaaggttggctgtaaaattacaaaaaccttacgcagcgtcaagcggaatcgtgtcaatcattgcgacaaatcaatcctgtgcacaacctttgcgcgactgagtcgcctcacttttccaatgggctgctacccacatggggccgccggctggaattttaaaggccatgcaagataaatatgtgaatcagatcacaattacctggctgcgatttcgcaacgtctaagtttagaacaaaagtcgacgcctgcctgttaatgttttgttagaatcaaagaaaagatgtgaatgtactcaacgcgagaagtaagcatatggctaatgatccctctcaggacgacctgaaaaaaaacctcactgaaatgcagttctatgtcacgcaaaaccatggcacagaaccgcctttcaccggtcgtctgctgcacaacaaacgcgatggcgtataccactgtttaatctgcgatgcgccgctatttaacgcccagagcaaatacgattctggctgcggctggccgagcttttatgaaccggtcagcgatgaggccatcaaatacctgaatgactactctcatgggatgcagcgcaccgagatccgctgtggcaattgcgatgcgcatctggggcatgttttcccggacggtccgcagccgaccggcgagcgtttttgcgtgaattcagcctcactgagcttcaccgatgacgacagcggcgagcaaatcaagggttaaagaatcgattcagcaaattattccatgcggagacaagaaatcgtgaatgtggatgagcttgttaacagtttaacgccggaagtgtaccagcgtctggtcacggcggttgagctgggcaaatggcccgacggcgtggcgctgaccccggagcaaaaagagaacagcctgcaactggtgatgctctggcaggcgcgccataacaccgacgcccagcatatgaccatcgataccaatggtcagatggtgatgaaaagtaagcagcagctgaaagaagagtttggcattacgccaaaatccattgccacgctgaaagtgaattaacaactctttgtaacaggccgggaagcgcgcttacccggcctttcaatgttttatggtttactgaccagcgattcagccagctgtttcgctaactggttattatcatccgcgccatactcccagaacatcgccccggccagtccttttttcttgatgtaatccgccttgattgccactgagcgcgggttttcgtaactcagcgcaaagagcgcttttccatcggcagatttcaccgacagccagggcactttcgcctcctcatcccagtgttccgtaaaacgcttctgcggatcgttgagcagcatttttacaatatcgttgtattttacgtaggtatcttttttaagatcgaatcccagggcgttgaaaagcgccacttcccgttcgccaaagtaaggctgtgtaacgggatttttctgcgcgtcaggtttgctccagtcgatgccaggctcaacggcgcgcttcggcacgcgtccataaaatccaatgcccagattcatttgccgcgccttcacgcctgccgccagatagttattgaccacaaaatcaacgctgtatttatccgcggcggcaacggtcggccaggccgtggagtcatacagattggcattgaaatactgggtgccgtaggccatgtcgtaggtcatcagattgatgtaatccagcaatggcgcaacggctttcatatccacccagcttttcggactttcggcgttcgcgccgacggcgatagtcaccagctttttatcgccaaaggcctcccgcagttctttgagtaaggtggtgaagttatcccgatcggcaggctggctgtcgaccagtccccatgcgccgtttaccgggtactcccagtccagatcgataccatccagcccatagcgggtgacaatatcctgagccgaacggatgaacaccgcgcgcgcttccggtgtcgcggcgacagcggaaaatccacgcgcgccccagccgcccacggatagcagcactttcagctcaggattttgtttgcgcagggtgggaatcaacgccagatcggcggcgacttttggggaaagccaaatctgatgccgcttagagggatcttttaacgcgtcgttagtttcgcctttttcgtcgttatagatcaggccaaatgagtaattcaggtgagtaatctgacgaacatccagggtgtttatatctccgccaggcccggcggtaacatctccaccgccgttaaaataaccgacagacatcagagaactggctgaggcgagcggggcgcagagcaggggtaacgctgccagcaaaggcaaaagtttcatggtagttcctctttgacaaaaaaataaagccaggcaaaagcttggcgaaaaaacaacccgcatagcctggcatagtcgttgcgctgatactgcgaagaacttcactttatgtcgttgaaggggaacaaaaagaacgggcattgatgatcaatacccgtgtagaacgttaagcgtgtgtttctacccagtccgccagcgtatagagcgtcgcgcccgctgccgccatctccataaacgcatgcgcgctgtcctgagcatggagattcacgccacggcagccatcggtaatgacatccacgctgtagcccagcgtcagcgcgtccagcacggtaaacttcacgcagtaatccgttgcaagacccagcacgatcagctcgttaacgtcatgatgtcgcagccattcatcaagctgcgttttttgccggtggccgttgtcaaaaaaagcgctgtagctgtcaatcgccgggttttcgcctttatgaaacagcgcatcaatggcctttgcgtttaacagcggatgcagcgccgccccttcggtgttctggacgcagtgatccggccagaaggtctggggcagcccgtccagtaatccttcagaataaggctcgacatgctgctggcttgcaaaactgccatgatccgcagggtgccagtcctggcttgccaccaccgcgtcgccgcgcgttttgcaccagtcgatcatggcgttagcaatatctaccgtactgtcgccttcggcgaccgccagcgcgccaccggcgcaaaaatcgttctgaatatccactaacagtaatgcccgggccatagtctgctccttattcgtccggcgtcagttcgccgcgcaaattgacggccatcgcctcgcggatggcctgcacatccagatcctgacttaacagataatgcagtttagtcagcgttgcttccaccgtcatatctgcgccgccaatcacgcccgcgtgcgccagcgcgttacccgtagcgtaaccgcccatattcactttgccggacatgcactgggtcaggttgatcaccacaatgccgcgctcgctggctgcctgtagctctttcagaaactcgccgttttgcggcgcgttaccgacgccataagagcgcaggatcaaggccttcaccggctggcgcaggaagttacgcaccacgtcggcagaaatgcccggatagatagtgaccacgccgatcggctgtggggtgatgggatgcacaatcagctccccatcgccatggggcgcagggggcgtgccgagacggcgaatatggatcccggcttccagcaacggttgcagattaggggaggcgaaggcatcaaagccatcagcatgcgccttggtggtgcggttgccgcggaacagacgattgttgaagaacagcgtcacctcgttaatcgggtagttcgccgcaatgtacagggaattgagcaggttgatctgcccgtccgagcgcagctccgccagcggaatttgtgaccctgtcacaatcaccggcttgccgaggttttccagcataaacgacagcgccgaggcggtgaacgccatggtgtcggtgccgtgcagaatgacaaaaccatcgtagcgatcgtaattcgatttaatatcttccgcgatatgctgccagtcctgcggcgtcatgtcggaagagtccatcaacggatggtattcatgaatggtgaagtcgggcatctcctggcggtgaaactccggcatcagcgccagctggcgttgcaggtgcccggaaaccggaatgtagccctgctcggagcgctgcatgccgatagtaccgccggtataggcgacgtaaatcgatttcttttgcatggtgttctgtttcatagccataaaaaaatcccctcatggctgaggggatggattatcagcgaacgttagcgcaggtcaggcaaaacgcatagcggttttgcggatcgttaaaggccgccagcttatcgctttccgctttcactgcaccggcgaccggagccagcggcgcgggcagataagcctgtaacgccgacggcatcgccgcgcggacgctggcggacatgctggtgatcacctgatcaaagaaggtcggctcatcctgataataatcaatgtgccactgcttgagcttcgccagttcagccgctttcgccaccgcatcatcgaaatcgcccagcgcgtccaccagcccgtttgctttcgcgtcctgaccggtccagacgtggccctgagcaatctggtcgatctgctccggcgtcttgttacgcgactgagaaacaatcgacaggaagcgcttatagccgctctcaatgctcaactggatcatctgctgcacttccggcggcagggctttggtcgccgccacgtccgccagcggcgaggtcgccacgccatcggtgtgcacgcccacgtaatcgaggctgttttcaaaggtgttgatcaccccgaagatgccaatcgagccggtgagggtgctcgggttcgccacaatgtagttagctggcgttgagatccagtaaccgccggacgccgccatgccgcccatggagaccaccaccggcttaccggcggctttcgcggcggcaagttcagcacggatcacctcggaggcgctgacgctgccgccagggctgttcacacgcagcacgatagctttcactttcggatcgagacgcgcatcgcggatctgcgaggcggtggtgtcgccgccgacgttacccggggtttcttccccgtccatgatcgcaccgttagcgaagatcaccgccacgctgtcgccgttttcgctcggttttttcagggcgtagtcgtagtagctgatggcgctgtagtttttatcagcgtcgctccagccaaactgtttgctgagcgctttttcaacttccgcgctggacgccagctgatccaccagtttgttatccagcgcgtacttcgccgtatcgccacccactttggtcagcccttccagcatcgcctgggcgccagggaaaatctgctgcgccggtacctgacggttggcggcgatggtgttcaggtagttctgccacagctcgccgacccagcggctgtcagcctcgcgcgcggccggggacatatcgtcgcggataaacggctcgacggcggatttataggtgccgacgcggaaaacgtgcgtggagacttttagcttttccagcagcgatttgtagtacagcccgttagtggcaaagccatgcagatccaccacgccctgcggcgagaggaaaattttattggcgaagctggcaaggtaatactgaccctggctgaagttatcgcctaccgcatagaccggtttgccactgtcgcggaattcgcgcagcgctttaccgatatactgcatcgacggctgatcggcaccggcgaagtttttcagatccatcacgataccggtgatattgcgatcctctttcgcctggcgaatggtctcgacaatatcaaacagcgagttttcctgtaagcgatcggagctggcgccaaacagctgacggcccagcacgcccagcttgctgctgctggaaggcttatccaccaccacaccggcgatatccagcaacagcgcgccacggttgctgtgctcggcattgctgctcttcacctgcatccagatgccgacgcacaccacgattaaaaagataaagaaaaggttgagcaccagttcacggacgaaattgagcaatcgccatgtccatttaaaaaaaccagcaatgaaacgccaaagggttcgcatgtattcttcctgtcctgattaacaacccccgctaccctgagcggaatgtgcggttatcctaattacccggcggcaacttgtcagcaagatccgccgccgtcgctgtaacaaaatctcctgtcgtgttaattttatgcataaatttgatgacaggagttaactaatggatgcacttgaactgctcgttaaccgtcgtagcgcctcccgcctcaccgaaccggccccggcgggcgatcagctgaaaagtattttacaggcaggtatgcgcgccccggatcatggcacgctgcagccgtggcgcttctttgtcattgagggagaagggcgcgagcgcttcagccagttgctggagaaaggcgccattgccgcggggctggatgaaaagggcattgaaaaagcccgctccgggccgttccgcgcgccgatgattattgccgtggtcgccaaatgcgaagatcatcctaaagtgccccactgggaacaactggtttccgctggctgtgcggtgatggcgatgcagatggcggcgctggcgcagggctttaacggtatctggcgcagcggcccgatgactgacagcccggtggtgcgtgaagcgctggagtgccgtgaacaggatcatatcgtcggttttctctacctcggcacgccgcaactgaaggcctccaccaccatcagcctgcctgataccacgcctttcgtgcgttatttctgaacctcgcccgggcgcttctgatcttcgcagaagcgcctggctagagagaatagtacccgcctaacgccttttttaaggcgttaataatttgtcgcttccagggcgtcgttgacgtgcggtactgaaaaaacacgtttccttccgcctgaaacccgttgagcggcagggtataaatgccttcacggtcgaccagggcggcaacccagggggcgggcaccacggccagcaaaggcgcacggcgtaacgcaggggcaagctggctgtaatcctgacagacaaatgacaggtgacgggataaacctgcccgggcaagctgtctgtccagctcattggctgcctgcggccaggggtggcagtagaagtgctcaaactgatccagctcgctgaactcaacgctggttttatccctgaactgttgccgcagcggcgcgccataggcgaccaccagccgtgcgctgccgatccgttcgtaatgcagggcactggagcctttttgatgatcgcccacggcaatcagtaaatcgattttcttcgcaattaactcctcacgccactcacggcgctcaaacgcatgacactcaatgacggctttcgcctgatgcccccggtgcgcaagctccgaggtaagcaacacatttaacgctggcggcaacaccaggcgaaaccgacgatcttcaccggtttcactgccgaacagttcttcatttaacgaaacgaaaagcggcgcgagcctgtcctgaatatttctggcaaagggcgtgggaacctgctgattgccttcacggcgaaacagcggatcctgtagcgcttcccgcagcctggtgagggcatggctgaccgcagacgcgctgatccccagcttttgcgccgtcaggctggtggagcctgtcatcagcatgacatgcagaattttaagaagattgagatcgaattgaaggatattcattaagtggcagcgcaattgcacaaaactaaaaaggcgctcagtatactccgcctcctttgctaaaggagaaaatatgaatcgctctgccatgcttttaacctgcctgatgatcttgagcacccccgcggtattcgccgcgctggatcccattcccccgggcagtcaataccgcgacatggcggagaaaggcgataaatacgcgcagtattttcttgcggatacctggtttagcgcaggggatatgaagcaggcgcagcgctgggcggaaaaagccgccgccgccgggctgccggatgcctgggcgctgctggcaaacatcagcttacagcattccggtaaggcgcttttacaggcgaaacgatacgccgaaaaagccgccctcgcgggcagtgaagcgggaaaagtgatccttgcgcggattttacttcaccgttctgcggagcaaaaagcgtgcgcgcgggcgctgagtctgctggagcaggctgccggcaatatgcacgatgacgcggcggtggatgcgcaaatgtggctgggtttactttatgcgggcggaatatgcgttaaagaagatcatgcaacggcagcgtactggttaaaacgcagttcggcattgtcccgtaccggctacgccgaatactggacgggcatgctttttgcgcaaggggaaagcggcattgtgaaaaaagatcccgcgcgggcatcctactggttcgccagcagttgtcacgagggatttgacagcggatgtgaaaaagtgcctgcgataagaccatgaatagtcttaaaaataagtgtgctggccgccggaatgacagtctgacgcagggtgccggtgtttatgtcataacagaaggcggatgcacagtagcggcttgcccgattgagcgctaccatagccgcattgcaatgacaggagatgtccatgagcgagcaagctattcgtttaacgcagtacagtcacggcgcgggatgcggctgtaagatttccccgaaggtgctggaaaccatcctgcacagcgatcgggcgaagtttatcgatccgaacctgctggtcggcaacgaaacccgtgatgacgccgcggtttacgatctgggcaacggcaccagcgtgatcagcactaccgacttctttatgccgattgtcgacaacccgttcgactttggacgcatcgccgcgaccaacgccatcagcgacattttcgccatgggcggcaagccgattatggccatcgccattttaggctggccgatcaacaccctggccccggagatcgcccgtgatgtaattgagggcgggcgttttgcctgccagcaggcgggcattgccctggcgggcggtcactccatcgacgcgccggagccgattttcggcctcgccgtcaccggcgtggtaccaacggagcgggtgaagaaaaacagcaccgcgaaggcgggctgcaaactctatctcaccaagccgctgggcattggcgtgctgaccaccgccgagaaaaaatccctgcttaaaccggagcatgtcgggctggcgacggaagtgatgtgccgcatgaacctcgccggtgccggatttgccagcattgacggcgtcaaagccatgaccgatgtcaccggcttcgggctgctcggccacctgagcgaaatgtgccagggcgcaggcgtgcaggcgcagatccgctatcaggatgtgccgaagctgccgggtgtggaagagtatattgcccagggcgcggtgccgggcggtaccgggcgtaatttcgccagctacgggcatctgatgggcgacatgccgcaggcctggcgcgatctgctgtgcgatccgcaaacctccggcggtttgctgctggcggtcaccccggacgctgaaagccaggtacaggcgaccgccgccgaatacggcatcaccctgaccgccatcggcgagctggttgaagcccgcgcgggccgtcctatgattgagatccgttaagtcaatgcggttgtttattgccgaaaaacccagtctgggccgcgccattgcggatgtgctgccaaagccgcaccgcaagggcgacggctacattgagtgcggaaatggtcaggtggtgacctggtgtatcggtcacctgctggagcaggcgcagccggatgcctatgacagccgttatgcccgctggaatctctctgacttgccgatagtgccggaaaagtggcagctgcaaccacgcgcctcggtgacaaaacaaatcaatgtcatcaagcggttgctggcacaggccagcgaagtgatccacgccggtgacccggatcgtgaagggcaactgctggtggatgaggtgctgaactacctggatctgcctgcggaaaagcgccgcaacgtgcagcgctgcctgatcaacgatcttaacccccaggcggtggaacgggccattaaccgtctgcgcgccaacagcgaatttatccccttaagctcgtcggcgctggcccgctcccgcgccgactggctgtatggcatcaacatgacccgcgcctatacgctgctggggcagagcgccggttatcagggcgtgctgtcggtgggacgtgtacagacgccggtgctcgggctggtggtgcgccgtgacgaagagatcgaaaacttcgtggcgaaagactttttcgaggtgaaggcgcatatcgtcacgcctaaggaagagcgttttaccgctacctggcagccaagcgaagcctgcgagccgtaccaggatgaagaagggcggctgctgcaccgcagcctggccgatcatgtcgtaaaacgtattaccggccagcccgcgctggtcaccagctataacgacaaacgggagtccgagcctgcgccgctgccgttctcgctctccaccctgcagattgaagcggcgaagcgctttggcctcagcgcgcagaacgtgctggatatctgccagaagctgtatgaaacccataagctgatcacctatccgcgctctgacagccgctacctgccggaagagcattttgctgggcgtcaggcggtgatcaacgccatcagcgtacacagcccgtcgctgctgccgcaaccggcggtcaataccgatatccgtaaccgctgctgggatgataaaaaagtcgatgcacatcacgccattatcccgacggcgcgcagcagtaaggtgaacctcacggataacgaagagaagatctacagcctggtggcgcgtcagtacctgatgcagttctgcccggacgcggtcttccgcaaatgcacgattgaactcgacatcgccaacggtaaatttatcgccaaagcgcgttttctggcggaagcgggctggcgcgccttgctgggcaataaagagcgcgacgaagagaacgacggcaccccgttgccggtggtcgctaaagacgatgaactgctgtgcgagaagggcgaagtggtcgagcggcagactcagccgccacggcatttcaccgacgccacgctgctgtcggcgatgaccggtattgcgcgctttgtgcaggataaagatctgaagaagatcctgcgcgccactgacgggctgggcaccgaagccacccgcgcggggatcatcgagctgctgttcaagcgcggtttcctggtgaaaaaagggcgttatatccactccagcgacgccgggcgggcgctgatccactcgctgccggaaatggcggcgcggccggatatgaccgcccactgggaatcggtgttgacgcaaatcagcgaaaagcagtgccgctatcaggattttatgcagccgctggtggggacgctgtatcagctgattgaccaggcccgcagcacgccggtgcgtcagttcagagggttagcggcgccaggcggggataagaagaaaagttttaaagggcggggtaagaaaaagccgcccgcgagtccggctccggcggcgtagcgcaggtcgccgggtaggttgaaatgtgccgggtggcggctgcgccttacccggcctacaaggtaaccccaggcccggcaagcgcagcgccgccgggcatccggattcagtcagcatgtaagcccggcaagcgcagcgccgccgggcatcacaaccgcaaatcagaccacgccctgcgccagcatggcgtcggcgatcttcacaaatccggcgatattcgcgccgcgcacgtagttggtctgcttgccatctccgccgtactccacgcaggcgtgatgaatatccagcataatatggcgcagacgcgcatccactttttccgccttccagctcaggcgcgcggcgttctgcgccatctccagcccggacgtcgccacaccgcccgcattcgccgctttacccggcgcgaacagcacccccgcttcgaggaacagatcggtggcttcgatggtggtcggcatattcgcaccttccgccaccgcttttacgccgttggcgataagcgtgcgggcggcgtcggcatccagctcattctgggtggcgcacggcagggcaatatccgccggcactgaccatggctgtttgccttccagatataccagcccgaactcgcgggcataatccgccacgcggccgtcgcggctggctttgatttcacacaggcgcgccagtttttctgcgttaaagcccgcttcgtccacgaccgtgccgccggaatcagaggcggtgatcacccgcccgcccagttccatgactttttcaatggtgtactgcgccacgttgccggagccggagaccgccacgcgctgcccttcgaaggccagaccgtgacgtttaagcatcgcctcagtgaaatagaccagtccgtagccggtggcttccgggcggatcaaactgccgccgaacgacagccctttgccggtaaatacgcaggcgctgttattggagagctttttcatcataccggccataaagcccacttcacgaccgccgacgccaatatcaccggcaggcacatcggtatccggccccaggtggcggtacagttcggtcatcagcgactggcaaaaacgcatcacttcgccttcgcttttgcctttcggatcgaaatcgctgccgcctttaccgccgcccatcggcagggtggtaagggcatttttgaacgactgctcaaagccgaggaatttcaggatcgataagttcaccgacgggtgaaaacgcatcccgcccttataagggccgatggcggagttaaactgcacgcgccatgcgcggttgacctgcacctgattacgatcgtcgacccataccacgcggaactggatcacgcgttccggctcaaccagacgttccagtaacgacatctgccggtaacgcgggttctcttcaataaagggccacagcgtggtcatgacttcgcgaaccgcctgggcgaattctgtctgatggggatcgcgttgttgaatacgggtaaggaaggtttccagagagcaagactgatccatcgatataacatcctcttatgacagtgggtctgaattttattgttggttgttaccgcattgtttgcgttttcgactataacaccggaaaagcggcatcaggcaagcgattaagaaatatgcagggaaattaataataggcaggaggtcataattaaaaacgatgaccgtgcacgttaaaggttcggcgatcttttaccgttatagttattaccaccacctaatcaggaaaaaaaacgatgatccgacacgctttattaaccgccagcctgctggcgctgctgaccgcgacggcacaggcagaggtgcggtacagtaccggcggcgttgatgtgaacgtgccgccggaagtcttctcctccggcgggcaacgtccgcagccctgtaatcagtgctgcgtttatcaggatgaaaactactcggaaggggcggtggtcaaagctgacggcattttattgcagtgccagcgtgacgaacgcacgctgagcaccaatccgctggtatggcgtcgtgtgaagccctgaggcttacagatcgaagcttgcccacacaggcgcatgatcggacggtttttccataccgcggatctcgtaatcgatcccggtgtcggtgcagcgggttgccagcgcactgcttgccagcaccaggtcgatacgcagcccgcggttatcgtcaaaaccttttgaacggtaatcaaaccaggaaaaacgatcctgtgcgtccggattggcggcgcggaaggtatccaccagcccccagccctgcaaacgggccatccactcgcgctcttccggcaggaacgagcatttacccgcgcgcagccagcgtttgcggctgtcttcgccgataccgatgtccagatccgtcgggctgatgttgacatcacccatcaccagcaccgggctgtctttgctgatttcgttttccagataatcctgcagatcctgataaaacttcgctttcgccgggaatttggtcggatggtcgcggctttccccctgcgggaaatagccgttgatcaccgtaatattgccgaggggagacgctaattccgccatgataatgcgacgctgcgcttcttcgtcatcgcccggaaaaccgcggcgcacggacaccggtgtatcgcgggttaacagcgccaccccgtagtgacctttctgaccgtgataaaacacgttgtagcccagtttcgccacatcttcgagagggaacatatcgtcatggacctttgtctcctgtaagccaatcacgtcaggctgatgcttatcaatgatcgcttgcagttgatgaggacgggcgcgcaggccgttgatattaaaagagacaaatttcatagtcgctgccacttagcaataaagagtgcagcgatggtagcagaaaatggccggcgttacgccccggcgctgcgcttttctgcgcatggctgcaacaggcgtcgccaatggtgcttaccatgccccgctgcggtgcatcccgccctgaaaaggggcgcggggcgcgatcaccttccgcgtaagatcacaattccagaattatattttagcaatgcataaaatttcctgccgatccgcccggcttcgctaatagcgcaaaaattattcactttttatgcaataaaagtgaatagtgacagattgtaagttactgatatttaaaatcctctccggcgttatgcacttttatcgctggctggcacgaagcgtgcaatctacattagcagcgcaaacactcataattattaacatatcaacaacctttcatttaccggatgaggtcgctatgtcccactctattacgcgtgaaaactttgatcactggatgctgccggtttacgccccggcgtcttttattccggttcgcggcgagggttcccggctgtgggatcaggaagggaaagagtatatcgactttgccgggggtattgcggtgaatgcccttggtcatgcgaacccggcgctgtaccgtgcgctcagcgaacaggcggcgaagttctggcacaccggcaatggctacactaacgaaccggcgctgcggctggcaaagcgtcttatcgacgccacctttgctgaccgcgtgttcttctgtaactccggcgcggaagccaacgaagcggcgctgaagctggcgcgtaaatatgctcacgaccatgcaggcccacagaaaagcggcatcgtggcgttcaaaaacgccttccatggccgcacgctctttaccgtcagcgcaggcgggcagccagcctattcaaaagattttgcgccgctgccgccggagatccgccatgcggagtttaacaatctggaatcggcccgcgaattgattaatgacgatacctgcgcggtgatcgtcgagccgatgcagggcgagggcggcgtggtgcctgcggatgcagccttcctgaaaggcctgcgcgagttgtgcgatcgtcaccaggcgctgctgatttttgatgaagtgcagaccggcgtcggacgtaccggcgagctgtatgcctatatgcattacggcgtggagccggacgtgctcaccaccgccaaagcgctgggcggcggcttccccatcggcgcgatgctgacccgcgacgcttttgcggctgtgatggtggtcggcacccacggcaccacttatggcggcaacccgctggcgacggcggtggcaggtgaggtgctggatatagtgaacaccccggcgacgctggacggcgtgaaacagcgtcatcaatggtttgtcgaacagttgcaggcgatcaacacccgccatgcgctgtttcgggagatccgcggcctcggcctgctgattggctgcgagctggcggcggaacatgccgggaaagccaaactcatctctcaactggcggcggcagaaggcgtgatggtactgattgccggtgctaacgtgctgcgttttgcacctgcgctgaacatcagcgaagaggaagtgcgtcacggcctggaacggctggcgcgcgcctgtgaacgttatctggcaggagaaagcctatgatggtgatccgcccgattgagcgcagcgatctcccggccctgatgcagctggccggtaaaaccggcggcgggctgacgtcgctgccggcggacgaagccacgctctccgcgcgcattgagcgcgcgcgcaaaacctggcaggacgaactgccgccgggtgaacagggttacgtgttcgtgctggaagatatccagagcggcactgtcgccgggatctgcgccattgaagtggcagtggggctaaacgatccctggtacaactaccgcgtcggcacccaggtgcacgcctccaaagagctgaacgtctacaacgcgttgccgacgctgtttctcagtaacgatcacaccggcagcagcgaactctgcacgctgttcctcgacgccgactggcgtaaagagggcaacggctatctgctgtcgaaatcgcgctttctgtttatggccgctttccgcgatcgctttaacgaaaaagtggtggcggagatgcgcggggtgatcgacgaaacgggctactcgccgttctgggaaagcctcggcaaacgctttttctccatgccattcagccgcgccgatcacctgtgcggcaccggacagaaagcctttatcgccgagctgatgcccaagcatcctatctatacccatttcctgtctgaagaagcccaggcggtgatcggcgaagtgcatcctcacaccgcccccgcccgcgcggtactggaaaaagagggcttccgctaccgtcactatatcgacatctttgacggcggcccgacgctggaatgcgacatcgatcgggtgcgggcaatccgtaaaagccgtctggtggaggtggccgaagggcagcccgcgccgggcgagttgcccgcctgtctggtggctaacgaaaagtaccagcaattccgcgccatgctggtgaatgccgatcccgataccgaacgtctgctgctgagcgccgcccagatggacgccctgaaatgtcgcgccggggaaaaggttcgcctggtccgcctgtgcgcagaggagaaaacacaatgaatctttggataaatggcgactggatcagcggtcagggcgaacaacgggaaaaaaccgatccgctcacccgtgagacactctggcaggggcgtgatgccgacgccgcgcaggtggccgaggccgggcgcgccgcacgcgccgcgtttccggcgtgggcgcgtcagtccttcagcgcacgacaggagattgtcgagaaattcgccgcgctgctggatgcgaacaaagccagcctgacgacggtgatcgcccgggaaaccggcaaaccgcgctgggaagccgccaccgaaattaccgccatgatcaataaaatcggcatctcggtgaaggcgtatcacacccgcactggcgagcagcacaccgccatgccggacggcgccgccacgctgcgccaccgtcctcacggcgtgctggcagtattcggcccctacaacttccccggccatctgccgaacgggcatatcgttccggtgttgctggccgggaatacggtgatcttcaaacccagcgagctgacgccctggagcggcgaagcggtggtgaaactgtggcaggaggcggggctgccgccgggcgtgctgaatctggtgcagggcgggcgcgacactggccaggcgctgagccagcttgccgatctcgacggtctgctgtttaccggcagcgccagcaccggttttcatctgcatcgtcagcttggcggtcagccggagaagatccttgcgctggagatgggcggcaataatccgctgatagtggaagatattgatgatgttgacgccgcggtgcacctcaccattcagtcggcctttattaccgccgggcagcgctgcacctgcgcgcgccgtctgctggtgaaacgcggcgcgcagggcgatgcctttctcgcccggctggtggaggttgccggacgcattatgcccggcgcctgggacgcggatccgcagccctttatcggcgggctgatttccccgcaggcggcagagggcgtgtataccgcctggcaggcgcaggaagcgcggggcggcaaaacgctgctggcgccgcggctgatcaaacccggcacctcactgttgacgccgggcattatcgagctgaccggcgtggctgacgtgccggatgaagaggtcttcggtccgctgctgggcgtgtggcgctatgacgagtttgacgaggccattcagcttgctaatgccacccgttacgggctggcctgcgggctggtcaccccgtcacgggagaaattcgaccggctgttgctggaggcgcgcgccgggatcgtcaactggaataaaccgctgaccggtgccgccagcaccgcgcctttcggtggtgtgggcgcgtccggcaaccatcgcccgagcgcctggtatgcggcagactactgcgcctggccgatggccagccttgaatctccggcgctgtcgctgccggagagcctcagcccggggctggattttggtcgggaggagacgcgatgaaagcgcgcgaagtcaattttgacggcctggtggggctgacgcaccattacgccggtttatcctttggtaacgaagcctccactgcacaccgtttccgcacttctgacccgaaactggcggcgaagcagggactgctgaagatgaaagcgctggcggatctgggctttccgcaggcggtgatcccgccccacgaacgcccgaatataccggtgttacgccagctggggtttaccggcagcgacgagcaggtgatcgccagagccgccgcgcaaaccccggagctgctgtcggcggccagttcctcgtcgccaatgtgggtggccaacgccgccaccgtctgcccgtcgtcagatgcccttgatggcaaagtgcatctgacggtggcgaacctgaacaataaattccaccgcagtaccgaagcgcccaccaccgaagcgctgctgcgcgccatcttccgggatgaagggcgtttcatggtgcatggcgcactgccgcaggtggcgcgttttggcgacgaaggggcggcgaaccataaccgcttcagccaggcgtacggcgagccgggcgtgcagctttttgtttatggccgggaagaaaacggccacgccgcgcctgagcgttatccggcgcggcaaacgctggaagccagccaggcggtggcgcgtctcaatcaggtggatccggcgcgcgtcatcttcgcccagcaaaacccgacggtgatcgatgaaggggtattccataatgatgtcatcgccgtgtcgaacggtacgctgctgttctgccatgagcgcgcctttgtgcagcagcgcgggctgatgacccgcctggcggaacaggtgccgggctttcaggttatcgaagtgccgcaggcgcaggtgtcggtcaaagaggcggtcagcagttatctgtttaacagccagttactgagccgcgacgacggcagtatgttgctggtggtgccgcaggagtgtcgcgagcaggcgaacgtctggcgttatctgaatgacatgctggcgcaggataatccggtgaacgagctgcgggtattcgatctgcgcgaaagcatgtccaacggcggcggtccggcctgtctgcgtctgcgggtggtattaaatgaggccgaacagcaggcggtaaatccggcggttatgatgaatgaccggctgtttgccgcgctgaacgactgggtggatcgctactatcgtgaccgtctcacccaggccgatcttgctgatccgcagctgctgcgcgaaggccgcgaggcgctggacaggctgacacagttactggatctgggatcggtctatcccttccagcaataaggatcgacgatggagaattttcttgccctgaccctgagcggccgtgcgcccgaaaacccgtgggggcaaaacgaccagctccgctggcactggcgggcagaggggatccttgagctgatcccgcatcagcccacggataaatcgctggtgctgtcggcgggcattcacggcaacgaaaccgcgccggtggagatgctggacaagctgctgacagggctgatacagggcgccacgccgctgcgctggcggatgctggtgatcctcggcaacccgcccgcgctgcgggccggaaaacgctatctgcacagcgatctgaatcgcatgttcggcgggcgctggcagcagtttgcccacagtgtggaaaccgtacgggcgctacagctggagcaggcaatcagccgcttttatgccgcgcagcccggcgacctgcgctggcatctggatctgcacacggctattcgcggctcgcaccatctgcgctttggcgtactgccgcagcgcgacacgccctgggaagaggactttctgcgctggctgggtcaggccgggctggaagcgttggtgtttcaccagtcgccgggcggcacctttacccattacagctgcgaacgctttggcgcactggcctgtacgctggaactgggcaaggcgctgccctttggcgaaaacgatctgcggcagttcgccgtcacgcttgacgccatcgcagcgttgtcagcggataaaccggccgcgggcagtgatgtcgcgccgctgcgctatcgggtcgttcagcaactcacccgccacagcgctgctttccggctgcatatgtccggcgagacgcttaacttcacgccttttgccgccggaacgctgctggcggaagacggcgaaacgcgttatctggcgcaggccgcgacggaatacgtgctgtttcccaatccacaggtagccctgggactacgcgccgggctgatgctggagcggctgccctgatgcgctggcgattatttttatcgcgattaacgcttttctggaaaatataaaaaccgatgatgtcaggcgatacggaattatctgacatcattgctttattattatacgccgctcaggtatcattcttcataatctctttaaaatcatcatcctgtataattcctgttgcaactctccacgctttatccttattttcttcataattggcgataatttgttttttacgctttcaatgctttactgttgctctgattatttgacgaaaaagaccgtaaagtgaatctcgtcaacacggcaatacgccgcaagaataactgaaagaaggaatacattatgcgtaaattgaccgctctgtttgttgcctctaccctggcgatgggtgctgctaacctggcccacgccgctgataccaccgctgcgccggcagacagcaagccgatgatgcaccataaaggcaagccgggtatgcatcatgacatgatgtttaaagatctgaacctgaccgacgcgcagaaacagcaggtgcgtgacatcatgaaaagtcagcgcgaccagatgaagcgtccgaccgtggaagaacgccgcgccacgcacgacatcatcgccagcgataccttcgataaagccaaagccgaagcgcagattgcgaagatggaagagcagcacaaagcccgtatgctggcgcacatggaaacccagaataagatttacaacatcttaaccccggaacagaaaaagcagtttaatgccaattttgagaagcgtctgacagaacgtccggcgccggaaggtaaaatgcctgaatccgctgaataacacagcgccccttattaagaccgccggacttgtccataaacgccttcaggctgtgggcaagcccggcggttttttcttttcttccctctttgacccccgcctgcgacagggtatgctctgataccttattacgcgaaactacctttttatcaggctgttaaaaaaattcttccaggatgcagcgtcattgctaaggcattacctgtccgctgccgataacctggtggcaaggtaaacagattataacaatgtggtgcggctttccggctgcgcaggcgcgcgtgatgcgcccttcaggagtggtgatggaatattttgatatccgcaaaatggcggtgaatctgtggcgcaacggggcgggcgaaacacgggagatttgttgttttccggaagccacgcgggatttccactggcgcgccagcattgcgtctcttgccgctaacggcgagtttccgcagtttcagggggtggatcgcgttatcacgctgatagaaggcggggaagtgaccctcgacgggggaaatgccttttgccataccctgaaacggctgcaacctttctctttttcaggtgagcagccgatcaaggtacagctgaacgacgggcagatgtcgatggatttcaatatcatgacccgccgcgatcgctgccaggcgaaagtgcgcatcgccgatcgcaccttcaccaccttcggctcgcgcggcggggtggtcttcgtactcagcggcgcgtggcaactgggggataagctgctgaccgcggatcagggggccagctggcaggaaggtagccataccctgcgcttactgaaagcggaagggcagctgctgttcagcgaaatcacctggctgccggggcattaaacctgcgtaccggcagacgcctgccggttcagggggcggtaaagggcagctcgtgaatatccatgatccccgccatcagcggcttgcagagaattttatagccatcctgatcgaaaccggcaggcgttttcagcagtgacgacgcctcgtccagggaattgaccgagcccaaccagaaccagttgtgaataatatgatactgggtcatttcaccgctgctttcccgcagcgccaccgggccgcgccacggccagcacaccagctgcatgcgggtcatggcgtcacgcagacgctgatggtgcgcctcgacgctctctttcccgcaacaggcgcccgcgcagcgattcagcgctgaacggaaacaggcgcgaccgcgactgagggattccagcccgagcaggccgtagcagagtttgtgctcatcggcgatagattgcagggtttgcagcgcagcgtgtcgattggcaaacagcccgtacagcccctgctgcgaagaaaaatccacctctttggcgtagatcacttctggcttgtcgctgtcaaagcgcagggaacagagctgacggttgcggcgcaggcgtttattaaacaacggctgctgttctttaatcagcctggcctccagcaataacgcgcctatctccccggcagtaaggatccaggtgatacgccgcgactggcgcagcatggacgcttcgtccggggtgcgcaaatgcgacaatacgcggctgcgaatattgatgctcttgccgatatacagcggcatggtgtcgctgtcgccatgaaagaaatagacgccgggatgcttaggcaatgcctccagccacgggcgcagatgttcgggatattcataaatggccgccgcttcaaaatgcaggcgcggggctgattgacgccttaccacacatagactcctgatactgtttacttatccagtgtagcaggcaaatcgtggcgaaaaaagaggcggcttgagccgcctggtgagattaaaccctgattgtgagcttttgccgggtggcgctgcgcttacccggcctacaaatcaaggagttgctattttttccagaaatcgtcaaaaaccgtcaccggcaggcggcgtttatgttcggttttcagataccagccttcgatggtacgcgcatgggtttcatcaatggttttgccttccagataatcgtcgatcatctcataggtgacgccaagggcgacctcatccggcagggcagggcgatcgtcttccagatcggcggtcggagcctttttatacaggtgctccgggcagttcagctgcgccagcagctgttttccctgacgtttgttcaggcggaacagcgggttgatatcggtgccgccatcgccatatttggtgtaaaagccggtcacggcttccgccgcatggtctgttcccacgaccacgcctttggtcattccggcgatgctgtactgcgctttcatacgctcacgggctttttcgttgccgcgaatgaaatcgcttaattcgatgcccgcgtcgcgcagcgcctgctcgctcgccagcactgccgctttaatattcaccaccagcacgcgatccggcccgatgaagttgatcgcatcctgacaatccttttcatccgcctgtacgccgtggggcaagcgtaccgcgataaaggcgtagctttcgtcgccggtttcctggcgcagctcgctgatagccatctggctgagcttaccggcgagcgtcgaatcctgaccgccgctgatgcccagcaccagtgacttcagaaagggatgcgctttaagataggatttcaaaaaatccacgctacggcgaatttcttcttctgcatcgatgcgcggcttaacgcccagcgcctgaataatgtcttgttgcagcgtcatgacaacactctccgtctgtcgcccttgagggcagatgttaagtagcaatcttttcaaattaacccgttgtggctaaaacgacaaggcgcgacggcgcagggagcgcaaataaccaccttttgtctgtctctctttgttttattagatttttcttaaagttaagtcaatgtcgtcaggaggttgaaaaaagttattttatattccaggcttagataacgcgctgatacacaagcggataacaagaggaaggatcaatatgaacaagaaactcgcaggaattttgggtaccgcggccgtaatgaccatgctggcaggttgtactgcttacgatcgtactaaagatcaggtgaccacgccggtggtgaaagacgttaaaaaaggcatgagccgtgcgcaggtaatgcaggttgccggtaagccttcttccgaagtgaccatgatccacgctcgtggtacctgccagacctacattctgggtcaacgcaatggcaaaacagaaacttactttgttgccctggacgaaaccggccacgtgatgaactccggttatcagacctgtgcggaatatgataccgatccgcaggcaccgaagtcctgatccctttaagcctgagcaaataaacaaaccggccaccgcgccggtttctttttgtctcaaaatcttatttcttgacgcgaattatttgccgaattgtgaaggctatcatcctgccaggtcaatgagagacaattcgggttagcgacggattatcgcccccaggcgggatgctgtatattttcttcaaccagaaacaaaagtaactcaagggttcacgagttatcccagccacccacacaggtccccatgcaggcacacctgttgcggttgaaacgtaaggaaggttgtgatggaaaagaaatacatctatctgttctgctcggcgggcatgtccacctcgctgctggtgtccaaaatgcgcgcgcaggcagagaagtatgaggtgccggtgatcattgatgcatttcctgaaaccctggccggtgaaaaaggacccgaggccgatgtcgtactgttaggcccgcaaatcgcctatatgttgcctgaaattcaacgtctgttacccaataaacctgtcgaagtgattgattccatccattacggcaaagtggatggtctggctgtactgaaaactgctgtcgccgccattaaaaaagcagcaaattaattttatttcttttccccgtcaaagagttatttcacttactttcgccgcaatagtttattgcggcttttaaggacttttctatgagcaaagcaattgattcgctggagcaaatgctgatcccttttgccgtaagaataggaaaacaaccccacgtcaatgcaattaaaaacggctttatccgcttaatgccgttaacccttgcaggggcgatgtttgtattaattaacaacgtattcttaagttttggcgaaggatcgtttttttactctttaggtattcgtctggatgcctcaaccattgaaacgctgaatggttttaaggccatcggcggtaatgtttataacggcactttaggcatcatgtcgctgatggcaccattttttattggtatggcgctggccgaggagcgaaaagtcgatccgctggccgccgggttattagctgtcgccgcctttatgacggttacgccttacagcgtcggcgaagcctatgccgtgggcgcaaactggctgggcggggccaatatcatttccggtattattatcgggctggtggtggcggagatgtttacctttgtcatccgccgcaactggatgatccgtctgccggacagcgtcccggcgtcggtgtcccgctcattctccgcgctgatcccaggctttctgatcctctcggtaatgggcattatcggctgggcgctcaccgcctggggcaccaacttccaccaggtcattctcgattccgtctcaaaaccgctttccgcgatgggcggcgtggtcggttgggcctatgtgattttcaactcgctgttatggttcttcggcgtccacggttcgctggcgctgacggcgctggacagcggcatcatgaccccctgggcgctggaaaacatggcgatttatcagcagtacggctccgttgacgcggcgctggcggcgggtaaaaccttccacgtctgggccaagccgatgctcgattcttacgtgatgctgggcggttcgggtgccaccctggggctgatcatcgccatctttatcggttcccgccgcgcggattaccgtcaggtaggtaagctggcgctgccgtccggcatcttccagatcaacgaacctatcctgttcggcctgccgatcatcatgaacccggtgatgttcattcccttcgtgctggtgcaaccggtgctgaccggcatcatgctggcggcctactacacgggtattattccgccggtgacgaacatcgcaccctggacaatgccgaccggcctcggcgctttctttaacactaacggcagcgtggcggccctgttgctggcgctgttcaacctcggtgtcgcaacgctgatttacctgccgttcgtaatggtggccaataaagcgcaggcggccattgaggaagaagagagcgaagaagatattgccaacgccctgaaattttaagcctgacggcgcaggctgccgttagcctgcgccggactgacatgaggaagataagatgtttaatctggatgatgttgtggaaaccgagcttgccaccgatgaactggaagaagtggtgatggggcttatcattaactccgggcaggcgcgcagtctcgcttatactgccctgaagcaggcgaaagcgggcgatttcgcggcagcgaaggaaaccatggcgcagtcccgtaccgcccttaacgaagcgcatcgcgtgcagacgcagctcattgaaggcgatcagggcgagggccggatgaaggtcagcctggtgctggtgcatgcgcaggatcatctgatgacctcgatgctggcccgcgagttgattgccgaattgattgagctgcacgaaaaagtgcgctaatacaggagccaacgcatgatgcagccacaagtgaacgcgatggaaatcaaaaccgcacgggaacagcagttgttcaatggccggaactttcacgtcttcatctacaataaagtggagagcataagcgggctgcaccagcacgattattacgaattcaccatcgtgctgacggggcgctactatcaggagatcaacggcaaacgcgtgctgcttgagcggggcgattttgtgtttatcccgatgggatcgcatcatcagagcttctatgaatttggcgccacgcgcattcttaacgtcggcgtcagcagacagttttttgaacaacactatctgcatctgctgccgttctgctttgtggcgtcgcaggtgtatcacgtaaaaagcgcatttctgacatggattgaatcggtgatcgcctcgctgaatttccgcgataacgagttcaatgaatttatcgaagtggtgactttttatatcgtcaaccggcttcgtcaccaccgggaagaggtggtgcagggcgacattccgcagtggcttaaaaccaccgtggaagagatgcacgacaaaatgcagtttggcgaaaacgcgctggaaaatatggtgaaattatccggtaagacgcaggagtatttaacccgcgccacccagcgctattacagtaaaaccccgatgcagatcatcaatgagatccgcattaattttgccaagaaacagctggaaatcaccaattactcagtcactgatattgcttatgagtccggttacagcagtcccggtttatttatcaagacgttcaagaaagtgacgtcctttacgccaggcagttaccggaaacacctcaccgttattaactgattaaggcacgcctttattttacggtcagtgcgtaagagagatgttatgaataaaaaactgaaagtcgtcaccatcggtggcggaagcagctacacccctgaactggtcgacggatttattaaacgttatcacgaactgccgatagacgaattatggctggtggacgtggaagacggccaggaaaagctgaatattatttatgacctgtgccagcgcatgatccagaaagcgggcgtgccgatgacgctgcacaaaacgctggatcgccgtgcggcattgcaggacgccagttttgtcaccacccagctgcgcgtcggtcagctacaggcgcgcgagctggatgaacgtattccgttaagccatggctatctggggcaggagaccaacggcgcgggcggtctgttcaaagggctgcgtaccattccggtgatttttgacatcatccgcgatgtggaagagatctgcccggacgcgtgggtgatcaactttaccaacccggcgggcatggtgacggaagcggtctatcgtcataccggctttaagcgctttatcggcgtgtgcaatattcccatcggtatgaagatgtttatccgcgatgtgctgagcctgactgacgaagacgaactgggtatcgatctgttcggcctcaaccacatggtgtttatcaaggatgtgctggtcaacggcgaatcgcgctttgcggaactgctggacggcgtggcctccggcagattaacggcgaattcggtgaaaaacatctttgatctgccgttcagcgaaggactgatccgctcgcttaacctgttgccgtgctcttatctgctgtactacttcaagcagaaagagatgctggccattgagatgggcgaattctacaaaggcggcgtacgggcgcaggtggtgcagaaagtcgagaaacagctgtttgacctgtacaaggatccggcgctggcagtgaaaccgaaagagctggagcagcgcggcggcgcctactattccgacgcggcctgcgaggtgatcaacgctatttataacgacaagcaggcggagcactacgttaacgtgccgcaccacgggcatattgataatatcccggcggactgggccgtggagatgacctgcatcctcggccgggatggcgcgaagccgcacccgcgcgtgacgcattttgacgacaaggtgaaggggctgatccataccatcaaaggctttgaaatcgccgccagccaggccgcgttaagcggtgagtttaacgatgtgctgctggcgttaaatttaagcccgttgatccactccgataaggacgcggaaatcctcgcgcgtgaactgctgctggcgcatcagaaatggctgccgcgctttgcaaaaaccattgaaggctttaaacgctaaggagccagcctgtggaaaggttactgatcgtcaatgccgatgactttggtctgtgcaaagggcagaactacggcattgtggaggcctgctcgcacggcgtggttacgtcgaccacggcgatgatgaatgcagaggcggtggaacatgcggcggcgctcagccgcgcgcttccgcagctggcggtcggcatgcattttgtgctgaccctcggcaaatcgttaagcccgatgccggggctgacgcgggacggcgtgctgggcaaatggatctgggagatggcggagcaggacgagctgccgctggcggagattgagcgtgagctggcgtgccagtatcagcgctttattgactgctttggccgcaaaccgacgcatatcgacagccatcatcatgtgcatatgctgccgccgatcttcccgctggtggccgcctttgccgcggataaaggcgtcgggctgcgtattgaccgcgaggtggcggcgcttcacggtctgccagtgaacgcggcgtgcagcagcgaaggctattccagcggcttttacggcgaggcgatatcggaggcgctgtttcttgaggtgctggatgcctccggcgcgcggggcgagcagtcgctggagataatgagccatccggcctttgtcgacgacacgctgcgcgccagcagctattgctggccacgtctgaaagagctggaggtgctgacctcgccatcgctgaaatatgcgatagcggagagggggtatcggctgggatcctggcgggatttgccttaacaggttcatgcccggcggcgcaaagcttgccgggcctacggtacagtaagtaggccgggtaagcgccagcgccacccggcatttttgtatcccagaactgtaggccgggtaagcgtcagcgccacccggcacattctttccgctacgccgggatcttgctgattttgcccgcccgcgaccagacgcggtgtcccgccagctgcatcaggaaatcatccatccactcctgcgtgacactgtcaccttcggtgatgccttcttcgccctgcgcatccaccctcagcaccgctttaaaggcgcgcgcatcgccggccagcgcgatcggcttcaggtgcttataggcttccagcagataatagttagcgtcgccattgtccagcaggctggcaggattcccgcctggcaccagcacgccatcgacggtcagcgacggtgaacccgcaaaggtcgcggcgatcggcacctgcgagccatcatccgccgtcacttcgcccatacgcgaataaagcagtttagcgtgcacgccttttgcctgtaagccctgcaacagggtatacaactggctggcggagacggtgtcattcagcagtaccgccaccacgcggcccttcagcgtgccgtcaggaatggcatacagactcagcgatggatcctttttcaggccgctgacatcctgcggcggcgcgatgttgcgctgatcgtcggtcagggtgatccccaggttgtgcgccaccgcctgcgccagggtaatgtcgatatgcgccagctgatccaccacccgctcgcggatataggcccgcgccactttgcccagctcgaagctgaaagcctcgataatatgctgctgctcatgaggcgtctggctctgccagaacagccgcgggtgggcataatactcgccaaacgaagggctgcgctcgcggatcttatgaccttcgatacgctcctgatatgactcaaatcccccgcgctgcggtgcaggcggcgtttcccgcggccagttatcgttaatcgagttaggctcatagtttgccggattagtgtcgatatccatgcggtgcatgccgtcgcgctggaaattatgatacgggcaggtggggcggttgatggggatttcgtggaagtttggtccaccgagacggctaatctgcgtgtcggtataggagaacagccgtccctgcaacagcggatcgttggtgaaatccagccccggcacgatgtgccccggatggaaagctacctgttcgttttcgctgaagaaattgtccgggttacggttaagcaccattttgccgacgcgctgcaccggcaccagctcttcggggatcagtttggtgggatcgagcaggtcgaaatcaaatttgaactcgtcctcttcggcaatcagctgtagccccagctcgtattcagggaaatctccggcttcaatggcttcccacagctcacggcgatggaaatccggatcgcggccggtcagcttttgcgcttcgtcccataccatagacgctttacctgccagcggtttccagtggaaacggacaaaggtggctttgccgtcggcgttaatcaggcggaaggtatgaatgccgaagccttccatggtgcgatagctacgcggaataccgcgatcggacatcgcccacatcacgttatgcagggtttccggttgcagcgagacataatcccagaaggtatcatgggcgctttgcccctgcgggatcgcccagtgcggctccggttttaccgcatgcacaaagtccgggaatttatgcgcatcctgaataaagaacaccggcgtgttgttgcccaccagatcgaaaatcccttcgtcggtataaaacttagtggcgaaaccgcgaatatcccgcacggtgtcagccgatcctgcgccaccctgtaccgtggaaaaacgcacaaacaccggcgtgattttatccgggtcggcgaggaagctggctttagtaatgtcgcttaacgagcggtagggctggaaatagccatgcgccgccgagccgcgggcgtgcacgatgcgctcgggaatacgctcatggtcaaaatgggtgatcttttcccgcagaataaaatcttccagcagcgttggcccgcgctgacccgcgcgcagtgaattctggtcattggcaatgcgcacaccctgattggtggtcagcggaaaattttcgccgcccttacggaagctttccagcgccttgagtttttcattggaggtatccggcgctttcaggctgccgggggcagtaggctgcgccccgggcggagtcggtaacggatcggcctgatgggagttgtcttccggggcgagtgagtccagaccgggacgggcggcacggtcatcgtggaccggggcatgatgatttttgggatgactatcagaatgcgacatggaacaggtctcctgtttttgctgcggggtgttggcattgaaactggccgtttttacgtcaaattctttctaactatagaacagcacacgattttttaccctggtgcttcgcagataaaaaccccgcaggggcaggggaaaaacaggcagggcgcgacgaggagggggagtttcagctatgatgggagttgcctgtttgtggaatatgtttttagtgaatcctggcttatgaaatcattgcgtcaacaaaaccgtcggattatcagctatgtgccacgtgtcgagcctgccccgcctgaccatgcctctaaggtcgaaggttttcgcgatgtgtggctgttacgcgggaaatatgtcgccttcgttttaatcgccgagcgttttcgtcgttcgccggtcttcagcgggccggaagccgcccagcgctgggccgaacagatgcggcaggaaggggaagtggatcaggattgatacgtcgggcgggaaaataccgcccggcagactgcgtcgccgggcggttaaagcttaacgatgcgccagttcggcgttttcttcgctgttcagaatggttttgtcggtctgcttcagccactggctggtgagcgtaccggcggtcattgaaccgctgacgttcagtgccgtacgacccatatcgatcagtggctcgacggagatcagcagcgccaccagcgtgactggcaggcccatggccggcagcacgatcagcgcggcgaaagtcgcgccaccacccacaccggccacgcccgcagagctgagggtgacaataccgaccagggtggcgatccacaccggatccagcgggttaatgcctaccgtcggcgcaaccatcaccgccagcatcgccgggtacaaacctgcacagccgttctgaccgatagtcgcgccaaaagaggcggcaaagctggcgatagattccggcacgcccagacgacgggtctgcgcttccacgttcagcggaatggacgcggcgctggagcggctggtgaaggcgaaggtcagtacgggccagactttacggaagtatttcatcgggctgatgccgttcgcacccagcagaataccatgcaccacaaacatgatcgccagaccaagataggacgccaccacaaagctgcccagtttgatgatgtcctgcaggtttgaacctgccaccactttggtcatcagcgccagtacaccgtacggggtcagctgcatcaccagacgtaccagcttcatcacccagctttgcagcgtgtcgatggcggtcagcacacgctggcctttcggggcatcatctttcagcagcttcagcgccgccacaccgaggaaggccgcgaagatcaccacgctgatgatggaggtcggacttgcgccggtcagatcggcaaacgggtttttcggcacgaacgacagcagaagctgcggcacggtcagatccgccacttttccggcataatttgtctgaattgccgcaagacgcgcgctttccgcggtgccctgcaccaggccttcagccgtcagaccaaacaggttggtcaccagcacgcccaccagcgctgaaatcagcgtggtaaacagcagggtgccgatagtcaggaagctgattttacccagttgcgaggcgttatgcagacgcgccacggcgctcaggatagaggcgaacaccagcggcatcacgatcatttgcagcaactggacatagccattaccgacgatgttgaaccactgaatagaatctttcagcaccggattatcagcgccatagatggcctgtaaggcaaaaccaaagaccacgccgatcaccagaccgaccagcacttttttagccaggctccactgtttgtggcgggtttgcgccagcaggaacagcaaagccacgaacaccacgatgttcgcgattaatggaaaattcatccccaatctcctgatgtgtttttatttcaggcgtcagtacacctgtcttgttggcggaagagtagcagaagtgtgatgtggcgcttatatccaaatggaatgggttatattcaaacgcataaattcgtgggtttattgaccaatctgctcatgaataaagcggttgtactgcatttgcagggtattgatcatctgcgatgaccagcgcactgcactgttttcggtcatcgtctgcggcataaacaccgcccaggtgaacagcgccatacagagcacgcgctcaagttgattgcctttctggggcatcaggatcggcacgcggaaccgccagcggcacggccacaacagcggcacacccgcaggcgtcagcatatcggcaaggatatggctcagataacccagcaccagcccctgtaaggcatcggcgggcaccagccagctgtcgggcactttcagcataaatagcgtcagggcgataaataccgccagcagactgtgcgtaaagccccggtgaccgaaggcgcgggctatgggttttgagatccatttcagccgctggcctaaaaaagatttcgggtgatcgatatccggcagcagacaggtgagaatagctgacggaacaatatgccaccagtccccctgcgcgagcacaggggtcagctcggcgtttttggcaaacaccgcgcaggctatcgaaaaaaggaggtgaccttccgccgtcatgattgcactcgctaaactgtcgaagtatacagtatagggtttttatacagtaggcggaagaggtgacggtgtaactgtttatctcagtggatgactaacgcgccagccagccgccgtccactgccagcgtatagccattaatgtaatccgaggcgcgtgatgccagaaataccgccgggcctttcagatcttcaggcgtgccccagcgcgcggcaggaatacggttgatgatctcttcgctgcgccgggcatcgtcccgtaattgctgcgtattgttggtcgccatgtagcctggcgcaatggcattaacgttaatgttgtgcgtcgcccattcgttcgccagcaggcgcgtcaggccgagcacgccgcttttcgaggcggtataagagggcacgcggataccgccctggaaagagagcatcgaggcgatgttaatgatttttccgccgccgccctgggcaataaattgtcgcgccaccgcctgacagagaaaaaaggtggctttcaggttaaggttaatgacgtcatcccagtcctgctcgctgaagttcagcgcatccgcccggcggatcgtgccggcattattgaccagaatatcgaggcgccccatccggcttaccacttcctgcaccagcgcatcataagacgcctgctggctcagatcggcctggatcgccgtaaaacgacgtcccagcgcggtcactttctgttctgtttcatgcggatatttgcggttaatgccgacaatgtcacagcccgcttccgccagccccaggctcatcccttgtcccagccccgtgtcacagccggtgacgatggcaactttaccgcttaaattgaaggcatccagtatcatactcaccccgattgctctgatgtgtgcaggcaggcgcgcctgatggtgttgagcatagaaggaagggatttgaaaaacaaattaaagtgaaatgatgtttcagtttaattgacgcgggtaacaaaagggggcctgttacccgcaaaaagcttatccgcgcagatgcgaaacggtcagttccgccagggagtgaagcttcacatcggcaagggcgtaacggggatcgttctggttggcttcttccggcaccacgacagaacgcatacgcgcggctttcgaggcgatcataccgttaaccgaatcttccagcgccacacaggtcaggggatccacccccagcttcgcggcgcaatcaagataaacctgcgggtgcggtttactgtacggcagcgtcccggcggaggcgagggcatcgaagtaatcagtcagctcaaacatggcgagcactttttccagcatgtgcagcggtgaagccgaagccaggcctattttcaacccctgcgccttacacagcgtcagtgcttcacgcacgcctggcagcagcggacgcttttcttccaccagcgacagcgagcgggcgatgatccgttcagtcacttccccgcgatccgggccgttccacggctgctgggcataccacagatccaccaccatatcgatgcgcagaccgagcgtatcgggcagttcattacggcgggtgatatccacgcccaggcttgccatgacctccagttcagcacgatcccacaggggttctgagtcgatgagtaatccgtccatatcgaaaatagcagcaagaatttgacgcggcgtagacattaaaacctctccttattggggcgggtatcaggccattatggcctactccctatgataacgcctctaaagaacaggcgaaaatgaatatgagcgggtaaacttaggcgcaaatggaacgtctttaacaaggggaatacatgacgtatcaacaagctggacgcattgccgtgctcaaacgcgtgatgggatgggtaattttcatcccggcctttatttctactctgatctccgtactgaagtttatgtacgagcacagcgaaaagcagcccggcatcagcgcggtgatgcaggatttcgcccatgtgatgatcgagatgatgcgttttaacacgccgttcctgaatttcttctggtacaactcgccgctgccggattttcaccagcagctgaatattggcttctggatcatttatgcgctgatttttatcggcctggcgttacaggcctcaggcgcgcgcatgagccgtcaggcacgttttctgcgtgagaacgtagaagatatgacgattctggaaaacgccaaaggcgcagacggtctgtaccgcgagcagatcgaagcgcggatcgtggtgccgaatcattcaatattccgccagattttcaccctctatattttgccggtaattattatcgtgctcggctatctgttcttttcgctgctgggttttctttgacgcttgcgggtattgccgggtggcgctatcgcttacccggcctacgtaaactacgccgtcatataggccgggtaagcgcagcgccacccggcgatggcactcacttttacgccgcaaggacacgatccagcgctttctgcgccgtcgccagatgcggtccgccaaataatatcgcgcggttaaacagcgtatagagctgatagagcggctggcggtcgaggaatccggcgggcaggggcgatacggactgataaccgtcgtagatctgcggcggttgatccggatgcaggggcagcatcgccagatcgcactcacgatcgccccagtaacaggcgggatcgtaaataaaggggccgtccggaccaagcgcgcagttgccggaccacagatcgccatgcagcagcgcggcctgcggctggtgcgacgccagacgctgttttacatgctcaacgatggcgtcgatattgccgaactccagccctttttccgcggccagctccagctgccagccgatacgctgttcggcaaaaaacgttgaccagcgtcgctgccaggcgttgggctgcggcgtggtggaaaggtcattatcaaagtccagaccgaactgcggctgatcgctccactgatgcagacgggcaagctgttgtcccagcaaaaacgcgttatgcgcatccagcgggcgggcggggagataatccatcaccagaaaacagtaatcgcgatccgcgccaacggcccggacagggggaacgctgacggtctggctgcgggagagcagttcaagctgatcggcttctgccgtaaagatgggtaacagttcgcggctgtcgcatttaacaaaaaaatcgcgtcctgcgtagcgcatatgccaggcggcgtggatctcaccgcccggcagttcgtgccggaattcgatttcaccctcgccaaaggattcactcaacagacgacttatcgcttgccacatgatgtctctccccatgttatctgtcagatcataaggttagcgcactgatgcggaacaaaataagaactaacgcacacctgagccgcctgctgtgtgcaatggcacttattgtgctttttgctgctctgtttgccacgtttcccagcgggaaacggtaatttccggctgtttatccagcgcgctttccgccagagcagcggactgcgctttgacttcctcttcactcatggcggtgatcagaccaaaagtgttggtgccgagttcatgtaccttgccatcatcgtcggtcagcgtcagtaaaaatccggcgcgcgtgaaatggttgttcagttcgttaatttcactcagattgtcttcgtgaaatttgatcgtaaccacatagcgcgtaatgtcaccactgctcatcgttcacctcgttgttatcctgaaagtttttttagcatagtcgacgtgaggaatttggcgaccacaggaatggatgatttcccccgccaggcggcaggggaaaggggtattaatgacgaaccagataatcgtagattttttgcgtgtcctcatggccgcacagacgcgtaccctgattaatggtcgccgcgctgcctgccgccacgccaaaacgcaccatttccgttaaagaagcgccttccgccagcttcagggtcatggcgccgaccatgctgtcaccggcgcccacggtgctttggcttttcatcggcggcggcaccacatgcacgcactcgctgccatcaacgcccagcgcgccctgaggccccagcgaaaccaccacgcgacggactttgccgctgttcaccagctcctgcgccgctttgcgcacgtcatccggctgggtgagcgggcgatttaccagcgcgctcagctctttctggttaggcttcaccagttcaatgttgccaatctccagcgcggcggtcagggcatcgccggagctgtcgataatgcagcggataccctgctgctgggcggctttaatcaactgcacccaggcctccagttgcacgccggggggcaggctgccgcttaaaaccagcagcgcgccgctctcaatagccagcactttttcttccagtttgcggaattcatcggcgctgagcgcagcgcccggcatcacaaatcggtactgctcgccactggcctcaacatgcacatgcaggttctgacgggtccagtcctgggtttcaacgctctgtgtcgggacgttttcatctgccagcagagcggtaagatgttcgccggtcgcgccgccggccgggaaaatggccgtggctttgccgcccagatgggtaatggcgcgggcaacgttaattccgccgccgcccggctcaaataccggtgcagtacaacggagtttaccttcgggataaatttgcggcgttaaggtcgcgctgtccagcgacggggcaagcgttaatgtatagatgcgggtcatctttacctccttttagcgtgaatcttttaagcctggcaccgttccggcagatagcaacgtaaataaacgtatgatttatcttgtgaagttgaatttaatttgcgtcaggttgatatacacttaatgccggtttgagagctctcttattcaaaaaatgaaataagaattcattgctatgttaattgagcctttttataatttgttacctttctcaggacggttacgcgttgatcctgatgtaagtttccgggaccgtgatggtctctttttttgttgtacggactctttataaatgaagcttttaaagacagtacccgcagttgttatgcttgcgggaggcgtgcttgcgtcactgaatgctgccgcagatgataccgtttttactgtcatggatgacccctccactgcacagaaaccctttgaaggtaatctgaacgcaggctacctggcccagtcaggtaacaccaagagttcctcgctgaccgctgactccaccctgacctggtacggcaataccaccgcctggtccctgtggggcaacgccagcaacacctcttcgaatgacgagcgctcgtctgagaaatatgcggtgggcggacgctcgcgcttcaacgtgaccgatgcggattacctgtttggccaggccagctggttgaccgaccgttacaacggttatcgtcagcgtgatatcctcaccgctggttatggtcgccagttcctgaatggtccggtgcacagcctgcgttttgaattcggtccgggcgtacgttatgacgagtacaccgacggcgacaacaaaacacagccgctgggttatgcctcaggaacttatgcctggcagatgacagataacactaagttcacgcagggtgtttcggtatttggcgctgatgatacgacgctgaactctgaaaccgcgctgaatgtggctattaacgaacactttggcctgaaggtggcatataacgttacctggaactctgagccaccggcctccgcgccggagcacaccgatcgtcgtacggtcgtgtcgttaggttataagatgtaattgattttgggccgaaattttcggcccgctttatatatttcagattaattaatgacgcgcttaaaatatcaatatgcggttttagcttattaaaaattatgtttctccataatttctcctcatttatctcttcggacacacattcaatttatttgacaagatttgataaattattcgactgttcaaaagtgtgatccagctctaaacttactgtcatgggtcaataatgcccaaccagacgtacggtattaagttaaaaagagaagaatcattatgaaaacatttaaaactatcgcagcagcagcggtgctttcagccctgtcctttggcgttttcgctgctgacagcgcgtatacacctgccagtgacaccaccaaaccctcgactactttccaggcgaaagatatcgaagccggttctaacattcagccaggcgcaccgtctaccggccgttccgccgatgatgcttttaatgttaaaacgctggtggccggagagtggtattaatccgcttcccgctttcgttattaacttcgcttattacgattaaaaaaccggattacgacgtaccggtttttttatgtacgtaataaggtcagcaaattctccggcagctgattcgcaatcttcaacaccgcgttctgactctcctgcaaaatctgcgctttaatttgcttactggtttccagcgcgtagtctgcatccataatacgactctgagccgtttgggtggagagcgtctgttgtgacaataccgatttggctgaatcaaagcggttcatccaggccccgtactgcgcgcgatagccgcttacctttgccagcgcgttatcaagcgcgcccatggcgctactggctgactgcgccgaactcaggctggtgtcgcgaatgcccagcgttttggtgtcggctggcgtggcggtcatggtcattgcctgaatatcatcgccaaaattggcgctggtgatcacctccatcggaccactctttttcggcggtgtggcaggggtgatggtcggcgcaggcagatttccccaggtcaggttgctggtaaaggaaccgctgccaacgatcaccacgatcaggtcttcactgacgttatcgatggtcaggcgctcaaggcggttggtgccattcgagccgtcgttgtacgcgcccatgccccggtcttcataacgatcgccatcgccactgtaggtgatggtcatgccgttataattcagcgtcgcgctgccgttgaggttccaggccgcgccgccttcgataagctggctgtcgtcatacgttgcgccgctctgaaaaccgttggccgcggtcagcaatttactgtcggctttcgccgcatcggtgatgccgcggctgacccaggtataatccggatccggcccggtaaagggcgtgcccgccagatgcttgccatcacgggtaaacagctgaatgtcatcgtccagaccgagggagtcgatggtcagattgatattggtcgaacccgcgggtaaataagccagcggtaccacccctgagctaaaggtataattgctaccggcaacgggaaatttactgctgatcggcgccacgtcgccaatcagggcagggggcagttccgggttcgccgtagccagcgggtatttaccaaaaatttccgtttgttcggaaagatcgttgatcccggccagaatactttcatattcattctggatgctgctccggtcgctttcagacagtgtgtcattaacggactgaatggcaagacttttagcgcggatcaaaagatttgccaccgacccgaggcttccgtctgcggtttgtgcaagactggtcgcgtcatccagcccacgggaaatcaccgtgtcggcattaatgttcgagcgcattctgttggtaatagcaagcccggccgcgtcatccatggctgaattgatgcgtaatcctgacgacagcctggcaatggtttgcgaaaggagcgatgtggtgctttgcctcgcaaccagattcagcccggcgatcgcattatgattaatagcttgcatgtgcgtttcttaacgattctcttggccccggataacctggtcatcggcaaaatacgccatgactttaatgcaaatcttcagtattgctggcgttcttcacaggtatccgggcaagaataagtctaaaatttcgacataccagacacttagccgaagccagcgaattttatgtaaagccggaatttacataagcgctgtgaatgagtcgcccgtagcttcacgcaatataaaggctttgcttgacgccatcgctatttttcgttgagctacagccgaccagcacgattaattaaaggggtaaatgtgggaaatcaggcgaaagacgacgagttataccaggagatgtgccgcgtagtgggtaaagtggtgctggagatgcgcgatctgggccaggagccgaagcatatcgttattgctggcgtattacgtacctcgcttgctaaccagcgtatcgtccggtctgaattaactaaagtcgccatggaggcggttattaaagcgttatcgaacacggcctgacccgtatttcccctgatgagtctttaaaccaacggcatagacgtgtagtatcaggggtgagcttatccgcagagggtaagggtgcggttgttaaaccctgcacagattccgcagagtgaagcggaaagccttatctaaactgctgataattattagaaaatagttttgtatgtgatctttcgtgtgggtcaccactgcaaataaggatataaaatgccagttattacccttcctgacggcagtcaacgtcacttcgataaagccgtaagcccattagatgtcgcactggatatcggtcctggtctcgcgaaagcgtgtatcgccggacgtgttaatggcgagctggtcgatgcaaccgatctaatagaaaacgatgcgcagctggctatcatcaccgcaaaagatgaagatggtctggaaattattcgtcactcctgtgcgcacctgttgggtcatgccattaagcaactgtggccgaataccaaaatggctatcggtccggttatcgataatggcttctattatgatattgaccttgaccataccctgacgcaggaagatctcgacgcgctcgaaaaacgtatgcacgagctcgccgaaaccaattacgatgtcgtcaagaaaaaagtcagctggcacgaagcgcgtgaaaccttcgcgtcccgcggcgagagctataaagtctctatccttgatgaaaacattgcccacgatgataagcctggcttgtatcatcatcaggaatacgtcgacatgtgccgtggtccgcacgtgccgaatatgcgtttctgccatcactttaaactgatgaaaaccgcgggcgcgtactggcgtggcgacagcaataataaaatgttgcagcgtatctacggcaccgcatgggcagataaaaaagcgctgaacgcctatttacagcgtcttgaagaagccgctaaacgcgatcaccgtaaaatcggtaaacagctcgacctgtatcatatgcaggaagaagcgccgggtatggtattctggcataacgatggctggactattttccgtgaactggaaacttttgtacgttctaaactgaaagagtaccagtatcaggaagtgaaaggcccgttcatgatggaccgtgtgctgtgggaaaaaaccggccactgggacaactataaagatgcgatgttcaccacctcctcggagaaccgtgaatactgcatcaagccgatgaactgcccgggtcacgtgcagatcttcaatcagggtctaaaatcctaccgtgacctgccgctgcgtatggcagagtttggtagttgtcaccgtaatgagccgtcaggcgcgttacatggactgatgcgtgtacgtggtttcactcaggatgacgcccatatcttctgtacagaagagcaggtgcgtgatgaagtgaacgcctgtattcgtttggtctacgatatgtacagcacctttggcttcgagaagatcgtcgtcaaactttccactcgccccgaaaaacgtatcggtagcgatgaaatgtgggatcgtgctgaggcggatctggcagtcgcgctggaagaaaacaacatcccgtttgaatatcagctgggtgaaggcgcgttctacggtccgaaaattgaatttaccctgtatgactgcctcgatcgtgcatggcagtgcggtacggtacagctggacttctccttgccgtctcgtctgagcgcctcttatgtgggcgaaaacaacgagcgacaagttccggtaatgattcaccgcgcgatcctcggttcactggagcgctttatcggcatcctgaccgaagaatttgcgggcttcttcccgacctggcttgcgccagtgcaggtagtggtgatgaatattactgattctcaggcggaatatgtcaacgaattgacccgcaaactgcaaaatgccggcattcgcgttaaagcagacttgagaaacgagaagattggctttaaaatccgcgagcacactttacgtcgtgtcccttatatgctggtttgtggcgataaagaggttgaagccggcaaagtcgccgtgcgtacccgtcgtggtaaagacctgggtagcctggacgtaaatgacgttatcgagaagctgcaacaagagattcgcagccgcagtcttcaacaactggaggaataaggtattaaaggcggaaaacgagttcaaacggcgcgaccgaatcgcatcaatggcgagattcgcgccacagaagttcgcttaacaggtctggaaggcgagcagcttggtattgtgaatttgagagaagctctggaaaaagctgaagaagccggggtcgatttagtagaaattagccctaacgccgagccgcccgtttgtcgtataatggattacggcaagttcctctatgaaaaaagcaaatcttctaaggaacagaagaagaagcaaaaagttatccaggttaaggaaatcaaattccgacctggtacagatgaaggtgactatcaggtaaaactccgcagcctgattcgctttctcgaagagggtgacaaggccaagatcacactgcgtttccgcggtcgtgagatggcccaccaacagatcggtatggaagtgcttaatcgcgtgaaagaagatctgggtgaactggcagtggtcgaatccttccctacgaagatcgaaggccgccagatgatcatggtgcttgctcctaagaagaaacagtaaggccatcaagtaatcattcctgtgggccacgctcacgggactgattcgcctttgtttcgtttattaacaatgcgaagtggaagttattaaaatgccaaaaattaagaccgtacgcggtgctgctaagcgcttcaaaaaaaccggtaaaggtggttttaagcacaagcacgctaacctgcgtcatattctgaccaaaaaagctactaagcgtaaacgtcacctgcgcccgaaagccatggtttctaaaggcgatctgggtctggtaatcgcgtgccttccgtacgcataagtcgttaaccttttaactttttaagaatagatacaggagagcacacatggctcgcgtaaaacgtggtgtagttgcacgtgcacgtcacaagaaaattttgaaacaagctaaaggttactacggtgcgcgttcacgcgtataccgcgttgccttccaggctgttatcaaagcaggtcagtacgcttatcgtgaccgtcgtcagaaaaagcgtcagttccgtcaactgtggattgcgcgtattaacgcagcagcacgtcagaacggtatttcttacagcaaattcatcaacggcctgaaaaaagcctctgttgaaatcgaccgtaagattctggctgacatcgctgtattcgacaaagtggcattctctgccctggtcgaaaaagcgaaagcagctctggcataagccagtgaagagagggggcttagctccctcttttttatttgtaataccgtcattttgttgacaattcgtcgtccggccttttcaataggcagtatcggtttttccacacaaggtaacgcaagcatgaatgctgctattttccgcttctttttttactttagcacctgaaaccgggaggctagcgcgtgaaagaagaaacgaaaaacagcgccagaaagcctcctgatggaggctttttttatgcctgatttttaaaaataagagaccaccataacggtgtctgcaccgacataatgaggaaaaccatgtcacatctcgcagagctggttgccagcgccagggcagccattaacgaggcttcagatattgccgcattagataatgtgcgcgttgaatatctgggtaaaaaagggcaactgacccttcagatgaccaccctgcgtgagttgccagctgaagaacgtccggcagccggtgcggtgatcaacgaagccaaagagcaggtgcagcaggcgctgaacgcccgcaaagccgatctggaaaacgccgcgctgaacgcccgtctggccgcggaaaccatcgatgtatccctgccgggacgccgcactgaaaacggtggtctgcatccggtaacccgtaccatcgatcgtatcgaaagctttttcggcgagcttggctttaccgtggccaccggcccggaaatcgaagacgattaccataactttgatgccctgaatattccgggtcatcatccggcgcgcgccgatcacgacaccttctggttcgatgccacccgcctgctgcgtacgcagacctctggcgtacagatccgcaccatggcgaaccagcagccgccgatccgtattatcgcgccaggtcgcgtttaccgtaacgattacgaccagacgcacaccccaatgttccatcagatggaaggcctgatcgttgataccaacatcagcttcaccaacctgaaagggacgctgcacgacttcctgcgtaacttctttgaagaagatctgcagatccgcttccgtccgtcctatttcccgttcaccgaaccgtccgcggaagtggatgtgatgggtaaaaacggcaaatggctggaagtgctgggctgcggcatggtgcatccgaacgtgctgcgcaacgtcggcatcgatccggaagtctattccggcttcgcgttcggcatgggtatggagcgtctgaccatgctgcgctatggcgtaaccgatttacgtgcattcttcgaaaacgatctgcgtttcctcaaacagtttaaataaggcaggacaacataatgaaattcagtgaactgtggttacgcgaatgggttaatccggcgatcgacagcgacgcgctctccgatcagatcaccatggcgggtctggaagtggacggcgtggagccggtcgcaggccgctttaacggtgtggtagtgggtgaagtgatggagtgcggtcagcacccgaacgccgacaaactgcgcgtcaccaaagtcaacgtcggcggcgaccgcctgcttgatatcgtctgcggcgcgccgaactgccgtcagggcctgaaagtggcagtggcaaccgttggcgctgtgctgccgggcgatttcaaaatcaaagcggcaaaactgcgcggcgagccgtctgaaggcatgctctgctccttctcggaactgggtatttccgacgatcataacggcattatcgagctgcccgccgatgcgcccattggcaccgacctgcgcgactacctgaagcttgacgataacaccatcgaaatcagcgtgacgccaaaccgcgccgattgcctcggcattatcggcgttgcccgcgacgtggcggtgctgaaccaggcgccgctgatggagccggaaatcgcgcccgtagccgcaactatcaacgatacgctgccgatcgccgttgaagccgccgatgcctgcccgcgttatctgggccgcgtcgtgaaaggcatcaacgtcagcgcgccgacgccgctgtggatgaaagagaagctgcgccgctgtggtattcgttctgtcgatgccgtggttgacgttaccaactatgtgctgctggaactcggccagccgatgcacgccttcgatctgaaccgcattgacggcggcatcgtggtgcgaatggcgaaagagggcgaaaccctggtattgctggacggcaacgaagccaaactcaatgccgacaccctggtaattgctgaccacagcaaggcgctggcgatggccggtattttcggcggcgaacactccggcgtgaatgaccagacccaggacgtactgctggaatgcgccttcttcagcccgctgtccattaccggccgcgcacgccgtcacggtctgcataccgatgcgtcccaccgttacgagcgtggcgtggatccggcgctgcagttcaaagccatggagcgcgccacccgtctgctgatcgacatctgcggcggcaatgccggtccggtgattgacgtgaccaatgacgccgcgctgccgaaagcggcgaccatcaccctgcgtcgcagcaaactggatcgtctgattggtcatcacattgccgatgagcaggtcagcgacatcctgcgccgtctgggctgtgaagtcaccgaaggtcaggaccagtggcaggctgtggcgccgagctggcgtttcgatatcgctattgaagaagacctggttgaagaagtcgcccgtatttacggctacaacaatattccggacgagccggtgcaggctggcctgatcatgggtcagcaccgcgaagcggatctgtcgctgaagcgcgtgaaaacgctgcttatcgacaaaggctatcaggaagtcattacctacagcttcgtggatcctaaggtgcagcaactggtgcatccgggcgcggaagcgctgatcctgccaagcccgatctccagcgaaatgtcagccatgcgtctgtccctgtggacggggctgctgacaaccgtggtctataaccagaaccgtcagcagaaccgcgtgcgcatttttgaatccggcctgcgttttgtgccggataccacagcggatctgggtatccgtcaggatctgatgctggcgggcgttatttgtggcaaccgtcacgatgaacactggaatctggcaaaagagagcgttgatttctatgatttgaaaggcgatctggaatccgtgctcgatctgaccggcaaactgaacgagattcagttccaggcagaggccaatccggcgttgcatccgggccaggctgccgcgatttatctgaaaggtgaacgcgttggtttcattggtgttgtgcatcctgaactggagcgcaagctggatctcaatggtcgtaccatcgtgtttgagctggagtggaacaaggtcgcagaccgcgtggtgcctcaggcgcaggagatttcccgcttcccggcaaaccgccgcgacatcgctgttgtggtcgctgaaaatgtacccgcagcagatgttttggccgaatgtaagaaagttggcgtaaatcaggtagttggcgtaaacttatttgacgtgtaccgcggcaagggtgtggcggagggctataagagcctcgctatcagcctgatccttcaggataacagccgtacactcgaagaagaggagattgccgctaccgttgccagatgcgtaggggcattaaaagagcgattccaggcatcattgagggattgaacctatggcgctaacaaaagctgaaatgtcagaatatctgtttgataagcttgggcttagcaaacgggatgccaaagagcttgtagagttgtttttcgaagagatccgtcgcgctctggaaaacggtgaacaggtgaaactctctggcttcggtaatttcgatttgcgtgataagaatcaacgcccgggacgtaacccgaaaacgggcgaagatattcccattacagcccggcgcgtggtgaccttcagacccggccagaagttaaaaagccgcgttgaaaacgcttcgcccaaagcagagtaatctgaactaaccaaaaaggccgccatcgcggccttttttctttcctcattgcaatatcagcattaaaatcaaacacatcatttcaccgtatcccggacattatgcaggcacttgcccgtcttcagcaccgtcgcgatcgccgcagactgtgtatcctcgccctggtactgcttatcgcctgcaccctcagcctgtgcgccggggaccagtggatcgcgcccgacgcctggcttagcgacagcggtcgcctgttcgtcgggcaaattcgcctgccgcgaaccctggcggtgatgctggtgggcggcgcgctggcgctgtgcggggccgtaatgcaggcgctgtttgaaaacccactggcggagccggggctgctgggcgtgtcgaacggggcgggcgttgggttgattgccgccgtgctgctcgggcagggcatgctgcctgaatgggcgctggggctgtgcgccattctgggggcgctggtcattacgctgatcctgttgcgttttgctcggcgtcatctctccaccagccgactgctgctggcgggggtcgcgctgggcattatctgtagcgccctcatgacctgggctatttatttctccacgtcctttgatttacgccagctgatgtactggatgatgggcggttttggcggcgtcgactggcagcagagctggctgatgctggcgctggtcccggtgatggcgtgggtatgccttcagtcgcagccgctcaacatgctggcgctgggggaaatctccgcccgtcagctggggctgccgctgtggctgtggcgcaacgtgctggtggtcgccaccggctggatggtcggtgtgagcgtggcgctggccggggcgattggctttatcggcctggttattccccatattctgcgtctgtgcggtatgaccgaccatcgtgtgctgctgcccgcctgtacgctggcaggggcggcggcgctgctgttcgccgatattgtggcgcgtctggcgctcagcgcggcagagcttcccatcggcgttgtgaccgccacgctgggcgcacctgtatttatctggctattattaaaggccgggcgctaagacccggctatacgatctgcaaactaaggggatgttatgcaacatgatattttacataccgacgtgatcaccattgatggcgaacacacgacgcttgaacaatacgcaggtaaagtgctgctgatcgttaatgtcgcgtctaaatgcggcctgacgtcgcagtatgaacagctggaaaatatccagaaagcctggaaagacgccggattagtggtgctcggtttcccgtgcaatcagttcctcggtcaggagccgggcagcgaagaagagatcaaaaccttctgcagcaccacctatggcgtgaccttcccgatgttcagcaaaatcgacgtcaacggcgaaaaccgtcacccgctgtatcagaaactgattgcagccgccccgaccgccgttgcgccggaagcgagcggttttcatgagcgtctggccagtaaaggccgcgcgccgctgtatccggatgacatcctgtggaactttgaaaaattcctcattggtcgcgacggccaggtggtacagcgtttctcaccggacatgaccccggaagatccgattgtcatggaagccattaaggccgcgctggcgaaataatgtctgcgttgatgcaattacaggatgtggaggcgccgggccgactcggtccgctcagcggcgagatcggcaggggcgagatcctgcatctggtcggccccaacggtgccggtaaaagcacactgttggcgcgtatggccgggctgacccagggaaagggcagggtgatgtttaacgacacatccctggccgcctggcccgccacctcccttgcccgccaccgcgcttaccttgcgcagcagcagatgccgccgttctccatgccggtatggcattttctgtcgttgcatcaaccgcacaacccggacgcggcgctctgcgagtcagtcgccgccgcgcttggcctgagcgataagcttggacgcgccaccagtcagctttccggcggtgaatggcaacgcgtgcggctggcggcagtcattttgcagatccatccgcagggaaatgctgacggacaactattgttactggatgagccgatgaacagtctcgacgtggcgcagcaggctgcgctggacaggctgctcagcgcgctgtgcgcggcgggggtgacgattgtcatgagcagccacgatcttaatcatacgctgcgccacgcgcaccgtgcatggcttctgcgcagggggcagctggtcgccagtggcacgcgtgaccatgtgatgacgccggtcaatctcgaaaaagcctatcagatcccgtttcgtcgcctgaacattgaggggcatagcgtgctgatttccgcccgctaagtgaatggtaacttgcgcaggacacaacacacaggctaaatttctgctgaaataataaagtaaaggatgcgtccggtatgcgttactggtttttactcgcagcagcgttgtttctggcagggtgcagcagccatcgcgcgccgccgccaaatccccgtctttccgactcgatcaccgttatcgccggtcttaacgatcagctcagcaactggcgcggcacgccttaccgttatggcggtatgagccgtggcggcgtggattgttccggctttgtactgatgactttcagagacaagttcgatctgcaactgccgcgcgaaacccgccagcaggcaaagattggcaccgaaatcgacaaggacgatttgttgccgggcgatctggtgtttttcaaaacggggtcgggtgaaaacggtctgcacgtcggcatttatgataccgacaatcagtttattcatgcttccaccagccggggggtgatgcgctcatcgctggataatgtttactggcgtaaaaacttctggcaggcccgccgcatataaatctccccttcacccacccctaatggtgggtgaatatctcctttctcttattgtttttttcttaaccacttattccgccacggattactcctggtaaatcatcctaattaattaaactgttaatatttctaaactaatgtgttaatgaaattttcgttactggctattatagtttattcgggataagatttgccttagggcaaaggatgaaccgcaattaaaaaggaaaaaatgaaagtatttcgtcttaagccccctgggttgaatggtattaatacctttgttagcgagccgggaaacaccctaatcatgggactggcgatatgatcctgacgcttgaaagcacatggcgcaccgagctgttattacagcccgcccgtagcgcgcagggcaaactggaaggcctgcagattatcgtcaatcttattggcgtggatgggcacatccatacgcctgccggggagttactggcgcaactccccgcacagacagccctgacgctgttctcagaacagctggcgttgcttgaatcctgtaagctcttttttatccagcacagcattccggcctggattaatataacgccagtgattgccggggcgcttttaagtgatgctgaactggcggcgagcgtggaacgttttccatttctggcattctctattaatgagaattatcccgatttgaataaaggggctgcgcatccacaactttctgcgctcgcggaacgttattccctgatgctggaaaatttcggcgcaggaaaaagttccacccgggcggtatttgatggactgtttaaacaggtgattctggataaaaactttgtccatcatcgattaacctcacgctccttcgaaccttttatgcgtgccgttgttagccaggtaaaaccttattgtcagtcgattatcatcgacggcattgataatgaattttcccgccagcgtattttaccttttcatttctcagcgatgatgggggcgttatggtcgccggtgacggtggctgaactgaccactctggtacagggataaccctgaggttatcccgtgtttaacctccgcattacccactacacttaatgcaggaggaaacatgaccctttcttttactacccactggcgcgatgagctgccggagttttacaccgcactacaacccacgccgctacaaaatgcgcgcctggtctggcataacgaaccccttgccgaaacgctcggtattcctgcctcgctgttcaatactgcgcaaggtgcaggcgtttggggcggcgaggcgctgctgcctggcatgtcaccgctggcgcaggtttacagcggccaccagtttggcgtatgggcgggtcagcttggcgacgggcgcggcattctgctcggcgaacagttgctggctgatggaaccacccgcgactggcatctgaaaggcgcaggtctgacgccgtattcacgaatgggtgacggtcgcgccgtgctgcgctccactatccgggaaagtctggcctctgaagccatgcattatttagggatccccaccacgcgcgcgctgtcgatcgtcaccagcgacacgccggtgcgccgcgaaaccgtagagcagggggcgatgatgatccgtatcgcgcaaagtcacgtgcgcttcgggcatttcgaacatttttactaccgtcgcgaaccggaaaaagtgcagaagctggcggatttcgttattcggcattactggccgcagctgcaggatgaggcggataagtatgccctgtggtttaacgatgtggtgagccggacggcgtcgctgattgcgcgctggcaggccgtcggcttcgctcatggggtgatgaacaccgataacatgtcgattctcggcctgaccattgattatggcccctacggtttcctcgacgattaccagccgggttatatctgtaaccattccgattatcagggccgctatcgttttgataatcagcctggggtggggttgtggaatctgcaaaaactggcgcagacgctgtcgccgtttatcgcggtggaagtccttaatcaggcgctggaaaactatcagcaggtgctgctgcgggaatatggcgctttaatgcgcagtaaactgggcttcacgacagaacagaagggcgataacgagatactgaaccggctgttcgctctgatggcaagggagggcagcgactacacccgtaccttccgtatgctcagtcagacggagcagcagagcgccagctcgccgctgcgcgatgaatttatagatcgggccgggtttgatgcctggtttgtggattatcgtgcgcgtctgcaacaggaaggcgttgatgacgtgacgcggcaggggcagatgcaggcggtgaacccggcgatggtgctgcgtaactggctggcccagcgcgccatcgaacaggcggagcagggtgacatggcggagcttgagcgtttgcatattgcactgcgcacaccctttgcagacaggggagatgattacgtcagccgcccgccggactggggtaagcgtctggaagtgagctgctcgagctaagcgatttgcgccgggtggcggcttcgccttacccggcctacatgatgagcgcggtgtaatgcgatgcattgccgggtggcggcattcgccttacccggcctacattctggattcactgtggtatcgacagttgtaggcccggcaagcgtagcgccgccgggcatccatggaaccgccctcagaaccggctgtccacggcgctggcgagcatttccagcagcctttcgctgtcgtcccagcccagacatggatcggtgatcgactgcccgtacaccagcggctgtccggcgacgattttctgcgtgccttcttctataaagctttccgccatgatcccggcgatagccgtcgatccggcgcggatctgctggcaaatgtcttcacacacctccagctgacggcgatgctgcttctggcagttgccgtggctgaaatccaccaccagctgctccggcaggctgaactcgcgcagcgtgtcgcaggctttcgccaggtcttccgcccgatagttcggctgtttgccgccgcgcataataatgtgcccgtacggattaccgctggtctggtaaatggtcatctggccggttttatccggtgagaggaacatatggctggcgcgcgaggcacggatggcatccaccgcgataagcgtattgccgtcggtgccgtttttgaagcccaccggacaggagagcgccgacgccatttcccggtggatctggctttcggtggtacgcgcgccgatagcgccccagctgatgagatcggcaataaactgcccggtcaccatatcgaggaattccgtggcggtaggcaccccaagctcgttcacctgcaacagcagtttacgcgccagttcgataccgtgattcacgcgatagctgccgttaagatccggatcggagatcagccctttccagcccactaccgtgcgcggcttttcaaaataggtgcgcatgacgatttccagccggtgctggtacttctcacgcagcccctgtaaacgacgggcgtagtccatcgcggcgtcgagatcgtgaatggagcaggggccgacaatcaccagcaggcggcgatccgtcccgttaaggattttctcaatgcgacgccgtgaggccgtgacgtgttccgccacgcttgcggagacaggatagcgttgcgccagttcagccggcgtgaccaggctgtctatgcgcgcagtacgcagttcatcggttttattcattacatttctcagaaatttgtggcttcagcggcaggtctgccgggaagtgatgggcatcacgataaaccaatcccgtggtatttcaagtgcgggcgtgatacgcatcacaatccaaaaggtaatgataacgaaattttaaccgatgtactagcttgctagtgcacaggagtgcgccggttaatacatgcggcggttcagcttcatcatgtcgagtattttggtggcgatctcctccacggagaaattggtgctgttaagaaaaggaatttggtttttccggtacagcgcttccacttccgccacttccatgcggcactggcgcagcgaggcgtagcgactgttttcccgccgctcttcacggatagcggcgaggcgctcggcgttgatggtcagcccgaaaagtttatgctgcaacggcttaagcgcagcgggcagcaccaggttatccatatcgtcggcgataaagggatagttggcggcgcgcacgccgaactgcatcgccagatagagactggtgggagttttaccgcagcgcgacacgcccagcagaataacctgcgcctgatccagattacgcatcgaaatgccgtcatcgtgcgccagcgtataatcgatggcggcgatacgcgcatcgtacttaatcagattgccgggattaagcccgtgagtgcggtgcgcaacgggggtgggatcgagcttgagctcctgctgtaagggcgcgaccagcgcctgtacgatgtcctgacagaacccttcgctttgcataatgatgttgcgcacttctggcagcacaatggagtaaaacaccagcggacggatcccggtctgctgatagagcgcgtcgatctgctctttcaccgccttcgcgcggctttcgttttccacaaagggcagggtgatgctgttgatggcgaccggaaactgcgacatcaccgcatgccccagcacctcggcggtgattgccgttccgtcagaaatataaaaaacatgcctgtctacagaattatccatttaagccgccctgaaataatcgtaattgcataaaagcataaattaaaatcaccaggatgcgtagtcagtagtcggcaattctaaaaaatgaaatgctgtttttatttttaatgaaaagtgcatttcattttccaatgctgagcacagtgcgcgccagttctcatgaattcagatgattcagacacttaccgctaatcgggaaacagtccgaaaaagcagaaataaaatttgcttgaacgattcaccgtttttttcagcggaataagtatgccaggataattgcgttataaggtctttcttaaacccgttcatatatcacaaaaggattgttcgatgtccaacaatggctcgtcaccgctggtgctttggtataaccaactcggcatgaatgatgtagacagagttggaggcaaaaatgcctccctgggtgaaatgatcaccaatctgtccggtatgggtgtttccgtaccgaacggattcgccaccaccgccgatgcctttaatctgtttcttgatcaaagcggcgtaaaccaacgtatctatgatctgctggataaaacggatattgatgacgtgggcgaactggcgaaagcaggcgcgcaaattcgggcgtggatcatcgacacacctttccagccggaactggaacaggccattcacgaggcctataaccagctgtctgctgacgacgcagaagcctcctttgcggtgcgctcctccgccaccgcagaagacatgccggatgcctcttttgccggtcagcaggaaaccttccttaacgtgcagggctacgatgccgtgctggtggcggtgaagcatgtttttgcctcactgtttaacgaccgcgccatttcttaccgcgtgcatcagggctatgaccaccgtggcgtggcgctgtcggcgggcgtacagcgtatggtgcgttccgatctggcgtcctccggcgttatgttctccattgatactgaatccggcttcgatcaggtggtgtttatcacttctgcatggggactcggcgagatggtggtgcagggcgcggtcaaccctgacgagttttatgtgcacaaaccaacgctggaagccgggcgtccgtccatcgtccgccgcaccatgggctcgaaaaaaatccgcatgatctatgccccgacccaggagcacggcaagcaggtgcgcattgaagatgtgccggaagccgaccgcgacatcttctcgctgaccgatgaagaagtgcaggagctggcgaaacaggcggtgcagatcgagaaacactacggtcgtccgatggatattgaatgggcgaaagacggtcataccggcaaactctttatcgtgcaggcgcgtccggaaaccgtgcgttcacgcggtcaggtcatggagcgttataccctgcatgaccagggcaaaatcatcgctgaagggcgtgcaattggccaccgcattggcgcgggtccggtaaaagtgatccacgacatcagcgagatgaaccgaattgagccaggggacgtgctggtcaccgacatgaccgacccggactgggagccgatcatgaaaaaagcggcggccatcgtcaccaaccgtggcggacgcacctgtcacgcggcgatcatcgcccgtgaactgggcattccggcagtggtgggctgcggcgatgccaccgagcgcatgaaggatgacgaaaaagtcaccgtttcctgcgccgaaggtgataccggttacgtctatgccgagatgctcgatttcagcgtgaaaagctccagcgtcgacaccatgccggatctgcctctgaaaatcatgatgaacgtcggcaacccggatcgcgcttttgacttcgcctgcctgcccaatgaaggcgtgggtcttgcgcgcctggaattcatcatcaaccgtatgatcggcgtgcatccacgcgcgctgctggagtttgacgatcaggacccggcgctgcaaaaagagatccgtgcgctgatgaaaggttacgattcgccgaaagacttttacgttggacgtctgagcgaaggcatcgcaaccctgggggcagcgttttacccgaaacgcgtgattgtgcgtctgtctgattttaaatcgaacgaatacgccaacctggtgggcggcgagcgttacgagccggaagaagaaaacccgatgcttggcttccgcggcgcggggcgttacgtggccgacagcttccgcgactgcttcgcgctggagtgcgacgcggtgaaatacgtacgtaacgaaatgggcctgaccaacgtcgagatcatgatcccctttgtgcgcaccgtggcgcaggcgaaagcggtcattgaggagctggagcgtcaggggcttaagcgcggcgaaaacgggctgaaagtgatcatgatgtgcgaaattccgtccaacgccctgctggcagagcagttcctcaagtatttcgacgggttctccatcggctccaacgatatgacgcagctggcgctgggcctcgaccgcgattccggcgtggtttctgaactcttcgacgaacgtaacgacgcggtaaaagcgctgctttccatggcgatccgcgcggcgaagaaacagggtaaatacgtgggcatctgcggccaggggccgtccgatcatgaagattttgccgcctggctgatggaggagggaattgacagtctttctctgaatccggataccgtggtacaaacctggctaagtcttgccgagctgaaaaaataattaacctgccatcgtccccggaattatccggggatttttttatctttaaaacgccgttttaaggataaaaaaaagcccatcgtgggagatgggcaaagactacacacagcaattcgttgtttcactcaggggatttccatgcttataaatcaatgcgttgatttataaccgtgacctaatagtaggcatgacgaatttttgcgtcgatcagattcgtctcaatagttaaataagcgtaaagaatttgcgacagataaacgccatggcatggggaaagtaccaggaatattcgcagacgtagtgggaattgattagcagcacttaattatcggcgggtttccccgccgaatgattattttttattcgcttctatgtcttcgacaggctgcgccggaacgtctaccggtgcgggcacttcttttacccaggcatcaaacagacgccagctcaccgccagcagcaccgggccgataaacaggccaatcatgccaaaggcgataagcccgccgataacgccggataaaatcaggatcagcggcaggtctgcgcccatacggatcagcaccggacgaatcacgttatccagcgtacccaccacgcagctccacaccagcagcaccgtgccccaggtggtgtcgccgctccagtagagccagataatcgccgggatcagcaccggcagcgggccaagctggataaggcacgacatgatcatcaccacggtgaacagcgtggcataaggcacgcccgccacggcaagcccgatgccgccgaggatcgcctgcaccagcgcggtgaccaccacccccagcgcaaccgcacggatcgcctgtgccgccagcagcaccgccgcgtcgccacggctggaggccagccgggtggcgaaatgacggataccgcgcgccacctgctcgccgcgccagtacagcagggcgctgaacagcagcatcagcacacagtgcatcaggaagcggccaatatgcgccgcctggccgacaaaccaggtggtggtggtgccgatataggggcgcactttcgccatgatggcgctgccgcccatatccagcaggttatgccatccggtataaagcttatcgcccaccagcggaacactgttaagccaggccagatcgggtaaggtcatatcgcctgcggttatggcgtggatcaccgggccgctgccgtccaccagactgttcaccagcagcgcaatggggatcacaaagacaaggatcaggaacagcgtcatcaccagcaccgccagcgagcggcggcccagcaaacggcgttgcaggcgtaaaaaaagcggccaggtggcgatcacaatggtgcccgcccaggcgaaacccagtacaaacggccatacgatccacaaacaggcgataatcatcagcgctaaaaacagcaccgacagcaaaatttgcggtacatccctggcctgtcgaaaattaaccatatttttcttcatcctgttggtgcgccggaagctggcgcaaaaaatgtatttcagaatctgcgaaatatcagcgatttcagacagcgaattctgcctgtaattctgccgcgcgtataagaaaaaaatgtgatacaacgataaacgcgcaatgcaaacgattaaatactcacaactctaacagtcaggcagggtcaacagtaatgatcccacagatttctcaggcacccggcgtcgttcagctggtgctgaattttttacaggcactggagcaacaaggttttaccggagacaccgccaccagttatgccgatcggctgacgatggcgaccgataacagcatctatcaactcctccctgatgccgtggtcttcccccgatcaaccgccgacgtcacgctgattgcgcgtattgccgccgaaccgcgtttcgaatcgctgatctttaccccgcgtggcggcggcaccggcacaaacggccaggcgctgaacgccggtattgtggtcgatatgtcgcgctatatgaaccgcatcctggaaatcaaccccgaagagggctgggtgcgcgtcgaagccggggtaattaaggatcagcttaaccagtatctgaaaccttacggctatttctttgcgccggaactctccaccagtaaccgcgccacgctgggcggaatgatcaacaccgatgcatccggacagggatcgctggtgtacggcaaaacctcggatcatacgctgggcgtgcgggcggtgctgatgggcggcgatattctggacacgcagccggtatcgctggagctggcggaaaccctcggcgaggtgcagaccgccattggccgcatctacaaagccgtttatgaaagctgccgggataaccgccagttgatcatcgataaatttccaaaactgaaccgcttcctgaccggctacgatttgcgtcacgtctttaacgacgagatgacccgttttgatttaacccgcatcctgaccggctccgaaggcacgctggcgtttattaccgaagcgcggctggatattacgccattgccgaaagtgcgccgtctggtaaacatcaaatacgactccttcaactcagcgctgcgcaatgcgccttttatggtggaagcgcgggcgctgtcggtggaaaccgtcgactcaaaagtgctcaatctggcgcgggaagatatcgtctggcattcggtgcatgaattgatcaccgatgtgccggataaagagatgctgggcctgaacattgttgagttcgccggtgacgacgaagccctgatcgacggccaggtcagcgatctctgtcagcggctggacagcctaatcgccacagagcagggtggggtgattggctggcaggtgtgcggcgatctggcaggcattgagcgtatctacgccatgcgtaaaaaagccgtcggcctgctcggtaacgcaaagggcgcggccaagccgatcccctttgcggaagatacctgcgtgccgccggagcatctggcggattacatcgtcgaattccgcgcgctgctggacagccacggactgagctacggcatgttcggacatgtggatgccggtgtactgcacgtgcgtccggcgctggacatgtgcgatccgcagcaggagatgttgatgaagcagatctccgacgaggtcgtggcgctgaccgcgaaatacggcggcctgctgtggggcgagcatggcaaaggcttccgcgccgaatacagcccggcgttttttggcgaacagctgttcggcgaactgcgcaaaatcaaagcggcctttgatccccataaccgcctgaacccgggaaaaatctgtccgcctgcgggcgttgacgcgcccatgatgcaggtggacgcggtaaaacgcggcacttttgatcgccagatccccattgccgtacgtgcttcctggcgcggcgcgatggagtgtaacggtaacggtctgtgctttaactttgatgtcaaaagcccgatgtgcccgtcaatgaagatcaccagcaaccgtattcattcgccgaaaggccgcgccaccctggtgcgtgaatggctgcgtctgctggcggatcgcggcgtcgatccgctgaagctggaaaaagagctggcggaaagtcgcgtcagcctgcggggacttatcgaacgaacgcgcaatagctggcatgcgcgcaagggcgaatatgacttttctcatgaagtgaaagaggcgatgtccggctgtctggcctgtaaagcctgctcgactcagtgtccgattaaaatcgatgtgccggagttccgctcccgcttcctgcaactttatcacacccgctatctccgcccgctgcgcgatcacctggtcgcctcggtggaaagctatgcaccgctgatggcccgcgcgccgaagaccttcaacttcttcctgcgccagccctggctgcgcacgctgtcggaaaaacgcatcggcatggtggatttgccgctcctgtcggtgccgtcgctgcaacagcagctggtggggcaccgcaccgccaatatgacgctggaaaatctggaacagttaagcgacgaacaaaaagcccgcacggtgctggtggtgcaggatccctttaccagctattacgatgcgcaggtggtgagcgattttgtgcggctggcagaaaaactgggctaccagccggtgatcctgccattctcgccaaacggcaaagcgcagcatatcaagggcttcctgatgcgctttgcgaaaacagcgcagaaaacctcagacttcctgacgcgcattgcgcaactggggatgccgatggtgggggtcgatccggcgctggtgctgtgctatcgcgatgaatataaacaaacgctgggcgacaaacgcggcgagtttaacgtgcagctggtgcatgagtggctgccggcggtgctggaaaacgtcgagccgcgcgtggtcagcggcgaggcctggtatctgttcggccactgcaccgaagtcaccgcgctgccggggacgccggggcagtgggcatctatctttgcccgtttcggcgcgaaactggaaaacatcagcgtcggttgctgcggcatggcgggcacctacggccatgaagttaaaaatcacgccagttcgctggggatttatgagctgtcgtggcatcaggcgatgcaacgtctgccgcgtaatcgctgtctggcgaccggctattcctgccggagtcaggttaagcgtattgagggcagcggggtacgccatccgttacaggctttactggagataattggatgatctggaaacgtgaagcgacgctggaggcgttaaacgccatgagcgaagggaatatggtcgggctgctggatatacgatttgagcgtatcactgctgacagtctcgaggcgacgatgccggtggacagccgcacgcatcagccatttggcctgctgcacggcggcgcctctgtggtgctggcggaaacgcttggctcggtggcgggctatctgtgcagcgagggcgaacaaaatgtggtggggctggaagtgaatgccaaccatatccgcgcggtgcgcagcggccgtgtgcgcggcgtctgtaccgctctgcatacggggggacgtcatcaggtctggcagatccacatttacgatgaacagaaccgcctgtgctgcgcctcccgcctcaccaccgccattatctaatcctctgggcggttgtagacgcagccgcccactccaatctatccatcgcgtgataatttcgtagtgtgatatagtgcgcaatattgaatctctgagtggcagtgttgtctaacccagagacggtaacgcatataagcctggaaataagaatcgtggtttccttgcgcgctacttaatgtgtgtttttcaggtaatcttgtaatgcgtacttccttaaagctctcttttcttcacccacgccactggtttacatggtttggtcttggcgttctctggctgctggtgcagttaccctatccactgatcgctcgtctcggtacctcgctcggtacgctggcgcgtccctttctgaaacgccgtgaaagcatcgcccgccgcaatctggaactctgttttccggagatggatccgctggtgcgcgaagtcttaatcgaaaataatttccgctcgctgggcatggggctgctggaaaccggcatggcctggttctggccggacgagcgcgtgcgtcgctggtttgatgttgagggttatcagcatctgcaggatgcgcaggcaaaacagaaaggcgtgatggttatcggcgtgcattttatgtcgctggagctgggcggtcgggtgatgggcctgtgccagccaatgatggcgacctatcgtccgcataacaatccgctgatggagtgggtgcagacccggggccggatgcgttccaataaatcgatgatcgaccgccgtaacctgaaagggctggtcaacgcgctgaaaaagggtgaagccgtatggtttgccccggaccaggattatggtcgcaagggcagcaccttcgcgccgttctttgacgttaacgccgccaccaccaacggtacctatgtgctgtcgcgtctgtccggctctgtgatgttgacggtgacgatggtgcgcaagcctgaccgttcaggatattcattatttatcggccccgagctgaccgattacccaaaagaaaatgaattcgaagccgccagctacatgaacagggttgtcgagcgtgagattttacgcgcccccgaccagtacctgtgggtgcaccgccgcttcaaaacccgcccgatgggcgagtcttcactgtatcgttaagcttcgctgtacgcctgccttccctggcaggcgctgacccttttattttaccgttacgataacttattgatttttcgatgagtgatttgttacatgtaaaaaagggtattttatgagaaaggagtgctttaactcaaaaatacaatgggttggcgtgatactattgctgttcactgccgtacaggcagcttagaaatgctgcgctttattggatacgacaaagtgcaagtgcactgccgtacaggcagcctcaaaataaagcccgtgcaatcacatcaccgtaatagttccgcagctacaaaaagcccaggcccaattttgtcgggtggcgcttcgcttacccgacctaccgcaactgacccggcctgcaatgacaaactgcgtctcatgggcatactgcccgcatcatttgtcacgtttatattacagaattgttataaaatcctatctgataaataggcattgcctatgcatgtttcatttctccagggtgtgttaaagaccaccgcataaaaatattttatattcaaatgcttagttatcgcagacctttccggttaacccggttgtgagggtctatgcttaatagaactgtgcaaaaagagcgcttcagggaataaccctttggaatagaggttgaagtgataatcattatcactaacatagcgttatgccctatggcgcaatcacgtgaggtagacctatggaattgcaagcaggaaccttcgaccccaacgatcccggttggcagggcctgacattaacgccagccgccgcgaagcatatccgcgcgctggtggaaaagcagccagagctgctcggcgtacgtctgggtatcaaacagaccggttgtgccggttttggttatgttcttgatacggttttcgatccggtggcagacgatctgctgttcgagttcgacggcgcgcgtctctacgtgccgcttcaggcgatgccctttattgacggcaccgaagtggactatgtgcgcgaaggactgaatcagattttcaaattcaataacccgaaagcgcagcacgaatgcggctgcggcgaaagctttggggtataggcggtactatgtctcgtaatactgaagcgactgacgatgtcaaaacctggtccggcccgctgaattacaaagagggcttcttcacccggttacagacggacgaaatggctcacggcatcaatgaagatgtcgtgcgggcgatctcggccaaacgcaacgaacctgaatggatgctggagttccgcctgaaggcctatcatgcctggctggaaatggaagaaccgcactggcttaaagcccattacgacaagctggattaccaggattacagctactactccgcgccatcctgcggcaactgcgacgacacctgcgcctcgcagccgggcgcggtacagcaaaccggcgccggcagctatctgaccgacgaagtggaagaggcttttaatcagctgggcgtaccggtgcgtgaagggcgcgaagtggcgatggacgccatttttgactcggtgtccgtggccaccacctatcgtgaaaagctcgctgagcacggcgtgatcttcagctccttcggggaggcgatccacgatcatccggagctggtgcagaagtatctcggcaccgtggtgccgtcgaacgataacttctttgcggcgctcaatgcggcggtcgcctcggacggcacctttatctacatcccgaaaggggtgcgctgtccgatggagctgtccacctatttccgtatcaacgcggaaaaaaccggccagttcgagcgcaccattttgatcgccgatgaaggcagctacgtcagctatatcgaaggctgctccgcgccggtgcgcgacagctaccagctgcatgcggcggtggtggaagtgatcattcacaaagatgcggaagtgaagtactccaccgtgcagaactggttccccggcgataacaataccggcggtattctgaacttcgtcaccaagcgtgcgctgtgtgaaggcgaaaacagcaaaatgtcctggacgcagtcggaaaccgggtcggccatcacctggaaatacccgagctgcattctgcgcggcgacaactccatcggcgagttctactcggtggcgctgaccagcgggcatcagcaggcggataccggcaccaagatgatccacatcggcaagaacacccgttcgaccattatctcgaaagggatctccgccgggaaaagtcagaacagctatcgcgggctggtaaaaatcatgccgaccgccactaacgcgcgtaactttacccagtgtgactcgatgctgattggcccggactgcggcgctcacaccttcccgtatgtggaatgccgcaataacagcgcgcagctggagcacgaagctaccacctcgcgtatcggcgaagatcagctgttctactgcctgcaacgcggcatcagcgaagaagatgcgatctcgatgatcgtcaacggcttctgtaaggatgttttctccgagctgccgctggagtttgccgttgaagcccagaaattactcgccatcagccttgagcacagcgtcggttaaggaaattacatgttaagcattaaagatttgcaggttgccgttgaagagaaagagatcctgcgcggtctgaacctggaagtgcgtcctggtgaagtgcacgccattatggggccaaacggctccgggaaaagtacgctctcagcaacccttgccgggcgcgaagattatgaagtgaccggtggttcagtgcagttccacggcaaagatctgctggagctgtcgccggaagagcgcgcgggcgaaggcatctttatggcgttccagtatccggtggaaatccccggcgtcagcaaccagttcttcctgcaaaccgcgctcaacgccgtgcgcaaatatcgcgggctggatgagttagatcgttttgacttccaggatctgatggaagagaaaatcaagctactgaaaatgcccgaagatctgctgacgcgctcagttaacgtcggtttctccggcggcgagaaaaagcgtaacgacattctgcaaatggcggtgctggagccggaactgtgcattctcgatgaaacggactccggcctggatatcgatgcgctgaaaatcgttgccgaaggggtgaactccctgcgcgacgaaaagcgcgcctttatcatcgtcacgcactaccagcgcattctggattacatcaagcccgactttgtgcacgtgctgtaccagggccgcattgtgaaatccggtgattttacgctggtgaaacaactggaggagcagggctatggctggcttaccgaacagcagtaacgcgctgcaacagtggcatcatctgtttgaaaccgagggcagcgcgcgttcggaacaggcgcagcagcatctgcaacaggtgctgcgtttagggctgccgacgcgtaagcacgaaaactggaaatacacgccgctggaagggctgctcagcagccactttgtcagcacgcagacccggttatccgccgcacagcgtgacgcgctggctctgccggtggacgcggtgcgactggtgtttgtcgacgggcgctttgacgccgaactcagcgacagtaccgaaaacagcggctttgtggtcagcattaacgacgagcgcgccgcgctgcccgcgccggtacagccggaagtgtttctgcatctgacggaaagcctggcgcacagcgtcacccatatccgcgtggtgcgcaaccagcgtccggcgaagccgctgctgctgatgcatatcacccagggactggcgggcgaggagatgaacaccgcccactatcgccatcatctggatctggagcagggcgcagaggcgacggtctatgagcattacgtcagcctgaacgatcagcggcattttaccggctcgcgtctgaccatgaacgtggcggccaatgcgcagttgcatcacgcgaagctggcgtttgaaaatccgcagagctaccactttgcgcataacgatattctgctggccgccgatgccgccgcgcacagccacagttttctgctcggcggggcggtgctgcgtcacaacaccagcatggcgctgaacggcgaaaacaccacgctgcgcgtgaacagcctggtgatgccggtgaacagtgaagtgtgcgacacccgtacctggcttgcccataacaagggctactgcaacagccgtcagctgcacaaaaccatcgtctctgacaaaggccgggccgtattcaacgggctgattaacgtggcgcagcatgccatcaaaaccgacgggcagatgaccaacaacaatctgctgcttggccgtctgtcggaagtggataccaaaccgcagcttgaaatttacgccgatgacgtaaaatgcagccacggcgcgaccattggccgcatcgacgatgaacaaatgttttacctgcgctcgcgcggcattgatgagaaggccgcgcagcaaatgatcatctacgcctttgccgctgaactgacggaagccatcagcgacgaggcgctcaggcatgaggtactgtcccgtatcggtcagcgcctgccagggggcatcgcatgagtttttccgttgagcgcgtacgggcggattttccggttctgacgcgtgaagtgaatggccagccgctggcgtatctcgacagcgccgccagcgcacaaaaacccaatcaggtgattgatgccgaagcggagttttatcgtcacggctacgctgccgtgcaccgcggcattcataccctgagtgccgaagccacccagcgcatggaaaacgtgcgcacccaggcgtcacggtttatcaacgcccgtacgccggaagagctggtgttcgtgcgcggcaccactgaaggcatcaacctcgtcgccaacagctggggcaacagcaatgtggcggcgggtgacaacatcatcattaccgccatggagcatcacgccaatatcgtgccctggcagatgctgtgtgaacgcaccggcgctgaactgcgcgtgatcccgattaatcaggacggtaccctgcaactggacgcccttgccgggctgctcgatgaccgcacgcggctggtggcggtgacgcacgtctctaacgtgctcggcaccgagaatccgctggcggcgatcatcgcacaggcgcatcaacagggcgcaaaagtgctggtggacggcgcgcaggcggtgatgcatcacgcggtggacgtgcaggcgctggactgcgatttttacgtcttctccgcccataaactgtatggcccgaccggtatcggcattctttatgtaaaagaggcgatcctgcaggcgatgccgccgtgggaagggggcggggcgatgatcgccaccgtcagcctgacggaaggcaccacctgggcgaaagcgccgtggcgcttcgaggcgggcacgccgaataccggggcgattatcggttttggtgccgctattgagtacgtcactgcgctgggactggacgccattgccgaacacgaacgcggactgatgcgttatgcgcttaacgcgctggcggaggtcccggatctgacgctttacggcccggcggatcgtctgggggttatcgcctttaatctggggaaacatcacgcctatgacgtgggcagttttctcgataattacggcgtcgcggtgcgtaccggacatcactgcgcgatgccgctgatggcgttttacaatgtgccggccatgtgccgcgcgtcgctggtgatgtacaacacgcaagaagaagtggatcgtctggtagccggactgaaacgcattcatcagttattaggctgacagggggacgagatggccgctttacccgataaagaaaaactgttgcgcaactttacccgttgcgccaactgggaagagaagtatctctacatcattgaactgggccagcgcctgccggaactggcagcggaggcgcacagcccggaaaatgttattcagggctgccagagtcaggtatggatcgtcatgcagcgccgggatgatggcgtgattgaactccagggcgatagcgatgctgccatcgtcaaggggctgattgcggtggtgtttattctgtatcagcagatgaccgagcaggatatcgtcgcctttgacgtgcgcccgtggtttgaaaagatgtctctcgcccagcatttaacgccttcccgctcgcagggtctggaagcaatgatccgcgcaatacgtacgaaagcagcaaacattagctaaactcaaaagacagcgactatcctgttatgcggggcagatttctgcctcgctggtttatcagccttctggcgcactgccagtgattacaggagtttaagcatgaagcgcgcgtctctaataacattaagccttatcggcgcttacagcgtcattcagagtgcctgggcggccgattatccattaccgccggcgggcagtcgtctcatcggtcagaatcagacttatgtcgtgcaacctcaggatcgtaatttgcaggccatcggccgtcattttgacaccggcgcgatgctgctcgtcgaagccaacgataccatggcgcctgtccccgcccctggcacaaccctgaccattccaacgcagatgctgctgccggacagcccgcgggaggggatcatcgtcaacctggcggagctgcgtctctatttttatccgccgggaaaagacattgtgcaggtcttccccattggtatcggccagcaggggctggaaacgcccatcgccgagacacgcgtcagccagaagatccccaatcctacctggacgccgcctgcgggcatacgtgcgcgttctaaagcgaagggcattgagttgcccgccgtggtgccagcaggcccttataaccctctggggcgctatgcgctgcgtcttgggctgggcaacggcgaatatctcattcacggcaccaacgctcaggacagcgtaggcctgcgcgtcagctccggctgtattcgcatgggcgcgccggatatcgaagcgctgttctcccaggtgaacaccgggacgccggtgcgcatcatcaacgaaccggtcaaatactccgtggagccggatggccgccactatatcgaagtgcaccgcccgctggcttccacccttgaggagaacacccagacggtgccgatcacgctgaccgccacctttagcgattttattcgtcaggcgggcggggatcagacggcgattgataaggcaatggtgcgccgtgccggttacccggtggcgatccctgccgcaaagaacgcgcaggcaaacccgacagccgtactgtcagcaaagaatggtgatccggcggtggcgaacgagaacgggaaagtgatgacgcagtaacggaaggtaaatcgcaggcaaaaaaaatggcgcacaatgtgcgccattttattacaggaactcttacttacggtaagagtgagcctggttgtccagacgctggttagcgcgagctgcgtcgtctttagcagcctgaacgtcagaacggattgcgttcacgtcgttgctcagctggtcaactttagcgttcagagtctgaacgtcagaagacagctgatcgattttagcattgctggagcaaccagccagcagagtagaacccaggattaccgcgcccagtaccagtttagtacgattcattattaataccctctagattgagttaatctccatgtagcgttacaagtattacacaaacttttttatattgagaatatttttttgttgggaatacccttaaatttgactgttcgctcaaagaaacaccgactttgcgggcgcacagaaaaaaactgtgtgaaaacagaccgctttcatcggattcatcttagaaaaaagtcagttaaatagtgcatttcgatttgcacttattgaaaatcgttattggatgaataaaaaaaagcgccacaagggcgcttttttaatcagattaatttgtacggcaattattacagcacgtgcacagaagcagtattggttgtgccgcttggaaccagcgcgccggaaaccattaccacaacttcacctttctgagccaggccgctttccagcgccacttctttacccagacggtagaaatcgtccgtggaggagatctctttcaccagctgcgcggtaacgcctttgctgagcaccagctgacgggcagtgacttcgttagtggtcagcgccaggatggtggcatccgggaagtatttacggatagcgcgcgcagatttaccgccctgggtcgctaccacgatcagcggagcagccagtttttcggcagtttcaacggcaccacggcacacggcttcggtgatgcgcagtttacggctgtcgttggtaaactccagacggctggtcatcacgcggtcagtacgctcgcagatggtcgccatgatggagacggcttccagcgggtatttacccttggcagactcaccagacagcattacggcatcggtaccgtccaggatggcgttagccacgtcgcctgcttccgcacgggtcggacgcgggtttttgatcatggaatccagcatctgggtcgcggtgatcaccactttacgggcgcggatacatttttcgatcatcatcttctgcgcgaagatcacttcttcaaccgggatctcaacgcccaggtcgccacgcgcaaccatgatgccgtcagaggcttcgaggatttcgtcgaagttgttcaggccttcctggttttcgattttggagatgatctggatgtgctcgccgccgtgcgctttcaggtgctcacggatttccaccacgtcagaacgcttacggataaaggatgccgcaacgaagtcaacgccttgctcgcagccaaagatcaggtcttgtttgtctttttctgccagcgcaggcagggcgatggaaacgcccggcaggttaacgcctttgttctcgcccaggtcgccgttgttcagcactttacagataactttgttgccttcgatggcggtcacttccataccgatcagaccatcgtcaaccagtacggtgttgccaacggacaggtcattggtgaagccttcgtaagtgacagcaacgatatcgctgttacccacaacggttttgtccgtggtgaaagtgaaggtctgacctgctttcagggagacgtcattaccgccttccagcttgatggtacggatttccggacctttggtgtccagcaggatggcggctttcttgccggttttgctcatcacgttgcgcaagtttttgatgcgctgaccgtgttcagcatagtcgccgtgagagaagttcagacgcatcacgttcatgccggcgtccagcattttggtcagcatctcttctgattcggtttttgggccgattgtgcaaacaattttggtctttttcatgacagtcttagtctttaagttgagaaggatatggaaataacgctccgggggcgcaccgccgcggagtcaaaccggtgttgcgaaagttttgcgatgtcacgtcataagaataggtgacatcaaaaaaagcgtgcagaggaatatgtgcttgtgtatcagcccaggggggaatgagtcgctgtgatagttgaatattacagttcaatgagctgaaaccattcaagagtcaattggcgcgcattatacgatgaaaaacagtcaaaaggaaaatgaaaacagcgtttcaaaatgcatctgtgcagattcacaacgaagtgttatcaaggtgttaagtaaagacagaaataatttcaggcacttaataaaattaacaggcccgagggggtaaaacccgacgggcctgttgcgctcaccttaaactttcaccagccttgagaccagcgccacgcccaccatggcgatggccaccaccacaaaagcagcgctcaggctgctgtgatgcgcaatcccgccgatacttgccgggcccgccagcacgcccatgtagccgagcgtagtgacggcaggcaccgccagcacctgcggcatggctgtctgacgtccgattgccgaaaacatcaccggcacgatgtttgcgcaacccagaccgatcagcgcgtaacccgtcagcgacagcacccaggcatcagacgccaccgtcagtaacaggccagcggcggccagcagcgcgccgacaaagaccaccggctgctggccgagacgggcgacaacgcggtcaccggttaatcgccccagcgtcatggtggcggcgaagcaggcaaaacccagcccgccgcgtgcttccggcagcccgcggtattcggtgaggaacaccgcgctccagtccagcaccgccccttccgccagaaacaccacgaagcagataccgccaagcagcagcacgataccgtgcggcaccgcaaaggccggaccttcctgcggattcgcgtagctgagaaaaccgcgcacgcacaccagcagtaacgctatcacgataagggtggtggcaagactggccgcctgggcggaaagccccagcgacatcatgccgctcatcgcaccggcaccggcaatccctcccacgctgtaaaagccgtgaaaaccggacatcagcggacggggagacgctttttcgacaatgatcgcctgtacgttcatcgcgcagtcagtggtgccgataccaataccgaacagcagcagcgccagcgccagcagtcgcgcatcctgggttatcgccagcagcggcagaatggcgcagaaaatcagcaccgacaccaccataacccgacgacagccaaagcgggcggtcagcgcgccggtaaggggcatagccaccagcgcgccgccgccgagacacagcagcagcaggcctaacgtgccgtcgctgacgccggtattgtatttggcgaagggcaccagcgccgcccaggccgcggtggcaaagccggccataaagaagacaatgcgcgttgcccgttgctcgtttctgccgggcagtgcgcgcgacgcaccgccggtagcgggtaattccagggctgcgtttttattgctcatagacatcctgtaaaaccatcagctgttaagaattttcagcgcttcgtcatgcagacgcgggcagccggacgccagaatgcggccaccggcttccgggcgatcgcccgacagcgtggttactacgccgcccgcctgttcgacgatcggaacgaaggccacaatatcgtaaggttgcagggcatattccagacaaaggtcgatttgcccggctgccagcatcgccatcgcatagcactcaccgccgtagcgggtcatcagggtcgcgctgtgcagcgccgcaaagttgacgtccgggctgtgggcaatcggctccggagaggtggtatgcaaaatcgcctggttaagcgacagtcctttgcgggtggtcatgacaccgctgccctgcggaccgctgcgccaggcctgtttcccgtccgcccagaagcgttcgccggtaaagggctggcccatcatgcccagctgaccgcgaccttccaccgtcaggccgatcagcgtgccccacaccggcagaccgcacagaaaggggcgggtaccgtccaccggatccagcacccattgcagcgggccgtcgccggtggtcccaaactcttcgcccatgatggaatgggaagggtagcgttcgttgataatggcgcgcatcacccgctcggcttcgcgatcggcatcggttaccggatcaaaacgaaagccctctttgggtttggagccgacatgcagatttaagccggaacgaaaacgcggcagcgtctcgttatcggcggcatcggcgagttcatggaggaaagcgacatcgggcagggaatagttcatgtttcgatccttttaagcgtgaacaacggcagggcgcagaaaatctttctgcttggttgtgctcgattatgcgcgatcgtgtgcaagagtacaaatggctctgcgtattatttttgttcagccggcgaggatcacgtccagttttttactgcgcagcgctttcagcgcctgttcgctcacggcgtcatcgatcaccagcgtcgtgatctcttcgctggtggcgacctgataacgggcaagagtggcgattttatcggcggtcagggtgacgatgatgtcgctgctgcgcgtcaccagacattttttgaattcggcatcgtcatactcaaacaccgtcacgccttcgtccgcgtcaaaagcgcaggcgccaagcagacactgatcgaaaaacattttttcaatgtggcgcagggtatcaataccggtcgcgccgcccgtctctttattgatccgcccgccggggaagatgatttccaccgcctcgtgatgcatcagttcagcggcgattaacggggaattggtgacggcggtaaggataataccgggaggcaactggcgggcgatggcgagatttgtcgtcccggcatcaaaaaaaacgcagctttcgggtttgatcagcgataccgcgcggcgggcgagctgttcttttttatcgctgttaaggttttcgcgcttcagaaaattaccggaagggggaagcacgctgaccgcgccgccataaacacgcttgcacaggccaagattcgccagctctttaaggtcgcggcgaatagtgtgttcggagacgttaagctcaggcgcgagctgggcgcacacgactttgccgttaagggctaaaagctgctttattttttcctgacgctgctcgggaaattcggcgtaatcaaacatagtggcccactgaaatcatcacaggtacgcataagcgagcatgatgggataaagcggtcagggagtcaaacaggaagaaaagggagagtattgctgaatggtgcgtccgagtggactcgaaccaccgacccccaccatgtcaaggtggtgctctaaccaactgagctacggacgcactgtacagaaagaatggtgcgttcaattggactcgaaccaacgacccccaccatgtcaaggtggtgctctaaccaactgagctatgaacgcattgttgtgctgacaacggggacgaatattagcggcagggcgcggccgtggcaagcggaaaaaagcaattttcattctgatttcacgcgattgcggaacaactgcgcaaaatgttgagaaagtagccgcccgcaggcggctacactgtacttaacgcgccgcgcgggcgaggatcacccctgaaggctgacgttgcaggtaacgcatgcgcagcatcatcaggatggctgccgaggtcaggccgatgataaagcccatccagaaaccggcaggacccatgcgatccaccaccagatcggtcagcgccagcacatagccgctcggcaatccgagcacccagtaggcggtaaaggtaataaagaagatggagcgcgtatctttatagccacgcagaataccgctgccgactacctggatggaatcggaaagctgatacaccgccgccatcagcattaactgcgaggccagatgcaccacttccggattgtcgttatacagcagggcaatatcttcccgcagcgcgacggtgaagatcgcggtgacgaccgccatgcagacgcctaccgccagcccggttcgcgcggcggtttgcgcatccagcgtcgagccctggcccaggcgatagcccacgcgaatggtgaccgctgccgccagcgacatcggcaggacgaacatcagcgagctgaagttaagggcgatctggtgcccggctacatcgacaatgccaaggggcgacaccagcagcgccaccacggcgaacagcgtcacctcaaagaacagcgcgagggcgatgggcagccccagttgcgccaggcgcagcagcacggcgggatccggtttgccaaaacgcatatcgttacggatgtcgcgcatggagcgcgcgcgcttaatgtaggagaccatgcagacgaacatcatccagtacaccgttgccgtcgccacgccgcagccgacgccgcccatctcaggcataccgaaatgaccataaatcagcacatagttgatggggatattcaccagcaggccgagaaaaccaaacaccatgccgggcttggttttcgccagcccttcacactggttacgcgccacctggaagaacagatagccaggcgcgccccacagcagggcgcgcagatagcgcaccgctttgtccgccagttcgggatcgatattgtgcatcgcatgaatgatatgacccgcgttccacagcacgatcatgatcagcaccgacacgccgcccgccagccagaaaccctggcgtacctggtgggcaatacggtcgcggcggccggagccgttcagttgcgcaaccgtcggcgtcagcgccagcagcagcccgtgaccaaaaagaatggcgggcagccagatagaggtaccaatagccaccgccgccatgtcggtggcgctgtagccgcccgccatcacggtatcgacgaaacccatcgcggtctgggcgatttgcgcaatgatcaccgggatcgccagtgctaataactgacgcgcttcaagaaagtacttctgcacgtgaacacctgttgaattgtagttatatgaaaaactgaatagccgccgttactggcagcaaaagatttgcaggagaaataaccagtacattgtagcggggaactgcgattaatccagagaaaaaacagcgtaataagtcccgagactggcaacctcatttttcacctgttattgtgctggtataaacacggttaaccgaattaatgatacaggagcaccaggcatgtttaccggtattgtacagggcacggcaaaagtggtgtccattgatgagaaacccaatttccgcacgcacgtcgtggagttgccagacaccatgctggatggcctggagacgggcgcgtccgtggcgcacaacggttgctgcctgaccgtaacggaaattaacggcaatcatatcagtttcgacttaatgaaagagacgctgcgtattaccaatctcggagaattaatccccggtgattatgtaaatgtcgagcgtgcagcgaaattcagcgatgaaattggcgggcatttaatgtcggggcatattatcactaccgcggaagtggttaagatcctggcgtcagaaaataatcgtcagatctggtttaaagtccaggatccgacgctgatgaagtatattctttataaaggatttatcggtattgacggtattagcctgacggtaggcgaggtgacgccgacgcgcttttgcgtgcacctgatcccggaaacgctggagcgcaccacgctcagcagcaaaaaactgggcagccgcgtcaatatcgaaatcgatccccagacccaggcggtggtggacaccgtcgaacgcgtgatggcggcccgggtggtggtggtcgagcgcgacgagtaaatcccacaaaaaaccccggcaagccggggttttttatcaacgcgccacgcgcaggccgttttccacgccccggctgaacaccacctgccagagctgaatatcccgcgcgcggaacgcccccgcacaggcattgagatagtagctgaacatccttctgaaacggtctgaataattgccggcaatctccggccaggcggcctgaaaacggctatgccaggccatcagcgttttatcataatccgaaccgaagttatgccagtcttccatcacaaaatgcggctcgctggcggtggcgatctgccgcaccgacggcagacagccgttagggaagatgtacttattgatccagggatcgacgtggtggtcggttttattcgagccgatagtgtgcagtaaaaacaggccgtcaggtttcagattgcgatcgacaacctcaaaataggtggcgtagtttttaggaccaacgtgttcgaacatgccgacagagacgatgcggtcaaactgctcgttaagatcgcgataatcctggagcaaaatagtcacatcgagatcctgacagcgttcctgcgccattttttgctgttccgcagaaatcgtcacgcccaccacgctgacgtcataatgctgcgccatgtactgcgcaagcccaccccagccacagccgatgtcgagcacacgcattccgggctggagctgtaacttttcgcaaatcagttttagcttggcaagctgggcgtctgccagcgtcgtggcatccttccagtaggcgcaagagtattgcatttgcggatccagcatgcggctgaacagatcattacccaaatcgtaatgctctttgccgacgatccatgcccggcgcttgctctgcaaattaaataatctggcgcccgctatacgcagcgtatctttgagatggtgcggtagctggttttcaagaccggcgcgcagaacgttgttgaagaaaatgtccagccgctcgcaatcccaccagccgtccatataactttcacccagccccagcgatccttcctgcagcacgcgtttaaaaaaatgaggatttttgacctgaatatctaccggggacgaaccgttgattgtgatccccgcccggccaagcagttcgcttacgatacgaaaccagtcatcatcccgtatgttaacgtcttctatgcacgatgaactcatagcttctccatcacctgtatgtgatcagaaccttcaaacagcgtagtcgctttttagggtttgtgagaaatctcacggaatggtccgcgagccagaaatccgacgtagaacagaggaagggagattacccttgccgtaaaggccgtccgtggtgagagaggcgtcatcctgcgcctgttactgcataatatttatcgtaattatatgtgccggaaatgagtataggcctcagatccggcagatacaatagtaaattcttagcaacctaatcactgatttgtaacatagttgcacggtgaactatgcagaggcggtttcagcattcgcgtctgttacaccatgacgctgcatccggtaaccggcagcggccagtaacacggtgatcagcattacgctggtggtggtcaacagcggcgtgccgataagcgcggacactaccagactggcaaggaaacagagccccagttgcagggtattttgcaacgccgccgcgcgtccggtcgcctgcgggaacgggcgcagcgcctgggccaccacaatgggatagatggcgccgttcgccattgccatcacgcagaagggcaccagcagcgccgtgagagattgacccgccaccagcccggctatccaggtacccgccacgctcagaccgtagaacaccagcagccacggcagtaactttttaccctgccacttttgcagcgccgcgcggcatccatagccgccgatcagaaaggcgatggtttgcggtacatagctcaggccaatggccgccgggccgtagcccatttcgctgaggataaagggcgagccggtcagccaggcgaagaagctggcggagcaggcggcgtagatcagcacgttaccgcggtaatcccgggaacggagcagggtggcaaaggtcagcggcacgtcgctgctggtggttttttttaccaccggcttcaggcgcagcgcgggcagcatcagcaccagcgtaatgacaaacagcgtcataaaaatcatttgccaggaaaaatgcgcgaggatccagctgcccagcagcggcgcaagggccggagagagacccaccagcggcataatggtggcgaagatacgattagtgcggtgcgccggatagtgatccgtcaccagcgcctgccaggtgacggcggcagcgcagacgccgatcgcctggataaaacgcagcaccagcagccaggtggcgtcgcgcacccacagcatgcccagacagccgacggcaaagagcgccagaccgcttaacagcaccgggcggcgaccataagtatcggacagcggaccccacgccagttgcgcaaccgcaaatccggctaaaaacagactcaggctggcgctgacggcagccgccggggtttgtagatcattctgaataacggcgaaggcgggtaaatacatatctgtagccagaaagcccagtacgcttaaccccgccagccagactaaaaatccttttccaggtttcatgtcacgttctcttgttttggcaggtgagcagagcggcagagtgtagggagtgcaatgacggttgtgaaacgctaatatttgcacattgcattcaaaaaatttgcaggcagaacatgtggtcagaatattcactggaagtggttgatgcggtggcacgaaccggcagcttcagcgccgcggcgcaggaactccaccgggtcccatcggcggttagctatacggtgcggcaactggaagagtggctggcggtgccgctgtttgagcgccgtcaccgtgacgtggtgcttaccccggccgggcgctggtttttaaaggaagggcgatctgttatcaaaaaaatgcagatcacccgtcagcagtgtcagcagatcgccaacggctggcgggggcagttatccatcgcggtggacaatatcgttaagcccgaacgtagcaggcaaatgatcgtcgatttctaccgccactttcaggatgtggagctgatcgtctttcaggaagtattcaacggcgtgtgggacgcgctggcggatggccgcgtggaactggcgattggggcgacccaggcggtgccggtgggcgggcgctacgccttccgggatatggggaaattgagctggaagtgcgtggtatcccgtgaacacccgctggcggcgatggacgggccgctgagcgatgacaccttgcgcaactggccgtcgctggtgcgcgaagacacctcccgctcgctgccgaagcgtatcacctggctgctggataaccagcggcgcatcgtcgcgcccgactgggaatcctcggcggcctgtctgtcggcgggattgtgtatcggcatggtaccggcgcattttgccaggccctggcttgatcgcggagagtgggtggcgctgccgcttgaaaaccccttcccggacgccgcctgttgcctgacgtggcagcaaaaggacaattcgcccgccttaagctggctgctcgattatttaggagacagcgagacgctgaataaagagtggttgcgggagccagagtgactggctcccggcaggcttaacggcggtagtcgcggaacgggccgtcggcgaccgagcggcgttcgatgagacgcgggtgcacctcaatggactgcgactcttcacgcttgctgacgatcctgtccatcagcatattgaaggccgtttcgcccagcgaatctttcggctggtgaatggtggtcagcgccggagtgaagaaacgcgcgttgcgcacgttgtcataaccaatcagcgacacgtcctgcggcacgcgcagacccatttcatcagccccgcagagcgcgcccatcgccatcacgtcgccgccgcagaagactgcggtcggacgatgcggctgggagaggatctgctgcatggcgcggtagccggattccggctcaaagtcgccctgcacgatccagttttccggcaccttaatcagcgcttcttccatcgctttcataaagcccgccagacggcccgcgccggtgttacgctcaagcgggcccggaatgacgccgatttcacggtggccacgttcgatcagataacggcccgccatatagccgccttcaaaagcgttatcgatcaccgaatcggtaaagtccgctttcgcttcgccccagtccatcaccaccatcgggatatgacggtactcttcaagcatgcgcaacagcgggtccgggtattcagaacacatcaccatcaggccgtcgacgcgcttttgcgccatcatcgacagataagcgcgctgcttttccaggttgttccaggcgttgccgaggatcagggtatagcccttctggaagcagtttttctcaacagcttcaatgatttcggcgaagtagggcgcttcgctgctggtcgccagcaagccaatcgacttggtatggttaaccttcagactgcgcgccaccgcgcttggggaataatgcagctctttgatggctgcccacaccgcgttgcgcgtttcttccgcaacaaaacgggttttgttaataacatgtgatacggttgtagtggaaacgtttgcgcgtttcgctacatctttaattgttgccattagatctcactccagaccatatcttaaactcctgatacttctacaggtaaacgtttgccttaaaaaacccttcgcacaacattttcaggttgcgatacgccgggaaaacaacacaggacgtcaggaggggtcagtggccggtacacgaataaatttagcgtggaattctggctgatcttgatgaaaaggggaagtctaaaaatggttatcaatctaaaacagagaagatttttgcgtttaactgtgcaaaaatgagcaatctcactttttgtgggggttaacaaaggagaaaaaatgatggatagcaatctgaagtattcgctgtttactaccgtaatcgtgctcagcctgatcgttgctggcgcaatgactgccgcttttaattgatccagagcagggagagcgctctccctctctttttcattcccgccgattgttatcaaatttgcaataatcttttgtcacttcattaacttctgtttttttgtgattaatgtcatgcttttgacttcaccgcggggcgctctgtacgccatcgcattactggagtcatgtaataatgaagataaattttcccctgctgtcactggcaatcggggcttttgggataggtacaactgaattttcacccatgggattgctgccggtaatcgcccgtggcgttgacgtctcgatccctgccgccggcatgctgatcagcgcctatgcgatcggcgtgatggtgggcgcccccctgatgacgctgctgctgtcgcatcgcgcccgtcgtaacgcgctgatcttcctgatggcgattttcaccctcggtaatgtactgtcggccattgcgccggattacaccacgctgctgttatcgcgcattatcaccagtcttaaccacggcgccttctttggcctgggttcagtggtggccgcaagcgtggtaccgaaacataaacaggccagcgccgtggcgaccatgtttatgggactgaccatcgccaatatcggcggcgttccagcggccacctggcttggggaaaccatcggctggcggatgtccttcctcgccaccgcaggtcttggcgtggtgtcgatgttaagcctgttcttctccctgccgaagggcagcgcgggcgtgcgtccgaatgtgcgccaggagctggcggtgctgatgcgcccgcaggttttatcggcgctgctgaccaccgtgctgggcgccggggcgatgttcaccctttatacctatatctcgccggtgttgcaggagctgaatcacgccacgccattctttgtcaccgcaatgctggtgctgatcggcgtgggcttctcgctgggcaattacctgggcggcaagtttgccgatcgttccgtcagcggcacgctgaaaggctttctgttgctgctgatggtgatcatgctggcgatcccgctgctggtgaaaagcgatatcggcgcggccgtggcgatggtagtgtggggcgccgcaacgttcgcggtggtgccgccattgcagatgcgcgtaatgcgtgtcgctcatgaagcgccggggctgtcttcgtccgtgaatatcggcgcttttaacctcggcaatgcgctgggcgcggcggcaggcggcgcggtgatctccgcaggattaggctacgccgttgtgccggtgatgggcgctgttattgcggcgctggcgttgctgctggtgctgttttccgggcgcgccgatgcccgccgggaatgcgtggcgaactgatcgttactgagtaaaaaagaaaaacaccctgccagtccggcagggtgttttttttagcggacgtttttcggcgtcatcacccggcgcgcgcccacataatgacgctgccagtaatcttcgctaagggaagtgatttgaatatcctgaccactgcgcggcgactggatgaatttgccattgccaacgtagacgcccacgtgatcggcggtgccgcgaccctgcgtgcggaagaacaccagatcgccccgttccagctcgcccgggttgaccggcgaggcatcacgcaggtgatacatttcattggcggtgcgcgggatgcggaacttcaccagatctttataggcgtaatacaccagcccgctgcaatcaaagccggtacgcggcgaggtgccgccccagtgatagggtttgccgatctgattcattaatgtcgataacgccgccgtctgggcctttttaatgcgcactttatgcgcgtctgccagggtaaccggcttgctgcttttcactttcacgcagtgctgcttgcggcctttgcgggtggtgcacttttccgtaaaggtaacggcggcaattttccccgggctggatttgcttttgcgtgaggcgaggctgctggttttagtaccggatgagacgcgttttgttctgctggaggttttttgactggcggaactgctggatgcttttttagctatttttttactgttgccactgcttttctttgttgtcttttgggtcgtgctttgcttcttacggtcgctggttttcgccagatgcgttttttgcacggcagagggccgtgcctgttcagacgcctggcttaatggcgcaaacgtcagcgaagcaaaaaccaaagcacagagcgtgatcgagactttatttatccgcgccactgagcaatcccctgattcgggcaggcatgaaatcatgcgtgcgtgtgattttcaaaactcgtcgattctaaagcataaaatgctaaaaaggtaagagcctttttgcatccttgcgctgtttcgttaacaagcgcaaaaaaaagcagcaattcagggaaggaaacggttaaggcatgagcgaatcgtttcgcgcaaactgatattcttaaggcatctttatccgacagacgataatataacgcgtggtgaacaaaatgttattttccgtgggttgtctgaaccgctacaataagacgactgtcgtagaagaagttaaggaagcaagacaatgagcgagaccatcgaaaaaatccagcgtcaaatcgctgaaaacccgatcctgctgtacatgaaaggttcccctaagctgccaagctgcggcttctctgcccaggcagttcaggcgctttccgcctgtggcgaacgctttgcttatgttgatattctgcagaacccggacatccgcgccgagctgccgaaatacgccaactggccgaccttcccgcagctgtgggtggatggcgagctggtaggcggctgcgacatcatcattgagatgtaccagcgcggagaacttcagccgctgatcaaagaaaccgccgcgaagtacaaaaccgaagagccgggggctgaataagcgcaggcaataaaaaagcaccctcgggtgcttttttttatggctgattttcgtcgccaggcatcgccatcggccagccgcccagccgcttccagcggttaacgatctcgcagaacagcagggcggtttgctcagtatcataaagggcagagtgggcctgggtgctgtcgaaatccagaccggcggcggcgcaggctttggaaagtaccgtctgtcccagcgccagaccgctcagtgaggcggtgtcaaaggtcacaaacggatggaaagggttgcgtttcagcgaggcgcgcgcggcggcggccatcataaagctgtgatcgaaggtcgcattgtgggccaccatgatcgcgcggctacagccgctgtctttaatgcctttgcgcaccattttgaaaatcgcatgcagcgcatcgtgctcactgatcgccccgcgcagcgggttagcaggatcgataccgttgaacgccagcgcttcaggttgcagatttgctccttcgaacggctcaacgtgaaagtgcagcgtgctgtccggcatcagccagccctcatcgtccatttttaaggtaatggcggcaacttcgagcagcgcatcggttttggcgttaaacccggcggtttccacatcaataacaacagggtaaaaaccacgaaatcggccgcacagaccggtgagttgagcgttatcggacatcaggatctcttaagacggaaaattgcagcgcgcattatggcaaattttacgcaaggattataccgcgcagaaagaacgggcgcggcgcgcccgtgggggatcagttgcccagaccgcgaccggcgtctttggcttcgatcagttcgattttataaccgtccggatcttcaacgaaggcgataaccgtggtgccgcctttaaccgggccagcttcacgggtaacattgccgccattctgacggatacgttcgcaggcttcagccgcgttatccacttccagcgcgatatgaccgtaagcggtgcccagctcatagctgtcgacgccccagttgtaggtcagttcgataaccgcttcgtcgctttccgggccgtagcccacaaatgccagcgagtatttgtattcggtattttcactggtacgcagcagcgtcatgcccagcacgttggtgtagaagtcgatggagcgttgcagatcgccaacacgcagcatggtgtgaagtaagcgcataatatcctcttaatcagttgttttgcgttccggtcgtaaagctttatgcagtatagcggcggagtgtcgccgctatcaatcaacggatcacagagtagggtagtcggtgtaaccttccgcgccgccgccgtagaagctttccgggcgctgcgggttcagttccgctttgcgttccaggcgctcaaccagatccgggttggcgatatagtcacgaccaaaggccaccgcatcgataagccctttgccgatcagatcttcggctttctccggcgtgtaagccccggcgccgataatcgggccgtggaaacgggcgcgcattttttcacggaaggcttcggtataaggcgcgccgcccgcccagtccggctcagacatgtgcaggtaagcgatgccgcgacgggccagctcttcgatcagatacagcgcatcggcttcttcgttcgggccattgtcggtgttctggaaggtaccgattggcgagacgcgaataccaatgcggtctgcgccccactcgttacagaccgcatccaccacttccagcaccagacgggcgcggttttccacgctgccgccgtactcatcggtacgctggttagcggaaggggacaggaactggtgcagcaggtaaccgtgggcggcatgcagttcgaccagatcaaaaccggcttcgcgggcgttggcgacagcctggcggaaatcgttcacgatgcccggaatttcatcgatttccagcgcgcgcggcacggaggtttcttcgcggatggcgttgccattggcatcacgcagggaagtacgggtacccgctgcgatggcagagggcgcgaccggcgcctgaccgcccggttgcaggctggtgtgggagatacgaccggtgtgccacagctgtacggccatatggccattttcagcgtgcacgccagcggtgatttttttccatgcggcaatctgctccgggctgtgcagccccggcgcgcccgcatagccttttgcctgggcggaaatctgcgtcgcttcgctgatgataagaccggcgctggcgcgctggcggtaatattcgcccatcagcggggtcggaatgtcacctggctcaatgctgcgcaggcgcgtcaacggagccataaatacacggttcggtacggtaatggcacccactttcaacggggtaaataacgacttagacataactgctcctgaatagaccggtcgactagtaaaagtagaaataaaaacgcctgttattgtgcaggcgctgcgataacaaatcgggcatgcgccagcgcgctttccagcggcacggcgctgcgtgacatcttggcctgcagattcgcccccagccacagggaatagagcacctgagcctgcgtctgcgcatcgccgggaaaatcgaggctgcgctcaccacggcctttttccagcgcatccgcaatcagagcgatcacctgggttgcgccattattcatggcggtgcgcatatcctctgacagatcgcacacttctgcagacagcttcaccgtcagacaaccgctgataatgccctgctgacgaaactgctccagcgtatattcataataggccagcacgcggtcacggtaattaccttcactgctggcaaaatgctgcgccagccgcgcatggtaatttgcgtaatgacgctccagcagcgcgacgccgaaggcttctttcgagcggaaatagtgataaaacgaacccttgggcacttccgccgttttcagcagttcgcttaatcccatgccggtgaagccacggtgcatacataactgctcgccggtggccagcagatgttcgcgggtatcatgttcagtgtgtctgttcatgacgtcactgtaatagaccgttcggtctaatgcaagacgatttgcgaaatgctccggtggcgtcttcaatgtaataaaccctaaaccggaggccgggcgtggcagagcaacttgagtttttcccgatccagagtccgtgtcggggcatttgtcagacggacgagcgcgggttttgccgcggctgtatgcgaacgcgggaagaacgttttaactggcaaaacatgagcgatacgcaaaagcagacggtgttgcgcctgtgccgccagcgtctgctgcgtaaattacgcgcaaacaaaccggatgcgccggaggaaccgcaacaaccttcacttttttaatcgtgcatatgcgtatactcagagcacattaattaaagaggaagcggttatggttcagcgtattacccttgcgccgcaaggcccggaattttcacgtttcgtaatgggctactggcgtctgatggactggaatatgtctgcgcgccagctggtgagcttcattgaagaacatctggatctgggcgtgaccactgtcgatcacgccgatatttatggcggttatcagtgcgaagcggcctttggtgaagccttaaagctggccccgcatctgcgcgcccgcatggaagtggtgtccaagtgcggcatcgccaccaccgcccgcgcggaaaatgcgctcggtcattacatcaccgataaaagtcatatcatcgccagcgccgaacagtcgctgcgcaatctggctgtcgatcatcttgatttgctgctgatccaccgacctgatccattgatggatgcggatgacgtggcggaagccttcctgcatctgcaccagagcggcaaagtgcgtcatttcggcgtgtcaaactttaccccggcgcagttcgcgctgttgcagtcccgtctgccgtttaccctcgccaccaaccaggttgaaatttcaccggtgcatcagccgctgatccttgacggcaccctcgaccagctccagcaactgcgcgtgcgtccgatggcgtggtcctgcctcggcggcggtcgtctgtttaatgacgacgctttccagccgctgcgggatgaactggcgcagatcgcccaggaagtgaatgccgccagcattgagcaggtggtctatgcgtgggttctgcgtctgccgtcacagccgctgccgattatcggctccggtaaaattgagcgcgtacgggcggctattgaggccgaaaacatccagctcagccgccagcagtggttccgtatccgtaaagcggcgctgggctacgacgttccctgatcacggaataacctgactttccagtgagatccttacccctggtttacacttcaggggtaaatctgatcaagggaggttatatgaagcgtttttgtctcgcgatgctggctctgtccgtctgcgcaggcgcgcaggctgccagccaggaagttacgatgaacctcgtcacctccgggggcatcggtcagtccattggtacagttaaaatcagtgaaaccgataaagggctggaatttgcccccaatcttaaagccctgccgcccggcgagcacggtttccatgtgcatgccaaaggctcctgcgaaccggccataaaagacggtaaagcagtggcggcagaagccgcaggcggccacctcgatccgcacgataccggcaagcatgaaggcccggaaggtaaagggcataccggcgatctgccggtgctggtggtcaacaatgacggcaaggccaccgacgcggtggtggcgccacggctgaaaaaacttgatgaagtgaaagacaaagcgctgatgatccacgttggcggcgataatatgtccgactcgccggagcccctgggcggtggcggagcccgttacgcctgtggtgtcatcaagtaatctctgaaggtaccacgcctgctgccggggcctgttcaagttgcaggagcgcgcaatagagccgccagacaatggaggccagttcccgcgcagcaggctggtgatgccgggccagcgtatcgcagatgcgctgtagctcctccagcgttatccccagcgaaacatgccgcacgcctttttcactcatcacgtcacgcagcagcgcaagacagcgatcccgcacccgcgatagcggatcggagcgggtttcccagtcgcgcagctgccacaccacatgcgtacagttaagcagcaccacgccccagcgcaacagccagcgcctggactgcgcgtctttactctggctgagctggctgacgtgatgataaaccagcgactcgaactcactttcgcggtagtgcggccgacggcttagctgatcgataaaccgcaggcgcagggcgcgaatatgacgatggcttttacgggcgtccgatccgggacgcagcaccgcgaatgccagccacgccatgcccacgccgagtaatttccccagatcgtcattcagaaaatccgcgaagtcatacaccggtggattagtgacggaaataaacgatcccataaagacaatcaattgcccccacagaccggcgtatttcgccatttgcagcttcagcagttgcatggtggtcagcagcggaaacagaaaaagtaaaaactgccaaagctccgaaatttgcaccatcaggccaaacttcaccgcaaagctgaacagcgacagtaaaagcagcgtgcgcatcagcagcgtcagggagctgaaaggcgaggcaacggcggaatagagcacgcagctgatggccgccagcgtcagcgccgaggcgcccgcctcccactgcgcgccgatagcccatgcaccaatcgccaccagggtggcaaaggtgcgcagcccgctccagacggcttccagattatcggtatgacgggccagcgctggcgcacgcggcacggtgaaagcggtgacggggcgggcatgttccagccgctggatccagcgactgctggctaagtgcaagcggcaaaaatagcgcagcctgtcccagaaggcgcggtggcggtaatcggcatcatcccgcggcgcaagcggggcgataatgcgcgccacggcataaaaatccgcatccggacgcccgagggcggcgagcagctgttccagcactggacgggtggcggccggcgcgtcgggccagttcagcagcagacgccgcaggcttgagatcacgctggtcatgcgtagctgttgatgcagtaaatagttgagcagggcgttttgctggcgaaagcggtagtggctccagaacgcctgaatgcgcagcaggttgagggtgaggatctggccgatgacattttcatgggcggcgcgaatggcgtcgctggtgtccggctgccagattaaggcggcgtgttccagcaggcgggcttgcctgtttttcagcgcgctgagcagcgccgtgccatccggggcgctcggcaggatcatcatcatcatgccccccgacaggatccccacgatcacctcgcagacccgcgactgggcgatgtcccacagctcgccggtttcgctgatatttatcaccggaaaggcgatgatcgccgcggtataacccgccagctgaaaggcataggccacgttattgctgtagtgcgcgcaggcccaggtgcagtagccgatccagcccgccatggcgaataaaaacagccagggatcgttaagggtatgaccggcgatcagcagcgcggccacggccccgagcaggcttccggcgatgcggccaaggcttttgctgatcaccccgccgacggtaggaaagctgacgaccgccgcagaggtcatcgcccagtaaggttcgtcgagattaagcgtataggcgacgctgagcgccagacacatggcgataccattgcgcaggccatagcgccattgcgcacgggtggccttaaaccacggcagcgcctgaagcagccgcaccgtcagcgtccgattgccacggtacaggtggtgccggacaccagcgtcaggccctgcggcggcgcatcgaattcaatgcgcaccggcacccgctgggccagtcgtacccagggcacgttcggtttcacatcggccaccagaccgctgtcgctctccacgctctgatcgtagatggcgcgaccaatactggatacgtgaccctgtaacttttgatcgctgctgtagagcaccacgctggcgggcattccctcgcggatatggcgaagtttggtctcttcgaaatagccgatgacataaaacgagtggctgtccactaccgcgaataccggctgtccggcggtggcgtaattacccacgcgggcggaaagattggtcacccagccgtcaaccggcgaggtgaccgtcgtttgctgttgctgccattgcgcctgcgcaagctcggcctgcgccgccgcgacgtcagcctgcatggctttgacattgatattggcggtatccagatcttcggcggaaatatagttatgaggcagatgtcggcggcggctggcttcgttattggcttttgccagttccgtctgcgcgcgggccagttgcgcttcggcgtttaaaatggcgatgcggtagggcgtgtcgtcgatgcggaacagcacttcgccggcatgcacaaactgattatcccgcaccttcagcgtcgtgatgctgccggacacctgcggtgtaacgctgacctgttcggcgcggatcttgccgtcccgcgtccagggcgactgcatgtaataattccacagccagatcccggcagtgatggcgagggcaagcaccagcagcgtggagaagtattttaaggttttcataacgacgtccacgcaatcaacagagcctgagccagcgccactgaaatcacaaataaagagagatccatcagcagcggatgccagatatcaccggcatagatccagccgcgcagcaggcgatgggcgattagccagagaaagaaaccaagcgcgacggcataaaacaacggcgggaaataaacggatgcgccgacaatcagatcctggaggggcaggccagaggtgatgaatctgagcgtcacgggcagggatcctgtgcaaagtgaagggggtaaacccgggttatacaaaaaagtaacaatagcgtctggttaacaagcttttaaaaacaacactataggaaaatacgctaaagctttacatttgttttaccaatataaatgctgcacactattctaaaatcagtataataacttagcaagctaattataaggagatgaaattggaatcgccattaggttctgatctggcacgtttagtgcgcatctggcgtgctttaattgaccatcgcctcaaacctctggaattaacgcagactcactgggtaacgctgcataatattcaccagttacctcccgagcagtcgcaaattcaactggcaaaagcgatcggcattgaacagccttcgctggtgcgtacgctggatcagctggaagacaaagggcttatatcccgtcagacctgcgccagtgaccgtcgtgcaaaacgtatcaagctcacagagaaagccactcccattatagatgaaatggaaacggtgatcagaaagactcgcggtgaaatactgtcggggatttcggaagaagaattgacgcagcttatcagtcttatcgcccggcttgagcaaaatattattgaattacatacgcgtgattaatgataaaagccctgcatagcagggcttttttattacctggccgcgtatgaattaacgcggagacgccgttacctggccgccgttggttgccagagcgacacgctggcctggcgagaagcgggaattaccctgtttctgcaccacgataatgctgttgccgtcgtctttacggatttccagctctacgccctgggttttgttcatggaaccctgcacgccctgtcccgccacgccaccagcgaccgcgcccgccgccgtagccagtgaacgacctgtgccgccgccgacggtgttacccaggaaaccacccagcaccgcgccgcctaacgcgccgataacgttagaatcatcgccgccctggatctgcaccggacgtacgtttaccacggtaccgtaggtcacactctgtacctgcttggcttcggatgccgtataaacgtctcctgaaaggctatcgttgttcacgcaacctgcaagagtgaaaccaatcagcgaaacggccattacacgtaacatcatttatgaatctcctgtccaacaagaaacgctcaggtgagcatccgtataactaaattatatggcatttagccattgaggacacaacttctgccagctcgcggtaaatattgtacctttggcccgcttaacttcgtctaaacgaaacaagtgtaacgtcaaatgtcccctgacgataacgcctatacacaaaaagacataagacttcatggtattagcggtcactttatggtggagtgttatgtctgttaacttttatccgcacgcaaacaggaaggcgtatgaaatcaggtcgctacattggcgttatgtcgggaaccagcctggacggggtggacgtggtccttgcggccattgatgaccggatggtggcgcagcaggcgagcctgacctggcccattcccgttccgcttaaggaggcgatcctgaacatctgccaggggcagcagcttacgctgtcgcagttcgggcagctggatacgcagctcggcaaactctttgcagaggcggtgcaggcactgatggtccaggagcagctgcgcccggaagatgtggtggcgattggctgtcacggacaaaccgtgtggcacgagccgcaaggggaagcgccgcatacgctgcaaatcggcgacaacaatcaaatcgtcgcccgtaccggcgtgaccgtggtgggcgattttcgccgccgggatatggcgctgggcgggcagggcgcgccgctggtgcccgcctttcatcacgcgttgctcgcgcatcccacagaacgccgcatggtgctgaacattggtggcatcgccaatctctcgttgctgtttccggggcagccggtgcgcggttacgacaccgggccgggcaatatgctgatggatgcctggatctggcggcaaaaaggtaagccctatgataaagacgcacagtgggccagcacaggcaatgtgatcctgccattgctgcaaaatatgcaacgcgatgcctatttttccgcccccgcgccgaaaagcaccgggcgggagtatttcaactacggctggctggaacgccacctggcgcatttcccgggcgtggcgggcgctgatgtgcaggccacgctggtcgagctgacggcgatcaccattgccgaacaggtacaactgagcggtggcgcagagcggctgctggtgtgcggcggcggtggccgtaatccgctgctgatggcgcggctggccgcgctgctgccgggtattgaagtctccaccaccgatgaagcagggatcagtggtgacgacatggaagcgctggccttcgcctggctggcatggcgcaccgtggcgggcttaccgggcaatctgccgtcggtgaccggcgcgtccgccgccagcgtactgggggcgatattcccggcgaatccccgccatccaccccgcacgcgggcataatcagagtttcctgactccgcggcacgcctctggccggtagactggtgcggtaaagcgagagggtgcaaccctctcagaccgggaaagtctatgggacaggtgaatgaaaaaactgttaatcgcatgtgtgccagtgctgctggcaggatgtagtacctataaccagtttgtcgatcgcatgaacaccgatacgctggaatatcagtgtgaagaaaaaccgctgactgtgaagctgaatcatccccgccaggaagtgagttttgtgctggataacaaaccgcttatcctgacgcagggcctgtcggcctccggcgcgcgttacaccgatgggatctacgtgttctggtcgaagggcgacagcgccaccgtgtatcatcgcgatcgcgtggtactggagaactgccagctacaaaacccgcaacgttgagatttccagccgggcggcgcacaatagcgccacccgatcacaacgtagcgaatgccatgtcagaccacgatgaactgcaacatatcgcgcatctgcgccgtgaatacaccaaaggcggtttacgccgcaacgatctccccgctgaaccgatagcgctgtttgagcgctggctgggccaggcctgcgaagcaaaactggccgatcccaccgccatggtggtagccaccgtcgatgaaaacgggcagccttaccagcgcattgtgttgctgaaacactatgacgaaaaaggcttcgtgttttataccaacctcggcagccgcaaggcgcagcatatcgaacgcaatccccgcgtaaacttactttttccctggcatatgcttgagcgtcaggtgatggtcaccggcaaagccgaacgcctgtcgacgctggaagtggtgaagtatttccacagccgcccccgcgacagtcagatcggcgcctgggtttcgcagcagtccacccgcatttccgcccggggcatcctcgaaagcaagtttctggaactgaagcagaaatttcagcagggagaagtgccgctgccgagcttctggggcggtttccgcatcagcatcgagcagatggaattctggcagggcggcgcgcatcgtctgcatgatcgttttttataccagcgggaaaatgacgcctggaaaattgaccgtctcgcgccctgatcgctaaaaatgttgtgttaagcgctggtgctcctgtttccggcgctttattctatgtctcttttcgtaactggcgaaaggccgtgtaccggcagaggtgcagtcgttttaaatggagaatttgatggcaagcagtaacttgattaaacaattgcaagagcggggcctggtcgcccaggtgacggatgaagaggcgttagcctcgctgctggcgcaaggtccgatcgcgctgtattgcggcttcgatcctaccgctgatagcttgcatttggggcatctggttcctttgttatgcctgaaacggttccagcaggccgggcataagccagtcgcgctggtgggcggggcaacgggtctgattggcgatccgagcttcaaagccgccgagcgtaaactcaataccgaagacaccgtgcaggagtgggtggataaaatccgccgccaggttgcgcctttcctcgatttcgactgcggcgacaattccgctatcgcggcgaacaactatgactggttcggcaacatgaacgtgctgaccttcctgcgcgatattggtaaacacttctctgttaaccagatgattaacaaagaagcggtgaaacagcgtctgaaccgcgacgaccagggcatctccttcaccgagttttcctacaacctgttgcagggctacgacttcgcctgtctgaacaaattgcacaatgtctcgctgcaaatcggcggctctgaccagtggggcaacatcacctccggtatcgatctgacgcggcgtatgcatcagaaacaggtattcggtctgaccgttccgctgatcaccaaagctgacggcaccaaattcggtaaaaccgaaggcggcgcggtatggctcgatccgaagaaaaccagtccgtacaaattctaccagttctggatcaacactgccgacgccgatgtctatcgcttcctgaaattcttcacctttatggatctggaagagatcaacgcgctggaagaagaagacaagaacagcggtaaagcgccgcgcgcccagtatgtgctggccgatcaggtgacgcgtctggtgcacggcgaagaagggctggaagcggcaaaacgcatcaccgccagcctgtttaacggcaccctgagcgatctgagcgaagccgatttcgaacagctggcgcaggatggcgtgccgatggtcgagatggaaaaaggcgcggatctgatgcaggcgctggtggattccgggctgcaaccgtcccgcggccaggcgcgtaaaactatcgcctctaatgcggtgaccatcaacggtgaaaaacaggccgatccggaatataccttcaccgacagcgatcgtctgttcgggcgctatacgctgctgcgtcgtggtaagaagaactactgcctggtgtgctggaagtaagtcttaaaggttaaaaagggagtgagaaatcactcccttttttatttgcaggtcgggtaagcgcggcgcgcgcccggcgaaaagttataacccttctgctccctgtgcggcgatcacgctctcacgcgccgccacacgcgccacaaaggcgtcgagatggctcaggctgctcatttccagtttcaccgcccgcgcccagcgcagcacgttatagagatacgcatcggcaatggtgaaatgatcgcctgcaataaattcccgtgacgccagctcgccgtttacgaaggtcagtttcttctccagcaacgcacgcgccactggtttgtactcgtccggcgtatccgggcggaacagcggcgtaaagcctttgtgcagttcggtggcgatatagttcagccactccagcgttttataacgcgacagatcgcccgtcggggccagcagatttttctgcggcgcgctgtccgccagatactgcataatcacgacggattcggtgatcagcgtgccgtcgtccagttgcagcgccggcacctggcctttcgggttaatggcaagataatcgctgccgtcgctgaggcgtttggtcatcagatcgaccgcttccagcgtaaaatccttaccggtttcacgcagaataatatgtggggcaagcgagcaggcgcccggtttatagaacaatttcattgatcactcctgttgttatagaaactcaagtgtacgttaaacctcaaaaaaaaaccgctgacactatgccagcggtttaatttgcgtttcccgaagcgattacgctttcgcgatttccggagcgtcaggttttacatcatcctgcgccatacggttcagtttcggcgccatcagcaccatcagcgcagccatgattgcggtggcgataccaattttcaggaacacgctgccgtagacgttcagggacatcagcggatcggtcaccccttccgggatcgccatcaggttagccacataaccggcgatcaggttagcaccggcggtggtcaggaaccagctacccatgatgaagcccatcagacgttgcggcaccagctgcgccaccattgccagacccagaccggaaatcatcagctcgccgatactctggaaggcgtagctcatgatcagccagttaacggaaacgatacccgcgtcggtagcgaatttagtacccagcggcaggatcaggaaggccgcggagcacagcaccataccaatggcgaacttgtgcggcatcggcaggttgtcgcccatcttgttatagatggccgcaaggattgggctgccaatgatgatccagaacgggttcagcgcctggaactgctccggctcgaaattgatacccagaatggcatgctcaacgttacggatagcgaagaagttcagcgaggtcggcatctggctgtacagcacgaagaacacgatcgcctgcaacatcagaatgaaggcgacgatcattttacgacgtgccgcaccctgcatggagaaggtttctttcgcgaagataacgataatgcccagcgcgacgacgcccagcaccatacgagcgataccctggttatgcaacagccaggtggcgatggtcaccagtacaacgataccgacgatggtcagcagcaggctacccacacgcagcggttcaaagtctggtttagagccatactgtttcacccagcgctggcagaacgcgaagttcaccacggtgatcagcatacccaccacgctcagggcaaaagccacgctccagccgaacttcgcggcaagccacggggtcgccagcatggagaagaaggagccgatatttaccgccatgtaatacatggtgaatgcaccgtccagacgcggatcgtctttcgagtagcaggtggacagcagggaagacgggttcgccttaaacaggccgttacccaccgcaatggtcgccatacccatataaaccaccgccgcgtcgtgaccggaccatgccaccagggcataaccaatcgccagcacaatagcgccgagcataatcacacgcttggtacccagcactttgtctccgagccagccgccgatggcaaccagaccgtacacgagggcgctgaaggaagagaacagcgtaatggaatcagattcggacatacccagttgttttaccaggtagacggccatgatgccttgcagaccgtagaagccgaagcgttcccataattcgatagagaagatcagataaaacgctttcggttgtttgaacgcgttcatacttacgttatctgctggttttttgtttgcagtcgacacatatacctctttttttacaacccatattaacgggggtgttcagtgcgccatgtccagagatcatcgcgcttatagttatagtgggaggggaaaacggcaggtaatgttccctatccggggcttccaggcaatacctttgtaatagtctgttacatataaacagggcgggataaaactcggagcggctaaatgttatttagcgttaaatttcactatggaataaaacatagttttttactctgcgaagggggcggtggtagcgggatatggcgatatattctgccatcgggcgaaaaacttagcgaattagtccagtattacagaattgactggttttatctgttgctggttgaaaaaaagcctctttgatacaaggcgtaactttgccgaaaaatacaatattttaacaaactgaaaaaaatgcatccggcggtgtgggttgtagtaattttttgcgctaaaaaaacattcaggcgcattccgatggaataagcgcctgcggatccgctaagcgcggcgctactcgtagactttttctttatattcgcagagatcttcaatcaggcaggagccgcagcgaggcttgcgggcgatacaggtatagcggccatgcaggatcagccagtgatgacagtccactttaaactcagcgggcaccaccttcagcaggctttcttcaacttgctctacgttcttgccgggcgcgaaacgcgtacgattgcagacccggaaaatatgcgtatccacggcaatggtcggccagccgaaagcggtgttcagcaccacgttcgcggttttacgtccgacgcccggcagtgcttccagcgaggcgcgatcttccggcacttcgccgccgtgcagctcgatcagcatgcggcaggttttgataacgttttccgccttgctgttaaacaggccgatggtcttgatgtacgactttaccccctcgacgcccaactccagcatcgcctgcggcgtattcgccaccgggtagagtctggcggtggctttattgacgctgacatcggtggcctgcgccgacagcaataccgcaatcagcagctcaaagggggagctgaagttaagctcggtggtcggatgcggattgttatcccgcaagcgcgtaaggatttcccttcgtttaacgttgttcattatgccttctctggcgttacgtccggcagcgcgtcggaggttgccaccgccgccgcgcggcgttttttactgcgttcatcaatcaggtatttaaccgccagcatcatgccgaggccaataaaggcgccgggtggcagcatcgccagcaggaaaggggaatcggtgtggaagacttcaatgcgcagcgccttggcccagccacccagcagcgcatccgcgccgtcaaacagggtgccgttaccgaggatttcacgcatcgatcccagcacaaacatcgcgccggttgcgcccatgccgatggcaaagccgtccagcgccgacagcgccgggcctttcttcgccgcaaaagcttctgcccgacccaccacgatacagttggtgacgatcagcggaataaagatccccagcgactggtacaggccaaacgcataggcgttgatcagcatctgcaccacgctcaccacagaggcgataatcatcacgtaaatgggaatacggatctctgacggcgtccagcggcgcaaggcggaaatggacaggttagtcagcgtcagcaccagggtggtggccagccccagtcccagcgcgttggtggcggtagaggtcaccgccagcagcggacacatccccagcagttgcaccagcgcggagttgtttttccacaacccctgaacaataacctctttgacttcgctcatggtttactctccacagcccggtaattggttgagacgggcaggcagcgattgtgcgtagatccccgcccgtttgacggcgttcaccaccgcgcgcggggtgatggttgccccggtaaactgatcgatatcgccgccgtcctttttcactgcccagtgcgcgctgtcctgcggatcgattttgcggcctgcaaaggtcaggatccagtcggaaatgcgcagctcaattttgtcccccagtcccggggtttcatgatgttcggtgacgcgcgccccggtcaccgtaccggaaaaatccgcgccgaccagcagctggatcgcaccggaatagccgtccggcgcggtggcttcaatgacggccgccaccggcgtgtcgtcttttcgggcaatatagacgcgatgctcgcctttgcccagctctggcgcagtaacaaaatagcagctctggctgagatcgttatcataaagcgacgcgggcaccacctgatcgaacagcgctttctgttgcagcgccgcctgatcgtcaatggtcgatttagtcagctggttaatcgcggcggtcatgccggtacagcaggcggcaaagatcgccagcgtcacaccgtgtttttgcatggtctttaacatggtgcgtcctcagcggtgaccgtacacgcgcgggcgcgtgtagtaatcgattaacggaacggtaatattcgccagcagtacggcaaaggccacgccgtcgggatagccgccgaagctgcggatcaaccacaccagcagacccgccagcgcgccaaaaatcagacggcctttattggtggtcgacgcggtcaccggatcggtgagaataaagaacgcgcccagcatggtggccccggagaacagatgcagcgtcggggatgccaggctgtccggcgacagcagccagccaagggtggagcagaaggccagcatggcgataaaactgaccgggatatgccagcggatggttttctgccacagcaggaacaccccgcccgccaggtaagccaggtttacccactgccagcccgcgcctgccagcacgccgctgtaaatcggatagctcaggatctcgtcaactttatgtccggcatgcagggacgttttaaaggtatccagcggcgtcgcctggctgatgccgtcaacgcccatgcgcagggtatccatattgccgccgctggaggtatggccggagaagatcacctggagcgcatccataaagccgggaacggtggcggcaatgtcatgcggcggcagccagctggtcatctgcaccgggaaggagatcaacaacaccacgtagccgaccatcgcagggttaaaggggttatgcccgaggccgccgtaaagttgcttggcgatgatcaccgcgaacaccgtgcccagcaccaccatccaccagggggaaaaagagggaatactgatcgccagcagcaggccggttaacagcgcagaattatccgcaaggatcattttgatgttctgcttgcgtaacttcagcaccagcgcttcggcggccagcgcgctgacgcccgccagtataatttgtatcagcgtaccccagccgaaaaaccagctttgcacggcaatgcccggcagggccgccagcaataccagcatcatgatgcgcgaagtctggcgctggttatgggtatatggggagcttgcgattcgaaaaaccatttaatcctcgttaacggcctgttgtgcggctttcttagcctgaactctggcgatcgccgcagcgacggccgctttacgcggatcgtcattggccgccggagtatcggtgaccggctgctgggctttacgtgctttagcgcgggcaatagccgcttccaccgcggctttgcgcggatcgatgacctcgtccggcgcgggtggaattttcggcggtggcgcttctgccgcctgctgctgcgctttacgggctttggcgcgggcaatagctgcttccaccgccgctttacggggatcaacatcgccaaccggttcagagggcgctgccggctcaggggcttcagcgctctgctgcgctttacgggctttggcgcgggcaatggccgcttctaccgcggctttacgtggatcggcgtccggcgcgttaacggccgccgcctgctgtgctttctctgcctgacgggcgcgcgcttcggctttgcgggcttcgcgggcggcgatgacctcgctgttatccggtacggcgcctgcctgcaccaccaccggctgggtggcgttctgttttttctcgcgcacgcgggcaagcgccgcgtcgatggcagcctgatctttcgccgcaggctgtaccgccgcctgtttgtggcgggcgagacgggcttctttttcacgctcaagacgcgcctgacgcgcttcaaagcgcatcttcgcttccgcggcgcgtttttcttcctgcgcgatggcgtagatttcggctttttcctgacggaaatactgcaccagcggaatattgctcggacacacccaggcacaggcgccgcactcgatgcagtcggaaaggttatgcgcagtggctttgtcgtgttgctggcctttactgaaccagtagagctgctgcggcagcaagtcggcaggacaggcgtccgcacaggcgctgcaacggatacagcctttctcttcctgcggctcgcccatttcagtggcggacggggccagcaggcagttagtgattttcaccaccggcacgtcgagccacggcagggtaaagcccatcagtggaccgcccatgattaccatctgttcgccaccggggcaaaaacctgcggcgtcaagcagatgacggatcggcgtgcccagacgcgcccagacgttgcccggctgttttaccgcttcaccggtcagcgtcaccacgcgttcggtcaggggttcgccatccaccacggcgcgttttaccgcataggcggtgccgacgttctgcatcagcacgccgatatcggacgaacgcccgccgtgcggcacctgtttgccggtgaggatctgcgtcagctgtttcgcgccgcccgacgggtatttggtcgggatgacgcgcagcgtaatgtcgtgcgatcctgccagcaccgcccgcagcatggagatcgcctggggtttgttatcttcaatgccaatcagcacctggcgcggctgcaaaatatgcgcaaggatgcgaatgccttccaccacctgtgccgcgcaatcctgcatcagacggtcatcggcggtgatgtacggctcgcactcggcggcgttaatgatcagcgtgtcgattttatcgctgccgccatgcagtttgttaccggtcgggaagcccgcgccgccaagaccagcgacgcccgcctggtgaatacgctcaatcagcgcctcgcggctgcgggagcggtaatcactccagccgtcgcgctcgatccattgatcctcgccgtcggcgtcaatgagcacgctcagttccgccagtccagacggatgcgccgtggagtggggggcaatggccaccaccacgccggaggttggcgcatgtaccggcagcatacggccgcgcccgcgggtcagcggctgaccgcgcaatacgcgatcgcctgcacgcacgcacagctcaccctcagcgccgatatgctgcttgagaggaatgacaaaacgtgaggccagcggcagctgacgcagcggcgtgccgttggactgggtcttcatttccggcggatgaataccgccgtggaagtcccacagtttatcttttcggaaagccgagaataacttaagcatgttgttccacagaaatgatgcgcaccgggatcgtctgcaaatcccatttccagctgtcaggggtagcggccaccggacgcagctcaatgcactgtgtcgggcagggatcgacgcacagattacaaccggtgcacaggtcgctcatcaccgtatgcatggcgcgggtcgcgccgacgatggcatcgaccgggcaggcctgaatgcatttggtgcagccaatacagttaggttcgtcgatcaccgccagcatacgcaccggctctgccgcgacctcttcgtcgtccactggttgcggatccacatttagcagcgtggcgattttcagcatcacggcttcgccgccaggggcgcagcggttaattttttcaccctgcacgcccaccgcctcagcataagggcggcagccagggtagccgcactgaccgcactgactctgcggcagcagttcgtcaatgcgttcgacaacgggatcgtcctccaccgcgaaacggcgggaggcgtaaccgagaatgacgccaaagatcagcccgagaacgctcagggcggcaatggcaatccagatcgcgctcattacaacttcaccagaccactaaagcccataaaggccagagacattaaacctgcggtgatcagcgcaatggcgttaccgcggaagggggcgggcacatccgccaccaccagacgctcacggatcgccgcaaacagcaccatcaccagtgaaaagcccaccgccgcggcaaagccgtacagcgcggactgcataaaattgtgcccaaggttgatattgagcaacgccacgcccagcaccgcgcaattggtagtgataagcggcagaaaaatgcccagcaggcgatagagcgccgggctggttttacgtactaccatctccgtaaactgcaccaccacggcgataatcagaatgaaggccagcgtacgcagatagatcagatccagcggaataagcacccaggtgtcgataatccatgcgcacacggaggccatcgtcattacaaaggtggttgccagtcccatccccatggcggattccagttttttggacacccccataaacgggcagaggccaagaaacttcaccagcacaaagttattgaccagaacggttccgacaaacagcagtaagtaatcagtcattattcgccctgaaagaataaaccgcccattatcggataatccgcaacgggcgacaacagcataactgtagggttattacgggttaacaaaggtctttttgaccctgccggagcgcttaaaatagggcaccagcaacgccgccgccatcagcggaaacagcagctggcgcagcgccagttcatccgataccggggaaaaggcaaaggcttttaccgccagcagcaccgaaatcagcagccagataatatagtgctttggcaccatccggcggcgtttgaaaaaggcaatggtcagccacagggtgtaataccacatgcccacagcaaacagcagggtggcaaaccacatcaccatagacatcatgccctgggcgtgcagcgtggtgaacgtccggggcgacatcagcgccgaagtatagagcagaagcgccagcgacgtgctcagcagcgccaccagcagccatgccaggggggcgagtaaccagcctccgattcgttctgcgggcgttgcggtcatggattattcacctttagtctgtacgcgtaatttgccgggcgaagattataaagcattgccgggggaatactactggcattattaccggtaacacccggacgcagcgggtaataatacgcgacctggcgaaacagatttgtccgtcaatgcggtggcgggggagttaaggtggttcttaaggggtaaaaagcaggcactggaaagtgcctgcggtaaattaacgctgcgcgccgcgactggcaattaactgctgataccagaagaaactttttttacgtttacgcgccagattattgtcatgatcgacatagacaaaaccgtactgttttttataaccgttaagccagctcagcaaatcaataaatgaccagggataatagccgcgcacgtccgcaccctgcgccatggcgtcagccatcgcatccacatgcatgcgcagataatcaatgcgcgggtcgtcaacaacttccccgtcaataatgggatctttcgcgcccaagccattttcggtgatgtagatgggaatatcaccgtaacgggctttgatttgcataatgccgtcggtcagtccctgcggccagatttcccagtcccagtcggtataaacgccgtccggattacgcacgaatttaaacaggcctttaaagccgaattcatgaccgctgttgctctcgccggaatgattcgcctgggtatgggtttcgtgcggattggaaactaccgtttcacgacgataataattcaggccgataaagtcgcagcgattctcccgcagtaagcgatcgtcgtccggggcgaaccgcggcaccccccagcgctgctgcgcggcagccagtaatgccgccggatattcgcctttcagcaccggatcgtaaaaccagtgggtataaatggcatccgccagatcagccgccgccacgtcttccggcaggcgggtgagcggggtgtgcggttgcagtacgttcacaaaaccgatttcacctgcgatgccggactgacgaaaggcttttaccgccagcgcatgggcgataaagacatgatgacaggcctgaatggcccgcgccggatcggtaacggagggcggatggctgccggtgatatagccgtgaccgatgaatacgatggtttcgttgaaggtggcccacaggcggacgcgggagccgaagcggtcgtagcacaggcgggcgtactcctcaaaagcgtccgccgtagagcgcgcttcccagccgccttcgtcctgcagtgcctgcggcaaatcccagtgataaagggtcaccataggcacaatattgtgcgccagcagggcgtcgatcagatcgctgtagaacttcacgcccgcttcattcacctcgccgcggccctgcggcagcaggcgcggccatgaaatcgaaaaccggtagctttgcagccccatttccgccatcagcgcgacgtcttcctgcatgcggtgataatggtcaacggcgacatcgccgttcgtgtcctgccaggtggcgccgggaatatgcgaaaacacatcccagatcgacgggcctttgccatcggcatcatgtccgccttcaacctgatacgccgcagtcgcggcaccccataaaaattcttccggaaacgcagccatcgtgtgctccttacagttccatgacgttaaggcacgttacacgcgatgcgtttatcaccgcaaccggtttcagaaaccggttaccggaatgggagggcagtcacttttaacccggcggggagggcgttattttgcctgtacgtgggcggcgggctccggtggctgataatcatcaatatggctggcaacgcctaataaaatggcgctgacgcccagcacgatccaaccggcaagttcaataatgcgggtcactactccgttcataatgcagacttctcctgtttacctgagggcgaatagtagcggggcgtgattattcgggcaagtctccgtcggtattcagggtattttcaggattttctgaaatcagcgcccccgatgacgctctgtttgaggaagacagggtgaccatcgccacgtatgattaataaagcgaaaacacattcctccactgacgagaggcagctttatgagtgacaagatccgtgtcggattaattggctatggctatgccagcaaaaccttccatgcgccgctaatcgacggcacacctggcatggagctggcggcgatctccagcagtgatgaaaacaaagtccatgccgactggccgaacgtgccggtggtgtcggagccaaagcatttatttaatgatccttcgctggatttgattgtcatccccacgcctaacgatacccatttcccgctggcgaaagcggcgctggaagccggtaaacatgtggtggtggataagccgtttaccgtgacactgtcacaggcacgcgagctggatgcgctggccaaaacccttggccgcgtgctgtcggtattccacaaccgccgctgggacagcgatttcctgacgctgaaagcgctggtggcggaaggcgcgctgggggaagtgacctattttgaatcgcacttcgaccgttaccggccggaagtgcgtaaccgctggcgagaaatggccgggccgggcagcggcatctggtacgatttagggccacatctgctcgatcaggcggtcaacctgtttggcctgccggtggggatgaacgtcgatctggcgcaattacgtcccggcgcgcaggctaccgactatttccatgcggtgctcacctatccgcagcggcgcgtggtgctgcacggcacgctgctggcggcggcagaatcggcgcgctatatcgtgcacggcacccggggcagctatgtgaagtttggcctcgatccgcaggaagaacggctgaaaaacggcgaacgtctgccgcaggaagactggggttatgacatgcgcgacggcgtgctgacccgtgccgaaggcgacgagcgggtagaggaaagctggctgaccattccgggcaactatccggcctattatgccgggatccgcgatgcgctgaacggtgacggggaaaacccggtgcccgccagccaggcgatccagatcatggagctgatcgagctgggcatggaatcggcaaaacatcgatcgacgctttgcctgtcgtcatgaagaagcccggcatttgccgggctttttttatgcgcggatgaggctgtcgcgcagcgcctgtttttcagcggcgctcaggaaggcgatctccagaccgttgatctgcgcctggcggatctgctcgcggcttaaaccggcctgcggcgccgcgacctgatactcatgaataatatccacgccctgtaccgccggatcgtcggtattcagcgtggccagcacgccgtgctcaaggaaggttttcagcgggtgcgcggaaagggacgccaccgtgctggtctgaatattagaggtcaggcaggattcaatgccgatgcgctgctccgcgaggaaatccatcagcgcaggatcttcaatagccttcacgccgtggccgatacgctcggcgcccagctcacggatcgcctgccagatgctctccgggcccgccgcttcaccggcgtgaacggtaatacgccagcccgcgtcacgcgcgcggttgaagtgggagaggaacaggctgccggggaagcccagctcgtcgcccgccagatccagcgcggtaatgctgtcgcggtgcgccagcaatgcctccagctcttcaaggcaggccgcttcgccgaaggtgcggctcataatgccgatcagacgcgcctgcacgttgaacgcgctgctcccctggcgcaccccttcgattaccgcttccaccacgcccgccaccggcaggttatgggtcatcgccatatagcccggtgaaaaacgcagttcaacatagtgcaggccattacgcgccgcatcttccatattctcaaacgccacacgacggcaggcgtccagcgaggccagcactttcacgccccagtcgagtttagacaggaagctgaccagatccggttcgttggaggtcacctgcacgtgcggacgcagggtatcaagggtatcagcgggcagagagagattaaactggcggccaagatcgaggatggtctgggcgcgaatattgccatcaaggtggcggtgaatgtcggtcaatggaatagtggaatcaatcatgctgcactctttttagatgttttaggtaaagtgcagagcattataaaaataaatcggggtaaaaagctatgttgcgcaagcaataagttggttgcgcaacacaaaatcacaaaagtgcctgaattccggctattaaccggctaacaccctgttccagcttgatgcgcggacaaccggcgttcagacgcacaaaaccgcggcccgcgtcgccataggtcaggcccggcataatggcgaccttctggttttcaatcagctcctgctgcaaaagtgcatcatcgatacccagcggccgcaggtctatccaggccagataagtcgactgcggcggctgccagttaagggcagggaaggcggcgttcagctccgccgctacaaagtccaggtttgccgccagatatgcccgcaacgcatccagccagggcgcgccctcgcgataggcggcaatatgcgcatggatcgccagcaccgacggtgatgatagcccgtcgcggctcttcagcgccgtcagataacgtgaccgtgtcacgttatcttcaataatgccatatgcgccggtcagcgccgggatattaaagcttttcgacgccgaggtaagcagcgcccagggaccctgagcgacacggctccagggtatatgacggtgcgctccccaggtcatatccatatggatctcatcgctgatcaccctcacaccgtggcgggcgcacagcgccgccatggtttccagttcatcctgcgtccagaccttcccggtcgggttttgcgggctgcacagcagcaggattttgttttcttcctgcgcgagcaccgcttccagcacggccatatcgcagtaccagtcgccgttatgttgcaggggcaccggcacgacgcggcgatcgttgccctcgatcaccttgtagaacgcgtcataggccggggtatgcaccaccaccccgtcaccgggggcagaccacaggcggatcagttcggcgaccatgtagatcaccgacgggccatagaccagcgcattgtccggcagcggggcgttaaagcgcgtactgaaccagtgctgcacggcgctgataaattcctcgttgttccagcggctgtaacctaatacgccatgggccagccgcgcctgtaacgcctcaatcacacagggcgccgtggcaaaatccatatccgagatggtgaacggcagcaggtcggcgtgaccaaaacggtctgccacataatcccactgggtacaccaggtgccgtggcgatccacgacggttgagaaatcaaacatctcgctatccttatgcttcaacggtattcatcagtgacaccagctcatctttgaccgactgaacctgcgggccaatgaccacctgaagattatgctcgtttaatttcaccactccaatcgcccgcagtgctttcagcgcgtcggtatccacttttgacatgtccgccaccgacaggcgcaggcgagtaatgcagttatcaatggtcaccagattctccgcgccgcccagcgccgccagaatagccgggacgttatagcccgatttcccggcgctgcccgcaaaacgtttttcaagctggctgctgatctctgcctcgcgacccggcgttttcaggttaaagcgggtaatggcgaagcggaaaatggcgtagtaggttacaaaccagaccgctgcgaccaccggcaccatgtaccatttggtcgccagaccgtgcaggatgccgaacaccacaaagtcgatcaggttgccgtcggtgttgccgatggtcacgcccagcaccgccatcatggtaaagcccagacccgtgagcagggcgtggatcacatacagcaccggcgcgacgaacaggaacaggaactccagcggctcggtggtgccgccaatcacgcaggcgaccacgccggaaatgagcaggcctttgattttatgacgattctccggacgggcgcagtgatacatcgccagcgccgcccctggtaagccgccgaggaaggcaggcattttaccctgcgacagaaaacgcgtggcgctctcggcaaagccgtgggaagtggggcagtttaactgcgcctggaagatggttaacgcaccgctgacggtgttgccgcagacgtcgagcgtaccgcctgcttcactgaagcggatcagcgccaccagaatatggtgcaggccaaagggcagcagcagacgctcgccggtgccgaaaatcatcggcccaaaatccccggcgctgttgatcatctgcccaaggccgttgatgcccatggcgaaaaacggccagatgagcggaatacacagccccaccagccccatcactacggtggtaatgatcggcacaaaacgcgtgccgccgaaaaacgccagcgcgtccggcaggcgcacggtatggaaacgttcatgcagcagccagaccaccacccctgcgatcaccgcgcccagaatgccggtatcaatggactggatgccgaggatgttctgcacgttgttggctttcagaatggcggcgtccgtggtgggcagaatgcctttcgcggtcagccagaagttaaccgccaggttcatgaccgcataaccgacgaaaccggcgaaggccgccacgcctttgttttcacgcgccagccccagcgggatggcgatacagaacatcaccggcaggaagctgaacgcaaaagaaccaactttccccatccagatgaaaatcgcctgtaacaccggattttcaagcgccggtaacagcgtcaccacatcatggctgctcagcgagctgccgatgcccatcatgatcccgcagaaagagagcagggccaccggcaacataaaggttttccctaactgctggaaaaactcccacagcgtaatttttggtgcagttttaacaggcatgaacgattccttgtctggaaaagtggattcagtggccagaagataaaacgttttatcaaattttagtgcgacaaatatcacatagtaagcgtataaattgcggtaaaaagggtaatggtaaaaaaacgttttaccagaatcattagcagggatacctcgccgggatgacgaataaaaaaatcaccattaatgatgtcgcgctgcacgctggcgtatcggtcagcaccgtatcgctggtgctcagcggtaaagggcgcatttcgccctccaccgggcaaaaagtgaatgcggcggtagagcagctgggttttgtgaggaaccgtcaggcagcgctgctgcgcggcggcaaaaccggcgtcgttgggcttattgtcagccacttttcagatcctttttatgctcaactgacggcggggttaacaagcgtgctcgaagcgcagggcaaaatggtgtttcttacccagggaggacggcagggggagcatctgctgtcccgcatcgacacgctgatggcgcagggggtggacggcatagtgatcgccggtggcgtcagtaataccgctgaaattaacgcccgtgctgacgggctgccggtagtgttcgcttcccgcgccagctatctcgatgacgccgatattattcgcccggacaatatgcaggcggcacaaatgctgaccgaacattttattcgcggcggccatcagcgcattgcctggctcgggggcaacagttcgtcgctcacccgtgcggaacgcgtcggcggctactgcgccaccttgctgaagtacggcctgccgtttcacaatgaatgggtggtggagtgtgaaaccagccagaaacacgccgccgaagccattggcgcgctgctgcgccacaatccgaccatcagcgcggtgatgtgctacaacagcaccatcgccatgggggcgtggtttggcctgatgcgcgccgggcggcagagcggttttgagagcgtcggcaacgtgtttgatcagcagatcgcgctggcggcctttgcggatgtgccggaaagccggctggatgatgtgcctatagcctggtcactgaccccggcgcaggagatcggctgcgcgctggcggagcggatcatgcagcgcatcgacaaaaaggatgcccacacgcaggagcagatcatgccttcacggctggtgaaggtgagataaaacggggataaacaggggaaaacggcaccttactttgcggagatatccgcatttcaggtgcagcttatcgttactgctgaggcaccgcaggcacggccggggcaaccggcggctgaggcgctggcgctggcaggccgagatccggcataccgaacatgccgacaaactcatccagcggcattttctgaccgttcagcgtcacctgaccattagcgtactgcaggctggtggagatcacgttgttatccagcgtggtgatgcggaacatctggcccatcgccgccaggcctttcacctgctgggcggccagcttgctggcgtcagcatcctgataaccttccagttttgccacctgggtcataaactccgtcgccatatccaccgggatggtcagcttgctgtcgagggatttcacgctgcgatccacttcctgcgccagggtttgcggctcgccggtggcggtggccggatcttttaagaacagcgacaggttaaaggcggtttcacctttgtcgtttttccagctcagcggcgcaacggtgatcaccggctcgcctttcagcagcagcggcagggaagagaagaaggcttccgtggctttctgttgatacagttccgggttctgcaccacgtccggctgcgccatcagcgctttggtctgcgcgttatattgctggctgaactgatgccatgcctggccgtcaatctgaccgactttcagcgtcagtttgccgctgcccatattccggttctgaattttcaggctgttgagggtgtaatcaatctggctgttgacggttttgttgtctttcgccacatcggtcttcgccgtcagatccatgccttccagcaccgccatctctttgttttccaccgagatagccagcttttccagcgacagtttctgatcgccgatacgctcgttgaagctggcgcgtttgctgttgccttcgctcttcagattgttaaaggtaacctgcaccttctggccgtattcgttgaccgcgtccaccagaccgcttgccgcttcgccggtcagcgacacttcgttgccatcacgatcggcctcaagtttgaaatccccgccgctgaaggcgactttctcaccctctttttcatagttaagcggcttcagggcgatgtcagaacgggtatcgccgccgtagccaatgcgcgtgtccaccacaaacggcgactcgcctttggccatatcaaacagcggctttgagacgttattattcaccagcgtcgacttcacggacgccatcgccgggatcagattgaaatgtttaagctgcgcaaaggggaaggggccgtgatccacggactcgttcaacaccacgctttcgcccggtttcagccagacgttctcgctgccggcgacgggtttgatcaccagttgcaaatggctgctgaagacgccgcgctgatagctctgataagccagttccacgcccgcttccggcgcgctgtttttaatttctgcgttagcctgattcaccatatctgcgatacggccttcaagctgtttacccgtgtaccaggctgcacctgtccagatagcacccagtgcaacaataactcccgcggcgaccagcgtttttttcataatgattatccataaaaatgaaaccaggcggctcaggccgcctggacgatcgtaaagtcttgctaagcttagcaatacccgcctgttacgtcagtaacttagttaaccttattgtagactctcgccacgcggccaacaccactgacggcgaccggtgactcatcggcgcggatcaccgccgactcgcccggtttcagcgtcaggcgctcgtcgcctttactaagcagggcttcgccttccacgcagaacacaatcgcggcgctgtgctgggcaagcgccgtttcctgggaggataaatcgtgcagcgagaacgcaaaatcctccaccgggatcgggaattccagcgtactgccgtctttttgcggctgcgttagcagttcagcggctggcttcggcgtgaatttgacgtttgccaccagttccggaatatcgatgtatttcggcgtcagtccggcgcgcagcacgttgtcggagtttgccattacttccagcgccacgccctgcaggtaagcgtgcggggtttcggcgaacaggaacatggcttcgcccggttccagtttcaccacgttaagcagcagcggcgagaacaggccgctgtcgtccggatagaactgcttaataacgcggatggtctcccacggctctccctgctggctggtgagcgtggcgctgagcaccgccagcgcgcgggatttctcttcgccctgcatgttgagcaggctggcgaacagctggcttaagctctctgcgtcaggcttttccaggaaatgagcgatggaggtatgcgcacccgccaccggctgcaatagcgagacaatctcggagaactcgcggaatgcgttcatcgcgaggaacggcgtcagggcaaagaccagctccggtttatggttcggatctttgtagttacgctctgcggcatccagcggaatgcctgcggcattttccttcgcaaaaccggcttcagacgcctgcttgttagggtgcacctggatggaaagcggttgatcggcacacagcactttaaacaggaacggcagttcgccaaaacggttggcaaccgcctcgcccagccagcgggttttatcctgatcgatcagatcgcgcagcacctgaacggaaccgttcgcgtcctgcacttttgagctgctcttcgggtgcgcgcccatccacagttccgccatcggcaactgctgtgggttggcaattccgtagagatccgttaacgcacttttacttccccaggcatagttttgcactgagttgatgagtttttgcattatcaagccctgtagtttcgttaaagagtttgcgggtattaaagcaataaacatcagggaagtaaccactgcatgcaaaaagtcgtactagtctcagtttttgttaaaaaattgtgtaggataaagcgactcgcttttaagcagggcaatggaacatctgcccgaaccataaccagaccgtgcagtcagtgagagaacaatgtcgaataaacccttccagtatcaggatccttttccgctgaacaaggaccagaccgaatattatctgttgagcagtgaccacgtctccgtcgccgaattcgaaggacaggagatcctcaaagtcgatccccaggcgctgaccttgctggcgcaacatgctttccacgacgcctcctttatgctgcgcccggcgcatcagcagcaggtcgccgatattctggccgacccggacgccagcgagaacgacaaatatgtcgcgctgcaattcctgcgtaactccgaaattgccgccaaaggcattctgcccacctgccaggacaccggcacggcgatcatcatgggcaagaaaggtcagcgcgtgtggaccggcggcggcgatgaagcggcgctggcgcgcggcgtctacaacacctatatcgaagacaacctgcgctattcgcaaaacgcggcgctggatatgtacaaagaggtgaacaccggcaccaacctgccggcgcagatcgacctctacagcgtggacggcgacgagtacaaattcctgtgcatcgccaagggcggcggctcggccaacaaaacctatctctatcaggaaaccaaagcgctgctgacgccgggcagactgaaggattacctggtggataagatgcgcaccctgggtaccgcggcctgcccgccgtaccatatcgctttcgtcatcggcggcacctcggcggaagcgacgctgaaaacggtgaagctggcctccaccaaatattatgacgagctggcgacgacggggaacgagctgggccaggcgttccgcgacatcgaactggaaaacgagctgctgcgcgcggcgcaggatctcggcctcggcgcacagttcggcggcaaatatttcgcccacgatattcgcgtcgtacgcctgccgcgtcacggcgcttcctgcccggtaggtatgggcgtttcctgctccgctgaccgtaatatcaaagcgaagatcaaccgccacggcgtgtggctggaaaaactggagaacaatccgggcaaatacattccacaggcactgcgccaggccggggaaggtgaagcgatcaaagtggatcttaaccgcccgatggcggagattttacgccagctgtcgcagtatccggtgtccacccgcctgtcactgagcggcaccattatcgtcgcccgcgatattgcccatgcgaagttaaaagagcgtatggatcgcggcgaaggcctgccgcagtacgtgaaagatcacccgatctattacgcaggcccggccaaaacgccggaaggctacgcctccggctccctcggcccgaccaccgccggacgcatggactcctatgtggatcagcttcagtcgcagggcggcagcatgatcatgctggcaaaaggcaaccgcagccagcaggtgacggatgcctgtcacaagcacggcggtttctatttaggcagcatcggcggtccggcggcggtactggcgcagagcagcatcaaaagtctggaatgcgtggagtacccggaactggggatggaagccatctggaaaatcgaagtggaagatttcccggcgttcatcctcgtggatgacaagggcaacgatttcttcgctcagatccagtcctccgcctgcgcgcgctgcgtgaaataaacccttttcgtccggcaacgcagctcgtcgccggacgtttttttgcaacattttctatcgtgccacgcaacttcagtaatacttacaacttcgtttgcaggtgagcaatgtcggcaacccacatcacttggtatccagggagaaagtatgacttcgcatcgcagtgaaaaagattcgatgggcgccatcgacgttccggcagataaattatggggcgcgcaaacccaacggtcgctggagcattttcgcatctcgacggaaaaaatgccggaggcgctgatccgcgcgctggcgctgaccaaacgtgccgccgctaaggtaaatcaggatctggggctgctgcccgaagaaaaagcccgcgccattatcagcgccgccgatgaggtgctggcgggtaagcatcctgatgagttcccgctggccatctggcagaccggctccggcacccagagcaacatgaacatgaacgaagtgctggcgaaccgcgccagcgagctgctggggggcgtgcgcggtatggagcgcaaagttcacccgaatgacgacgttaataaaagccagagctcgaacgatgttttccccacggcgatgcacgtcgctgccgtgatagccatccgcgaacagctgctcccgtcgctgaacgaactcaaaaccacgctcagcgaaaaatcccgcgcctttgcggatatcgtcaaaatcggccgtacccatttgcaggacgccacgccgctgacgctggggcaggagatctccggctgggtggcgatgctggagcataatctcaaacatattgagcacagcctgccgcatctcagcgagctggcgctgggcggcacggcggtgggcaccggcctgaatacccatccggaatacgccgtgcgcgtggcggaagagctggccgccaccaccgggcaggcgtttgtcaccgcgccgaataaatttgaagccctcgccacctgcgacgcgctggtgcatacccacggcgcgctgaaagggctggcggcctcaatgatgaaaatcgccaacgatgtgcgctggctggcctccggcccgcgctgcggcatcggcgagatcgccattccggaaaacgagccgggcagttccattatgccgggcaaagtgaacccgacgcagtgcgaagccatgaccatgctgtgctgtcaggtgctgggcaacgacgtggcggtgaacatgggcggcgcgtccggtaactttgagctgaacgtcttccgcccgatggtcattcataacgtgctgcaatcggtgcgtctgctggcggacggcatggagagctttaacgaacactgcgccaccggtatcgaaccggtgcgcagccgtatcgatcagctgctcaacgagtcactgatgctggtgacggcgctgaacacccacatcggctatgacaaggcagcggaaatcgccaagaaagcgcataaagaagggctgacgctgaaagacgctgccctggcgctgggctatctcaccgctgaagagttcgacagctgggtgcggcctgaatccatggtcggcagcatgaagccgggccactaaccggcaacaaagaggtgcagccggggaataatcggcgttaacggctgcgcctcaggcttataacgatgctgaatattgtcagcatcgtaattcagcagttccccgatatccggcgcccggccgccgttttccgcatcaatcagcgcaatcatcggcgcggggcaggcgtactgcacctgctttttggtgtccgcataccagacgcgggcaatgggctgcaccttcaccggccgtttgattttcagtttcgcccgttgcggcagggcggcaatatcgttgtactcctgctccagccgcgtctgccactgttcacgcgtccagccgcccaccgcgcggggggctttcaggcttttcgccagcatcgccagcacctcatcccgggtcagattcttaatgatgtgtttgttcgcccagccaaagcgcagcgtcgccggatcgcgcagggtggtcagcgagcgataggcgttaagggtaatcagccccggcaggtggtggtgcacccattcaaagcgcgcggcgggaggaagttcagattccacggtgataatgcgctcaaaagcctgcttcaggtcattgatggtggcgatgcgcgcttcgatggcgtcgcgcagcccgggagccgtttgcaggcaaattacgccgggcagccgcacggcggctttgctgctgcgcttttctgactgctgctggataaacagatgcgtgaagtggcgcagcgcccgttcagccgcttccttgccgatatgctgcttcacggtgatggtggtcaggggatcgtgctcgctgcctttttccactgccggcaactcaaagacgcggcctgccagcagccgacaggcggcgagttcggttttcagctccgccagttgctgctcaagctggcgaaaagtgctggtgaggcgttcgatcaggtcgtagcgcgccatagcttactccttagttacaacatactttatgtatagcacagccggaccgctccggccaccgcgattaacggtccggcaggacgggaagggcgaccagttgtgtaactggccagcgaaaacgaaagcgcgcgccgccggtatcgctggcgtcacagctcacttcaccgcccatcgcctgtgcgatcgagtgcacaatcgccagccccagtccgcagccgccggtggcgcgatcccggctgggatcaagacgcacaaaaggctcaaacacccgctggcgttccgcttcggcgatgccggggccgtcgtcgtcaacctgtaaacaggcatagctgccgtccagatccaggctgacgctcacctcgttttcacaatagcgcagcgcgttattgagcaggttatccagcacccgttccatcaggcgcatgtccagcgcgccaaagtgcgcagcgctgtcggcataaacccgcagacgtttgtcgggggttacgctctgcacgtcggcgatatggctggtcagccaggcgggcagatccggcgtcgtcagccgcagttcattttgcggccggtcgaggcgggcataggtgagcaattcttcgatcagtccttccagctggccgatatcacggttcagcgccgctcgttccggctcgctgaggttatcgctcatttccagacggtaacgcaggcgcaccagcggcgtgcgcagttcatgggcgatgccgtctatcagctgtttcttgctggcgatgagagcgttaatgttatccgccatctgattaaaagccacgccgagccgctcaaagcttgagccacggtcaaagtggatgcgctcggtcagatgcccgtcgccaaaacgctgcgccgccgattcgatacgcagcatctcctgccagtgcgggcgcatccagataaagacagggaatgcgagcgaaatcgcgataaacaccagcagcgtgatgtcgagaatgcgcatctcatgcagataaaacagataaggcaccggcccgaccgccagcacatagtggctgcggggaatgcgctggataaaggtgtactccgcgtccagcgccacaatgtcgccttcccgcagccgctgcgccgttggcgcgtcaaggctgaacttattcagcggttcaatacgcatatcgaatgaaagattaagatccatctctttaagggttttgctccactcgtggggcgggatctcgcgcagctcgctgcggatgaggtacagcgagcttttcatcagatcgtcaagcgactgtcggcccgcacgctcggcggtgaatttgtacaccaggccgaccagcatggtcatcaccagaaaacagacgaacagcagcaggtaaaactgcacaaacagctttttcattcagacacctgtgattgtggcgacactcagttttcccaggcgtggggcgcgaacagatagcccttgttgcgcaccgttttaatgcggtagggctcggtggcgttatcaagcagttttttgcgtaagcgtgaaatggccacgtcaacgctgcgatccatcccgtcgtagctgacgccgcgcagattctttagcagcgcgtcccggtccataatctgcccggcatgggtcgccagctcccacagcagatcaaaatccgccgtcgagaggacaatttcatccccggccagcagcacctggcgattaaccggatcgatggacaaactgccaaagcgcaaggctttgtgcggcgttaaggtattttgctgcgccgcgggcgtggtgttcgcggcatgctggcgcaggtgcaatcgcagacgggccagcagcacggcgggcggggtggttttcaggatgtaatcgctggcgcccatttccagcgacaaaatatggttcatgtcgctgtcaagagaggtcagcagcacgatgggtccctgccactggctgcgcagatcgcggcacagcgtcatgccgtctttaccgggcagcatgatgtccagcagcaccagttcagggttctcgcgcaggatcaccgcttcggcgcagtcgccgcgcggctcgacaatcacgtcgatgtcgtgtttaccaagatacgccgcgatcagcgcgccgacttccgggtcgtcttctacaaaaacgatcttattcatatgcatgatggttagctaaaaacgccaacatacaccgccttgtttcaacccgccatcactctttcgttaccggagcggacgaccgccgtcgatggcgaaactgcgaccggtgacataacaactggtgagcagataatccaccagatcgataacctctttttcaccgggggcgattttcatcagcgacttattcagtgccttctgacgatagctggcgtcgtcgtgctcgttgaataaaatcagcgacggggcgatggcattgactttcacttccggcgcgagcttgcgggcaaaggagcgcgtcatgttatccagcgccgctttactggcggcgtaggcgatatgcttatcactgccgcgctccaccacgtaatcggtgaaatggataatgtcggtggatgcatgaccctgaccgcgcagtagaccttccagcgcatgattaagcaggtaaggggcgtggacatggatttgcagcatggcggacagcacctcggtaagaggcgtgccgggcttttccggcagccagccgctggcgttgtggatcaccgcgcgcagacaacgggtacgggatttgatctcctcggcaaattttaatattccgtcatcggaacaaaaatccgcctggatgcagaccgcgccttcttcctgcaacacatcgatagccgggtaaggggtgcgatagctgacgatcaccggctggtgcaggttgagaaaatggtgggcgagggcgaggccgatacggcggcctccgccggtaattaaaatgggattgggttgatctttacccatcgctatctccttatcgttaagacgatgggcgcagcatttatcccatcagcatccaggtcgccggaaccgctgcaagcagcagacaggcaatcatcacatgttcggcgcggcgcagcggtttatcatgctggtgggtacggcgggcatagataaacaccagcaggccgggcgcataaagcaccaccgacagcagcagatgcatcgggccggaggcatataataaccataaaccatacaggcaggatccgacacccacgaccttatgcagtggacggctggcgattttcagcaaatacgccccgacgaggaaatagggcacgaggatcatttcggaggcgatggtcaacagcgtgttgtaatcggatccggtcagccagataaggatcagacacacctggacgctggcgttggtcagccacagcgaagcagaaggcgcgctgtttttattctgacgggcgcagatacgcgggaaggctttgtaggtggcggccagcagcggcacttccgccgccatgatcgtccagctcagataggccccgcaaacggagacaaccagaccggcggcgataataatttcgccccaggaacccatcatacgtaccatcaatcccgccatcgacgggttacgcatttcagccagctccggacgggccaccacccccagcgacaacagcgtcaccagcaggtaaaccgttaaggcagccatgaccgccagcagcgtcgcgcggcccacgtcatgcttgctgcgcgcccgggcggacaccaccactgcgccttccacgccgataaacacccacagggtgataagcatggtgtttttcacctgctcccacaccggcacgcccagatcgatgccggtaaaatcgagtttgaacttatcaaaattaaaggccagcgcagccagcaccacgaacagccccagcggcaccagtttcgccagggtcgcggcgaggttgatactggctgccgtctgcacgccgcgcagcaccagcgcatggacgatccacagcaggcaggacgcgccgacgatggactgccaggtgttgccgtcgccaaagatgcgcagctgtggggtatcggtgaagaagctcagcgccgagaatacgatcaccaggtaggagacgttggcgatcaccgcgcacagccagtaaccccaggcggagcagaaaccgatcagttcgccgaagccttcccgcgcataggtaaagatgccgccatccagatccgggcgcaaccgcgtcagcagcagcatggcaaaggccagcaataaaatgcccgcgccggtgatcccccagccaatcagcagggcggcgggactggcgacttccgccatattctgcggcagactgaacacacccgcgccgagcatggagctcagaacgagcgcagttaaagcgctaaggccaagtttcttttccatcgtcatcctgttatgaacgaactggatccagaataattatttcgccgtagcgcataaaaatggtggatcacactgaggcgcggaattttacgaagagcggcaggcgcatgcaatgaggtacagcagaaaattatgcaaaaagctgtaaaaggcggcacaagccgccttttaagaggggaattacttatacagatcggcgctgatggtgatattgccaccacgttcctgccactggcgggtgatgtggtaatattttgcgcctttctttgccgcgcgtttggccacctggtaggagatttccgtcatgttgccgtagttaccggtgaacttcacgctgtcgaagggcaccatttgcgccgcggtgattttattcacttcttcaattttggtgccgtccggtaaagtgacagtgtaacggccaccttttgatgactgggtttcaaagaaacgacccacttcggcgcttggcgcggcgctggtggcgatacccgggatctcaactttcttcgcttcttcgccgcctttcgccagcattgcgcgtcctgcgtcagagtttgccggaatagcgtccgggctttgcagtacgcgttttttggcgtctgctttatagacgtaggcggtgatcatctggttgccgccgtcgttggtatccacctggcgcacaatatagtaagaggccgcatttttcgctttcgcggccttggtgatggcggcgttaatatcaggctggctgcggtagaaaccccgcaccgagacggtgtcaaaaggttccagctcgatcgcctgatctttggttaattcggtcacgccgttaatgacacgattttttggcgcatccgcttttggcgcatctgatttatagagatcggccaccacgcgctgattaccgctgttggcataatcggcagagtcgacaatatagaaggcatccgcgcctgctttatcggcgcgattagagacggcattcacggcgtcgctgatggcattaaaacggccagtgatcgtgatgcgatcgtaaggcttaaccgctgctgcctgctcaggcgtcaattctgtcgctgcattaaccgacaatgttgtcgctgaaagaagtacagacgccacgagggtgttcttaagcttcataaaaataatccttcgccttgcgcaaaccagtaattggtagtgtggttgtcttgaaaacgttgccgattatggcattgaaatgtcgtcattgtctgcgtcatttttaacggccagtgcggggcgttagctgaattaccataacaattagatatatgtggaaaaaacagccgccagaccagcaaaaccggtaaagcatatgacttttataagttaactcattgttaaattgttgatctcagcaaacaggtaatcatgttttgccgcctcgctttggcggattatggggcgcgcgccgcaattttaagttaaaccagccagtcagaacgcgtttctcttaatattccgcaattaaataagaaatactcttttctggcgctagatcgcaggcgttattttcagtaggttatagaaagtttgttaccgtttgatttattagcgttgatgttcgttacccctgtgggtggcgggcaaggtcttttgagaaaactgacaaaccatcatcttaaaccgatggaagggaaaactatgcgtattggtgtaccaaaagaacggttggccaatgaaacccgcgtggctgccacaccgaaaacggtcgagcaactgcttaagctgggtttcactgtcgctgtggaaagcgacgcgggcagactggcaagttttgacgacgaggcgtatacccgtgcgggcgcgcagatcgttgacggaaatgacgtctggcagtcagacattattctcaaggtgaatgctccgggtgacgatgagattgcgttgctcaatccgggcaccaccctggtgagctttatctggcctgcgcagaatccggaactgctggaaaaactcgcggcccgcaatgtcaccattatggcgatggactcggtgccgcgtatttcccgcgcccagtcgctggatgcgctcagttcgatggccaacatcgctggttaccgcgccattgtcgaagccgcccacgaatttggccgcttcttcaccgggcagatcactgccgccggtaaagtaccgcccgcgaaagtgatggtgattggcgcaggcgtggcaggtctggcggcgattggcgcagctaacagccttggcgctattgtccgtgccttcgacacccgtccggaagtgaaagaacaagtgcagagtatgggcgcggagttccttgagctggatttcgaagaggaagcgggcagcggcgacggttatgccaaagtcatgtccgaggcctttatcaaagcggaaatggcgctgttcgccgcccaggcgaaagaagtggacattattgtcaccaccgcgctgatccccggtaaaccggcgcctaagcttatcacccgtgaaatggtcgattccatgcagccgggcagcgtcatcgtcgacctggctgcgcaaaacggcggcaactgtgaatacactatcgccaatgaagtcgtcaccacgccaaacggcgtaaaggtgatcggctataccgatttaccgggtcgtctgccgacccagtcctcccagctgtacggcaccaacctcgttaacctgcttaaactgctctgcaaagagaaagacggcaacgtgaacgttgattttgacgacgtggtggtgcgtggcgtaactgtcgtgcgtgagggtgaaatcacctggcccgcgccgcctattcaggtttctgcccagccgaaagcggcggcaaaagccgcacctgagccgattgaagaggcggttcccgcatcgccatggcgtaaattcgccctgatggcgctggcgatcattctgtttggctggctcgctgatgtcgcgccgaaagagttcctgggtcacttcaccgtcttcgcgctctcctgcgtggtgggctattacgtggtgtggaacgtatctcatgcgctgcatacgccgctgatgtcggtgaccaatgccatttcaggcatcatcgtggtcggcgcgttattgcagattggtcatggcggctggatcagcttcctgagctttatcgccgtgctgatcgccagcattaacatttttggtggtttcaccgtcactcagcgcatgctgaaaatgttccggaagaactaaggggtaacatatgtctggaggattagttacagctgcatacattgttgccgcgatcctgtttattttcagtctggccgggttgtcaaagcatgaaacctcccagcagggtaaccgtttcggcatcgccggtatggctatcgcgctgattgccaccatctttggcccggaaaccggcaacgtggtgtggatcatcgtggcgatggttatcggcggcgcgatcggtattcatctggcgaagaaagtcgaaatgaccgagatgccggagctggtggcgatcctgcacagcttcgtgggtctggcggcggtactggtgggctttaacagctatctgtatcacgacgcgggtctggatccgattctggtcaacatccatctgaccgaagtgttcctcggtatcttcatcggcgcggtgacctttaccggctccatcgtggcctttggcaaactgcgcggcaaaatctcctctaagccgctgatgctgcctaaccgccataagctgaacctggcggcgctggtggtctctttcctgctgatggtgatcttcgtgcgcaccgaaagcgtcgggttgcaggtgctggcgctgctggtgatgaccgttatcgcgctggcctttggctggcatctggtggcgtctatcggcggggcggatatgccggtggtggtctccatgctcaactcctactcgggctgggcggcagcggcggcgggctttatgctgagcaacgacctgctgatcgtcaccggcgcgctggtaggctcgtccggcgccatcctctcttacattatgtgtaaggcgatgaaccgttcgttcttcagcgtgatcgcaggcggcttcggcactgatggctcctcgaccggcagcgacgaagaagtgggcgagcaccgtgaaatcagcgcagaagagaccgctgagatgctgaaaaactcccacagcgtgatcatcaccccaggctatggcatggcggtggcgcaggcccagtatccggttgccgatattaccgagaagctgcgcgcgcgcggcatcaaggtgcgtttcggcattcacccggttgccggtcgtctgccgggccatatgaacgtgctgctggcggaagcgaaggtgccctatgacatcgtgctggaaatggacgaaatcaacgacgatttcagcgataccgacacggtgctggtcataggcgcgaacgatacggtgaacccggcggcgctggacgatccgcgcagcccgatcgccggtatgccggtgctggaagtgtggaaagcgcagaatgttatcgtctttaaacgctccatgaacaccggctatgcaggcgtgcagaacccgctgttcttcaaagagaacacccacatgctgttcggcgatgcaaaagccagcgtggatgccatcctgaaagcgctgtaagacaccgcaaaaataaaaggccgctcaatgagcggcctttttgtttctgagggcaggttaatcgtcttcgtcatccagctcgatcggggtctggaactcgtccggcttcagcaccagcacatcgcagcgcaggtgatcgataacctgttccgccgtattccccaggaacgccgctgacagcccggtacggcccaccgtacctaacaccaccacgcccgcctgcatatgctccgccagatccgggatcacttcttcaggcaaacctttttccacatgggtcagcttctcatcgatgctgtatttctggcgcagcgccttcattgccagcagatgctggccgcgaatggcatcgttatagacgctgggatcgaactccggcagttcaatggcgatattgattggcgtaacagggtatgcgcctaccaggtgcacttcggtatggttaaccatatccgcaagctggatggtttccttcaccagcttctcattaagggccgtgtggtacggctcttcgctggcaaggtttactgccaccagcgctttgccgccttccggccacggctgatccttcaccatccataccggacaggggcatttacgcagcaggtgccagtcggtaggggtgaagatcaccgattccagtttgtcgtgctggtgggtcattttcagcaccaggtcgtgatgatcgctcagcacttcctggataatggcttcgaagggacggttatgccagaccactttaatgtcgataggtacgccggcatcaagataatactgggcctgttcgcggatccacgcggtccgctggctgatcacccctgaccgcatggcggtgcgctcatcaggcgacagcagggtggtcatctcgtaggaaaaatcatagattggcaaaaaggctttgatccgaccaccaatccgttgatgtagataaacagcgcgccgtaatgccggttgatcgtcctggttgggatcgatggcaaccaacatattttgatatctggccatacagggtctccttacatctgtcaccgcagtctgtaactaaaagataacccaaatatgatgaatgaaacaggggagaacctttgccagatcaataaatcagataaatttaacgatccagcaaaggaggctgcgaaggggaaaaatcaggcaacgttacgggagtgtccggccagtaccgccagcgcgtcaccgttttcaatagtgatgtacttgcctttcaccgccagcatgccgctcttctggaagcgaccaagcagacggctgatggtttctaccgtcagacccagatagttgccgatatcgccacgggtcatggtcagacggaactcacggggcgagaagccacgctgggcaaaacggcgcgacagattatagataaaggccgccagacgctcttcggcatttttcttcgacagcagcaggatcatgtcctgatcgcctttgatttcgccgctcatcagacgcatcatttgctgacgcaggttcggcattttaccggacaggtcatcgagggtttcaaaggggatttcacagaccatggacgtttccagcgcctgcgcaaagctcgggtgatggccggtgccgatagcatcgaagcccaccagatcgccagccagatggaagccggtgatttgctcgtcgccctgttcagtgatggtgtagctcttgatggtgcctgaacggatagcgtagagcgatttcagttcatcccctgctttaaacagcgtctgccctttctgaataggctttttgcgctcgataatgttatcaagctggtccagctcatgttcattaagggtaaaagggatacaaagctggctgatgctgcaatcctggcaatggatagcacaaccgccagactgaatgcgtcgtataattcgcttttccgggatcataggtctgctcaagccttaattgattttggtcaattttaacatctttttagagcagaggtaagtccgggacagtgccagaaggtgattattggaaacctaataacattatttattgtatgtcattgatattccgcatatagattagggctttttacgctaatcactgatagaaaagcactaaatgtccttttttctcacaataaaaagtagccctcatggcgcaacaaccactcttttcgctgtacgccgcccgcataccccgtgagcataccattgctgccaatcacccgatgacagggcaccacaatgcttaccggatttgaaccattagcagcgccgactgcgcgggcggcacctgcccgacccagcgccgcggccagctgaccataatgcatcacctggccgcagggaatggcgcgcagcgctttccatacctcgcgctgaaagggcgtaccggcggtttcggtgggcagggtgtcaataacgtcaagatcccccgcgaagtagtcgcgcagcttctggctgaggccgcccggattactggcgctgacgcgctgataaccttcaaggcgataatgcaggctcagcagctgttccatgcgatcgctgtgctcttcccattccaccgcgcgcagacggaactgttcatcgcacatcacccacaaggggccaagcggggtagcaattttatcttcaagcagcgtcagcatggggatcctggtaaaggcagcgggaaagggcggagataatctagcacgacgacaaccccgtctctaccctccctgagaggtagcgcaccattaataaccagcgaaacgttttgctgactaaataataatcacctgcgcatttaagaaataaaaaaatagagtctgccgacatccgccagactctacagtacacacagcagtgcttcctaagcttattcccgagaaatcgtccctgtgggttaatttaagttatagccaggttgcggtataattccagtcgcggatgtcattaatgtctcattatttttatttatcctgtcattttaattttcatggggtattagttaagggcaggcgaataaaagaccagcgaaatagtattccatctggttatgatttttttaacgcctttgggaaatcagggatggtcattgagacgcgggcgcggcgcggttatagtagagggatgctggcaccagcagaagtagcctgaggacaacaacatgaaccttgacgacaaatccctgttcctcgacgccatggaagatgtccaacccctgaagcgcagcaccgacgtgcactggcagccggagcgccgcgcccccggcccgcagcatcctgatctcctgcaactggataacttcctgaccacgggttttctggacattgtgccgctcaacacgccgctggagttcaggcgcgaaggcctgcaaacaggcgtcattgagaaattacgccagggcaaatacagccaacaggcgagcctgaatctgctgcgtcagccggtggagcaatgccggaaaatgctgttcagctttatgcatcaggcagcgaaagataacctgcgcaatctgctgatcatccatggtaaaggacgcgacgacaactctcacgccaatattgtgcgcagttacctggcacgctggctgaccgagtttgaagacgtgcaggcgttttgcgtggcgaaagagcaccacggcggcagcggagcctgttatgtggcgttgcgtaaatccgccgctgctaaacaggaaacctgggagcgtcacgccaaacgcagtcgctagtttgtttttatttaacggctgcgccggtgataattttccccgcggtcagcggggcgcatgaataagcagggccgcaatttttatttatttgcgcttaaattattcaccttgtaaatataaaacgccctgcataccagacagggcgcttaatattatccttcaggagtagaaaattatcagcgcgctagagcgcttcatattcgccggtgccatccggccacggcgtcagtaaatcataaccgttttccgtaacggctacggtgtgttcccactgggcggaaagcgagcgatctttagtcaccaccgtccagccgtcagacagcacgctggtggctgctttaccggcgttgatcatcggctcaatggtgaaaatcatacccggtttcagcaccgtgccggtgccgggaacgccgtaatgcaggatctgcggctcgtcatgataaacctgcccgacgccgtgcccgcagtactccctgacgacggaaaaaccggcgtcttccgccacgcgctggatcgcagccccgatgtctcccagcgtcgcgcccggacggacggttttgatcccggccaccatagaggcataggtgatatccaccaggcgtttcgcgcggatcgagggttcgccgacaaaatacatacggctggtatcgccgtaccagccatctttgatcaccgccacgtcaatattcacgatgtcgccttttttcaggactttctccgccggaataccgtgacacaccacatggttgacggaggtgcagacggtgcgggtatagccctgatagccaatgttcgccggcgtgattttcagctcgttcacaatgaagtcgtgacacaacctgtccagttcatcggtggtgatcccggggcgcacgtgaggaccgatcatcgccagtacactggcggcagcctgacctgcggcacgggccagctctatttcttcctgcgtatggagttttatcgtcatggtatcagcgcctctttttgtgccggaaatgccccggcctggactaatttttgaatttccgcgccgccctgcgactcggtctgcaccagcaggcgcatcaggtcctgatgggttaaatgcggatagacttccgccagcatgccaatttttaaccagtgttccgcctgagaatttatcgagcggctcatcgcattgctggcaagacgcagattctcatgcatcaggtccgagattttcacaatacccataggtgatcctgcctgtcggtttaatacgaaacatatatgaaacgtataatagcataacctcaccggcgtacaacatgtccctttttgacatcaggctgtccggcgcggggctgtcgcctgtggcgggattgacataagctcagcaaaaaacagaggggacaattgatgcttgaactaaaacctgcctgtgaacgttgtggcgccgcgttgccgcacacctcgacgcaggccatgatttgctcatacgaatgcactttctgcgccgactgcgcccggtcgccgttgcaacatacttgcccgaactgtggcggcgaactgctacggcgacccgcgcggcataaaaaagaggcctgacggcctctgatttgtggtggattttgtcgggtggcggctgcgcctgacccgacctgcgatatggtgatctgtgactattcacacatgccacgcgttgtcgccttcttcccgctggcgggaaagggcatcggcggcgcaaatcaacgataaatggctcagtccctgcgggacatttcccgtccagtcgccggttcgcacatcaaacatctcattaaaggtttcgacgttgcccttattacacaggcattccaggatgtgctccatataacctgacgccttttcgtcgttgcccagccgcgcccaggcttccaccagccagaacgagcaggccacgaaggtgctttcctctttttccacgtcgctatagcggtagagcatgggggtgccgtgccccagttccgccaccattgcgtcaaaggtggatgtcatacgcgccagattgttttcccggccgtagtaccacaccaggcacagcgaggcatccagtctgtctgttccgggataaaaagtgtaggcctgcttcttttcagaccagcagtgttcttcgatccagtcccgaatacgatctttttcccgcgtccagcggtcgatccaggtggattctatatgtccatcgctggcaagcttagcggcgatatccagcgtcacccagcaggccattttcgaatgggtataatgattacgttctggcagttcccagatccccgaatcatcctgtcgccaggagtcggcacagtcattggccagccgtgacagcagacgggaagtggtcagatccagcacgtgaccggcatggacgaacagcagggcggtgtcgagcatatcgccaaacatactcagctgacgctggctctgggcgttattaccaattcgcaccggttgggatcccttataaccttccagcggcagccaggtttcatccggcacaatttcaccgttaagggtgtagcaggcgcgcagctcgccttcatgtcgcacaatggtgtgcgtcagccaggaaaaagccgctttgcattcttccagcgcgccgataaaggcaaatgcgcgaataatcagacaggcatcgcggatccaggcgtagcggtaatcatagtttttctcgccgccaatgccttccggtaacgaggtggtgggcgccgctgccagtgcccctgttggcgagtaaagcaaaaacttcagcgccagcgccgagcgtttgacgtgttccgggaaacgtccgtcataggtcagatcctcagtccattgccgccacatttgatcgctgatctcaatacggtggtcgattctttccagcggcggcacggccagcggctctttatcactcaccagcagggcgatcaggctgcgggagccgggagaggtggtcagggtcgcctctatacgatcatcttccgtgcgggtgagcgtgacatcaggggtggtgctgatcatcgccatcagctcaccgatatgaatgacctggcctttgggagattcagccagccagggggcgcgggtacaggcggctgaacccggcacgaagaccatttttaacgtcacttccccttcaacgccttccacacgacgcgccagttcacaccagggcagacgtcccgcgtgattactgttcagggattcagtgaactttactttgccggaatcggtttcatagcaggtttccagcacgttgctgttttcgcggtacatacggtttacgcagtattcgccgatgggttcaatctgaaagaagccgccatgtgtggcgtcaagaatacggtcaaacagcgggggtgaatccatattaggcgcgcaccaccagtcaattgcgccatccggggcgataagcgccaccgaacgaccatcgccgatagcggcatagtcgcccagcccggcatagccatccacacgacccgggtgggtataagattgattcttcatcggcactctatcctgcaaaaagaaaaatggcaggcaaaggcccgccattctgttacacggtgccggtaccaccgtcggaacaccagacctggccggacgcgaaggagctttcgtcagaagcgaaaagcacatacagcggcgcgatctccacaggctggcccggacgacccagcggcgcggtttcgccaaaggctttcactttttcctgcggctgaccaccgctggactggagcggcgtccagtaagggcccggggcgaccgcattcactcggataccttttttgcccagctgcttggcaagcgctttggtaaaggccacgttacaggctttggtctgcgcgtaatccagcaggatgtcgctcgggttaaaggcctgtacggacgaagtattaatgatcaccgcgccttccttcaggtgcggcaccgccgctttggtgatccagaaaggggcatatacgttggttttgaaggtgtcgtcaaacgcctcggttgtgagatcttcaatggattcacaaaactgctgacgaccagcgttattcaccagaatatccagaccgcccagcttattaatggcttccaccactaattgctggcaaaaggtttcggaacgaatatcgcccggcagggcaacagcggtacggccttctgcctgaatcagggcaatcacggcttccgcatcggattcttcttccggtaaatagttaatagccacgtctgcgccttcacgagcatacgcaatggcaacagcacggccaatacctgagtcgcctccggtgatcagcgcctttttccctgccagacggccagagccgatatagcgagtttcgccatgatcgggaatcggcttcatctcagaggcaaggcctggcgcctgttgcggctgctcagggaaaggtggacgtgggtactgcgaaagtttgttatcctggtttgtcattatatccgcctcgttgataaaaacacgtattaaccctagacacgaaatcatcggtgcgcgaaatttttctataataattaagattaattttaagaactttacttcttttatattaggatctacccgccataaataaggggagatgtttaaaaaatgttcttttttgttaagctaatgggcgagtaatagcgggtaaaacgtttcgatgacatcaaaaaacggattattccttaaataagacatttcttacgaaataggcttgtgactattatcagttaggctaagataattcctgacactggagcctgattagcatgcgtcgtacctgatatttacggcccggcactgttttttgatcggttaaacatgtcgtaacaaacgtgttgtaatgttaaacctgtgaaaaacattgatttataaggagatttaggatgagcattgagcccgtgtttcctgcctttcccgtagtgggctggcaggttggtccggttgaaagtcgtagtaatgtcgtcgttaaatttggctacagcacgtcgccccatacggcgggtgccagtacctttgattcgcagttctttagtttgtcgcctgacatggtgcgcagtctgatttatgatttgcagcgcagcctgcgtgagtgtgaagcaccgctggaaacgaaagtcgcctgagtccgtcgcacatcaaaatcgcagcaggccgttgatcacctgcctgctgcgaaataccatcgccttccggcaacacgccaactaatctattaattaaaaattccagctcatactttttgcttaattccacctctcagtggaatcttaattaattcttcgccgctacgttctgcgctataacttaatacagatagattgtatctgcggaatggagaaagcatgaactttgtttattttaaggcggagaatcatcagcaggataataacacgcccgttaacctggtagttgaagacgtggtacttatgcgagatggggaagttatcgccggactgggagatataaaaatcacccgtttgccattatatgtatatcgtgcagtaccaacaggttttcgtaagattgaatataaaatgaaaaccaccagtcaccggcgtattttgttttcagctggttatctgaaaacgggtgcctattatgttgaaacgcctgacggtgaacagacaatgaactttaacgcgctctccggtttatggaccggggtgcatgaagatgaaaagataatggataaccatgcttttcagaatcagggatacgctgtcttacgcccggtacccagggtaaagaaaaaacgcagcgaattgccccgttaaacttctgcgtcggcgattatcaactaaactaaaaagacaagataacaggaggccgacatgacaacgcaaacgcaaccaccacacatcacagcagcagaaccgcaacggccggtcaaagataatccggcgaagcagggcgaattgccccgtaaacgcgacgacagccaggatgacagcaaagatccgtttaaggcaagttaatcgccgggaacgatttaaaataaagggtgcgctgcacccttttttattttaaacccccgcaactttgcttaaaaaataaccctgccgctgcgtaaagatttgaaaatttcgagaatcccatacagccgttgtggtaaaaatatcgcgtgtttaactaccgaggacaattttcatccgcaggacgagaagcaagacgcggataattgtaattttatggacaatctttgcaggtcaattcgttttaccccccgttttatcctttctgcacccactcagcttgctggtgaacagtactggcgctcggcgctttagccttcattctctctgcacgagctggcgcatgatgcgcacggctaccctctaccgttttaaggtttgcgatttatcgtaagccacgaaggattatattctcacgcaggagagaatgatgcgttactggatcttactggctctggctattctggctgaaattattggtaccctgtccatgaaatgggcgagcgtttctggcggccataccggctttattttaatgctggcgatgatcgctctgtcttatattttgctggcctttgccgtgaaaaaaatcgcccttggcgtggcctacgcgttgtgggaagggattggcattctgctcatcaccctgtgcagcgtactgtggtttgatgaaagcctgacggtgatgaaagtcgccgggctgaccacgctggtggtgggcattacgcttatcaaatccggcacccgtaaagtgaaggagtccgcccatgcagccctttgaatggcaacacgcggcctggctggggctggcaattttgctggaaattatcgccaacgtactgctgaagttttccgacggttttcgccgcaaaagttatggcgtgctgtcgctggccgcggtactggccgccttcagcgcgctgtcacaggcggtgaagggcattgatttatcggtcgcttacgcgctgtggggcggtttcggcatcgccgctaccctggccgctggctggatattgttctctcagcggctgaacaggaaagggtgggcgggggtcatactgctgatcctcggcatggtgctgattaaacttgcctgatgtgatcgccgtctgctgccgctgacggcgaaatcagctaagcttatttttacttctgtaaaaaagataacagccttttcaggcggataagagggcggtgaatgttcaaacccttaagctggcgtaatctacccaccgcacgaaccttatccgttatgatattcgtggcgggtattggtctggttatttccgttattaccctgatttatctctcgctgcatctcatcagcgctaaaaccaacgaaatcgatgaacaccgctcggcgctgtcggtgcagggggcgatccagacttcggtaaaccgggtatggtcgctggtgctggacaacgccgtctgggacgatgcggtgcgcgaggtctatcgcccacaggtgaatgccagctggttatataacacctggggcgcaggctttaaggttaataatctttatgacggcacctttgtgctgaatgagaatttcgacatgctgtggggttcctttcgcatggagccttttaccgaacttagtctggatttttttggcgcggggctgaaggcgttaatcagccataatcagcgtacgctgcccggggaaaatctgatctacgcagggatcacccgcacccgttacggcgtggcttttgtggggatcggccttatccgcccgaccaccggtcgtctcgaagtgtacgacaatacccggcgctatctggtgatcacccgccatctgacgccgcaaatcctcaaagacctgggcgacaccttccagatcaacaatctcaccttcagtcataccatgccgtccaccgccagcgtcccgctgcgcagcgcggcaggggaaatcctcggctacctgagctgggatccgcagcttcccggcgcgcaggccgctcatgcggcggcgtgggaaatccgccagattgttggcctggtgacgctgttgatcctgatgtttatcctgctgaccagcgccgggctttacaaactgtcgcgcggcgaaaagctggcccgccgcatcgccgtcaccgactggctgagcggcttacccaacaggcgcgcgctgatcgaacggctggagcagcttaatcagtccggcgataccgacaccatcacggtggtgtttatggatctggatggctttaaggatgtcaacgacgtttacggtcatgacgtcggcgacaagctgatcgtcgccgtcgcccgcagcctgagtgaaaaagtgccgccgggcgggatgctgtcgcgcatgggcggcgatgagtttgccatgaccatgcacggcgacaatgctcacgaaaagagcgcgatatttgccatgctggtgctctcctggttcaatgcgccggtgcggctggacgaacgcagtattcacatcaccgccagtatcggcatcgccagcagcgtgcagggcgactgtagcagcaccgagctgttccgccgcgccgacatcgccatgtatcactcgaaaatgaccggtaaaggccgcatcacgcattatgacgcggcgctgaacagcgcgcgcgaacgcaagttgatcatcgagaatgacattcgtgacggtctggaaaacgacgaatttgacgtctggtatcagccgattgtcgatgcccatacgctgaccatgaccggcgtcgaggcgctggtgcgctggccccgtcgtccagccggggcgctggggccggatgaatttatcccggtggcggaaagcagcggcctgatttacgccctcggccagtttgtgctgcgccgcgcctgtaccgatttactggcgatggaagatcttaagctgtcggtgaatatctcccccgcgcagtttcgcgatccggaatttgaagtgaaagtggcgggcgtgctggacaccgtcggttttccggcgcaccgtctgcaactggaagtgaccgaaacctatgtgctggaaaatccggagcgttcgcgtacggcgatcgccaatctgaaagcgctgggtaccggcgtggcgctggatgatttcggcaccggctactccagcattggctatttgcggcgctttaatttcgacaccattaaaattgataaatcgctggccgggctggtagatgcggacgatcaggccgccgcgctggtcagcggcaccgttcggatcgccagcgcgctgggtatgtcggtcactgcggaaggggtggaaaacgaaaagcagatgaaactgctgcgccttgccggttgcgatcggttacagggcttctacttcagccagccgcagccgatttctgtgctgatgccgctgcgtaaacagcggcggggatgatcattcctgcgccagttcgctcagtttttcgcgaaaacccgttactgaaatcgcccggttatccgcccgccagcgatctttcgcggccggggcggaactctgcacgccaattaactgccagccggtgtccgtctggatcatcagcggcgatccgctgtcgccgggcagggtatcgcactgatgggacaacaccgaagtctgcgcccagccggtcaccacgcaatctttatggctgtacaacgcatccagatgatcctgcggatacccggactgggtaacgtggcggccggtcgtttttagcgctgccgttaatgcctcgcgatcgccggtaaacagcggcagaggggtgatgccggacggcggatagcgcagcacgataagcccaaaatcccagggggcggcggaagacggtacgatccagccctcgccgtcaggcttcagacgtttgccgagagacggatcgacacggccttcaatgccatggatctcataccgccagatgcctttttgcgccacaaaacgcagcgccagcgctttatccggcttgccgtcgggcggcgtcagcagacagtgcccggcggtgagcgccagatgcggggagatcagggtggcagtacataaattgccgctgacggtttccagttgcccgattgcatcccagggggactgctccggttgcgtgacgcgggtacgatcgtcatgaccgaaaaatagcgttttcacctcaccggcattcatcgcctcatcatcgccttcatcagcatgcaggactgcggaaaataaacagaacgttcccagtaacaacacaacagttttacgcatagcacactctggtggggtaattatgattattaaaagtaacccaatgtaagactaactatagacgggaggcgtggaaagtgggagtaaaatcagcgtactacaatcaggaaaaatagaaatgcgtggcaacgattgcgcataaaataagcgtgatgagaattaactcaaaccgataacgccccagcatacgccctccggataaaaaacggcgcttaccagaaagctaagcgccgtgttattagcctgcccggacatgcgggcagataacattgctacaacttatgcagcaggttgtgcggccggttttgcggcttcatgttttacgtgttttttgtgatgctttttagcggcctgagctttttgctcagcagccggtttagcagcggcttttttgtggtgctttttagcagcctgcgctttctgggcaacggcttttttgtgtttcttgtgttttgccggggcagttttggtcgcagccggagcctgagcagtggtcgcggtagcggccggtgcagcagtggtggaggtggcagcatcagcagcgaaagcggcggaagacagacccatagcagcggcaacaaccagagctaatacttttttcatctcgtgatcctcgaattggtttcaacattcaaccccactgcggggccgttgaaaacactatatccctgataattcgcggcttccgtgagtcattggtatcggcgtgtaaccatatgtacaacgccgggtatgatgacccggcgcgtggaggcgttacagataacgcgcggtgagatgctggcggaaatagcggctgttcagcgcttcgccggtcgcgttttcaatcagttgcgacgtggtaaagcggctgccgtgctgccagatattctgccgcagccagtcaaacagggcggtgaaatccccctgcgcgatggcggcatccagatccggcagggcggttctggcggcgtggaacagctgtgcggcatacatggcgcccagagtgtacgacgggaaataaccgaagccgccatccgtccagtgaatgtcctgcatacagccatcacggtaattgcctcccgtggacagccccagccagctctgcattttctcgttccacagcgccggaatatcctccacctcgatgtcgccgttaatcagcgcccgctcaatttcatagcgcagcaccacgtgcgccggatagctgacttcatccgcatcgacacggatataacccggcttaacgcgctggttccaggcaataaagttgctttcgctgaaggcgggctgatcgccaaagcgctgcactaccgacggcaacagctgcttcaggaaggcggcgctacggccaagctgcatctcaaaaaacaggctctgggattcatgaatggcggtggagcgcgccagcgccaccggctgccctggccaggtacgcggcagattttgctcgtagcgcgcatggccggtttcgtgcaccacgcccagcagggcgcttaacagctcattttcgtcgtaacgtgtggtgatgcgcacatcgtccggcacgccgccgcagaacgggtgggcgctgacgtccagccgcccgccgttaaaatcaaatcccaggcgcgccatggtttcgacgccaatctcccgctgtaaatcaaccgggaacggcccctgcggcgcgatcagcggctgctgtgcctgtttctccaccacccgattcagcagatccggcagccaggattttaaatcaccaaacagcgcgtcaaggcgggcgctggtcatatccggctcataaatatccagcagggcatcgtaaggcgagcagcccttagcgtcggcgcgcagacgggcctcttcgcggctgagcttcaccacctctttcagattggcagaaaacccggcccagtcgttggccggacgctgactgcgccaggcgtgttcgcacttgctgcccgccagcgattttgcttccaccagcgcttccggcagcagcgccgcctgttgatactggcgggtcatctcgcgcaggttagcctgttcaatatcattcagattttcttgcgccgcgccttccagccataccgcaacatttttatcggtgaggatctggtgttgcagcacgctcagttccgccagcgcttcgccgcgcgcctggctaccgcccggcggcatcatggtgaacatgtcccagccccccatcgcggagagatgagaaaaacgggacagacgggtaaaaatgcgggtgagttgctgatagttcttattttccataatgcctcatgtcatcgaaggggctgcgaaataatcttacttgagtaaattcttattgggtaatttgatttccatcaaacgaaagttgtgtttttttcaggaagggtaatactgtgtcataatagataaagttcatgttaaccaacaacataagaattcgatgttatgaatccattttattgggtgatattggtagtcttgacgctggatgcggtccgtgaattgatgggtgtatcatccgtaatgggaatattttcgtaagcagacgtgcaagccgggttagcgcaacgccacccggcaaagaaagctaatcaatccagacgccggtgcaggcagcgccccaccagcagggcggcgatcagcagcagcgcgataaacccgcccacgccattccagccgaaacgatgccagaacacgccgcccagcgtgcccgccacgcttgatcccagataataactgaacagatacagcgacgatgcctggcctttcgcccgtcgtgcgcgcggcccgatccagctgctggccaccgaatgcgcggcaaagaaaccggctgaaaacagcagcatcccggcaaaaatcagccataacgaagccagcagcgtcagcagcacgcccgccagcataatggcggtggagccgagcatcaccgggccgcgcccgaaccggctggtcaacatgcctgccttcggggaactccaggtgcccgtcagataggccaccgacagcaggccgacaatcgcctggctgagatgccagggcgcctgcatcaggcgatagccaatatagttaaacagcgtgacaaacgcgcccatcagcagaaaaccggtgacaaacagcagcggcaggccgcgatcgcgccagtgcaggcgaaagttaatagcaagcgtcctgggtcgcaagggcgtcggacgaaagtggcgcgagtccggcagaattttccagaacatcagcgccgccgccagcgcaaagcagccaatcacgcccacggcgatacgccaggaaaaaaaatcggtaaacacgccgctgagcagacggccgctcatgccgccaatggagttgccgctgatgtacagccccatcgagaacgccacaaaactggggtggatctcctctgcaagccaggtcatgcctactgccgccacgccgcttaacgacaggccgatcagcgcgcgcataattaaaatgccgtgccagctggtcatgaccgtcgagagcagcgtacagcaggaggccagcagcaacgcggtgaccatcaccggtttacggccaatggcatcggagagcggaccggtaaacagcagaccgatggccagcatgccggtggaaatcgacagggaaatactgctgctggcaggggacacgccgaactcctgcgacagcaccggcaggatcggctgcacgcagtagagcagggcaaaggtggcaagaccggcggaaaacatcgccagggtgacgcgtacaaacagcgcgctaccgcgtttaatccagggggcgggccgggagagcgcctgtacaccggcatcgctggccgcagcgatgtcaacaggggttgtatgactcacagaacatccttaacttcacatccccgtgattcagggtgacgggtaagaccaccgccacagggtaggaaaatgtaaatattctgtctaatatattaatcctctcaaataatatgtttagcgaatgaatatagaactacgtcacctgcgctattttgtcgccgtcgccgaagaactgcactttggtcatgcggcggcccggctgaatatctcccagccgcccctgagccagcaaattcagatcctggaacagcaggtgggcgcacggctgctggcccgcaccaatcgcagcgtggaactcacgcccgccggaaagcagtttcttgccgattgtcggcagattttaagtcaggtggaggacgccgccgcccgcgccgcgcggctgcatcaggggcagaccggggagctgcgcatcggctttacctcctctgcgccctttatcaggccggtctccgatacgctgtcgctgtttcgccgccgctacccggatgtgcatctgcaaacccgcgaaatcaatacccgggaacagatagcgccgctgcatgagggggccctcgacctggggctgatgcgcaacacgcagctgccggacacgctggcctggcagatgatcctgcgcgagccgctgctggcgatggtgccgcgtgatcatccgctggcggcgaaaaccagcgtaacgctcagcgaactggcgcgtgaaccttttgtcttcttcgatccgcaggtcggcaccgggctgtatgacgacatactcgggctgctgcgtcgctacgggctgacgccctttattgcgcaggaagtcggggaggcaatgacgatcatcgggctggtagccgccgggctgggcgtgtcgatcctgcccgcctcctttaaacgcgtgcagctggacgaaatgcgctggctacccatcgcggaagcggatgcggtgtcggaaatgtggctggtatgggcgaagcatcatgagcagggatcggccgcggcgcgtttccgggaacagctgctggcgaccattcagtaaatttattcatcaaagcgaagggtaaaatgtgcggtaaatcacaaggctaatcaaaaatttgacggcctcattgaactgcttcaccatagcccacagattatttcgaagctcgaaaataagggagtcttaggtggttgctgatagtcagccagggcatattgatcagattaagcagaccaacgcgggcgccgtttatcgcctgattgatcagcttggcccggtttcgcgcatcgatctttcacgcctggcgcagcttgcgccagccagcatcaccaaaattgtgcgcgagatgctggaggcgcatctggtgcaggagacggaaatccaggagccgggcagccgtggccgtcctgcggtcgggctggtggtggaaaccgaagcctggcactatttatcgctgcgtatcagccgcggtgaaattcatctggcgctgcgcgatctgagcagcaaactggtggtggaagagcagcagccgctgccgctggtgtcggatgaaccttttatctcccgtgtcattacccatatcgatcagttctttatccgccatcagcatcagcttgaacgtctgaccgctatcgccattactctgcccgggatcattgatacggaaaatggcatcgtccaccgcatgccgttttatgaggatgtcaaagacatggcgctgggcgaagcgctggaagcgcacaccggcgtgccggtctacattcagcatgacatcagcgcctggaccatggccgaggcgctgtttggcgcctcccgcggcgcgcgtgacgtgatccaggtggtcatcgaccataacgtgggcgcgggggtgatcaccgacggccgcctgttgcatgcgggtagcagcagcctggtggagatcggccacacccaggtcgacccttacggcaagcgctgttactgcggcaataatggctgtctggaaaccatcgccagcgtcgacagcgtgctggagctggcgcagcagcgcatgagccagtcaatgagctctatgctgcacggcaaaccgctcagtgttgaatccctgtgtcaggccgcgcaggacggcgatctgctggcgaaagacattatcaccggcgtcggcaccaacgtgggccgcatcctggcgatcatggtcaatctgtttaacccgcagaaaattcttatcggttcgccgctgagccacgccgccgacatcctgtttccggccatcagcgactgtatccgccagcaatcccttccggcctacagccggcatatggtggtggaaagcacgcagttctcaaatcaggggacgatggcgggcgcggcgctggtcaaagacgcgatgtataacggttctttattgatacgtctgttgcagggttaacatttttcttactgacgtaagaaaaattgcgctacctcaagccgactccttacgccttaacgtagacttccgccactgaattattattctgattaatatttccgaagcataacggtggagtaagtgatgcttaagcgtttctttataacgggtacagatacctcagtcgggaagaccgtggtttcacgtgcattgctgcaggcgctggctgccagtggcagaagcgtggcagggtacaaaccagttgcgaaggggagtaaagagacgccggaaggaatgcgcaataaagatgcgctggtactgcaaagcgtctccagtattgatctgccttatgaggcgttcaatcctatcgccctgagcgaggaagagagcagcgtggcgcacagctgtccgatcagttacagcctgttaagcagcggcctcgcggcccttggcgaacaggttgatcatgtggtggtggaaggcaccggcggctggcgcagcctgatgaacgatctgcggccactctcggaatgggtggtgcaggagcaactgccggtagtgatggtggtggggatccaggaaggttgcatcaaccatgcgttgttaaccgcccaggcgatcgccagcgatggtctgccgctgataggctgggtggcgaaccgcatcaatccggggctggcccattacgccgaaatcatcaacgtgctgagccgcaaaattccggcgccgctgattggcgaacttccttatctgccgcgcgcggagcagcgcgagctggcgcagtatatcgatctgctgacctttaaccgcacgctggcggcggatcgcgttctggcttaagctggactgcccggcggcgctttgcttgccgggcctactgattgtcgcaatcccgtaggccgggtaagcgcagcgccacccggcaaattcagcagcgccacccggcaatacgctcaactgtcggtatgaatatttaacgcccggcgcgttctgccggagcttaaataatcggcgatataatcctgcgaaatctcgccgttataacgaccttcctcatcgacaatcggcatccagctggtattgctctcatagagttttgacagcaccacgcgcaggttatcttccgccttaccggtgacgcggaatggatgcagcagctgcgcgcagtcgccactggcgttacgcgcttcacgacgcttcacaaagccgagcggcttgccgtccacatccaccacggtaatggcgcgaatatcgttctcatccataatggcgaaggcttccgccagcggggtggatttgcgtaccgtcagcgtcggctgttgatcggtgacgtctcccgccgacaccagcagcaggcgcttcagcgtgcggtcctgaccaacaaacgaaccgacaaactcattcgccggtttcgccagcagttcatccgggctggcgcactgcacgatgcgtccctgacggaatacggcgatacggtcccccagcttcagggcttcgtcgatgtcatggctgaccagcatcaccgtctttttcagcttacgctgcatgtcgaggaactgcgtctggatcacctcgcggttaatcgggtcgacggcgccgaacggctcatccatcaacagcaccggcggatctgccgccagcgcgcggatcacgccgatacgctgctgctgaccgccggacatctctttgggatagcggttaaggaattttttcggatccattgccaccatatccatcagctcttcggcgcggcttttataacgcgcgcgatcccagccgagcatgcgcggaacgacggtaatgttctcctcaatggtcatgttcggaaacagaccgatttgctggatcacatagccaatgttgcgacgcagggtgacggtatccatgccggtggtgtcttcgccgttaatcaaaatcttgcccgcgctcggggcgatcagccggttgaccattttcagcgtggtggtcttgccgcaaccggacgggccaagcagcacgcacatttcgccttccggcacattcaggttgacgttatcgacagctttaaaggtctggccgtttttctgtgtaaattgtttggtcaggttttcaagttttatcattatcgtattcctttcggtgtcagggcggtctgcaaacgatgcagcagccagtcaagcacaatagccagcacacaaatcatcaacgcgccggcaattaacatacggatgtcgctgccgccgatgccgttcagcagcagcaggccgaggccgcccgcgccaatcacagcggcgatggccatcacgccgatattcatcacgacggcggtgcggataccgccgaaaatcaccggcaacgccatcgggatctccacccagcgcagacgctgccagaaggtcatgccgataccgcggcccgcttcacgcagaccgggcggcagactgtccagcgcggtatgggtgttacgcacaatcggcagcagcgaatagagaaacaccgcggtaatggcgggcagcgcgcctataccttgtcccaccagcgaaaacaccgggatcatcaggccgaacagggcaatcgacggaatggtcagcagcagagtggcaatgccaagcaccggcgtcgccagccatttgtaccgtacaatcactatacccagcggcacgccaataataatcgccagcccgacggccagcagaaccagccacaggtgctggaaggtcaggctcatcagatagcctgcgttgtccatcatgtaatgaatcgtatccatgggcgctccttacagcaggcctttttcatgcaggaagtcgcgggcgacctgctgcggcgtctggtgctcaatatccaccttcgcgttaagcgtggtgatggcctcgttatccagcaggccggagagggtattcagcgcctcttccagtcccggattagccgccagcgtgtctttacgcaccaccggcgtgacagcgtaacttgggaagaagcctttatcgtccttcagcactttcagatcgaagcccttcacgcggccatcggtggcatacaccagaccggcatcgacaaagccatcgcggatggcgttatacaccaggcccggatccatctggcggatttgcgggcgatccagttccatctgataggcctgttgcagcggcttcatgccgtcgctgcgcccggcgaattccaggtcaaggccgagcatccagttgttgtcgggatcggttttgcggatgtgttcaattttcgccaccatctccgacatggtgttgatgttttccgcctcggcgcgtttacgctgcatggcgaaggcataggtattattcatgtccgccggtttcagccataccagacccagtttggcgtccagctgtttcaccgtggcgtaggactcctccggtgacatgcgtttattgatatggttgaaaataatcagcgaggtgccggtatattcccaggtcatatccacctgcttattaatcattgcgttacgtgaaatcaccgtcgcaatgttggtctgcggcgtaacctgaaaacctttcttttgcagatactgcaccgtcatggccgacagaatatgctgttcagtaaaactcttggtggccagcaccagcggcgcggcctgcgcctgggcgcttagcagggcaatggcagccataaatcctgccagtcgggtaaaccatttcataccggattccttattcttgttatcaggcagtgtgcgggctgagcacgcgtcccagcgcggcaagcagcgtatcgaggatcagcgcaaagagcgcggtcgccgcagcgccgaggatcagcgtcgggaaatcgttcaggtagatgccggggaaaatcagctcgccataactgctggcgccaatcaaaaacgccagcggcgcagtgcccacgttgatggcggtggcgatgcggatgcctgacagcatcaccggccaggcgttcggcagttccacctggcgcaggctctgccatttggtcatgccaatgcctctggcggcttccagcagcgaaggttgcacgccgcacagaccggcataggtgttacgcacaatcggcagcagcgaggcgaggaacagcgcgatgatcgccggcgtatcgccaatcccgaaaatcaccatcgccagcgccagcactgccagcggcggcagggtgttgccgacgttgaagatctgcatgatgtactccgcaaaacggcggcatgccgggcggctgagcaggatcccgctgggaatgccgaccagcagcgcgaagaacatcgaactgaagacgaggatcatgtgctgttgcccgagatacagcagatcaacctgccgctcgcggatagtttgcaggccgatactccagaccagcagggcgatgacaataagcagcgcggccacaaaaagcagcgcgcgaacaaggggggatctttgcattgcagtgtgtctccctgggtgcatgcgttattgcaacagtctgttgcgtgttgttatgccatgtatcggcagggtgaatgagctatagcaagctgccggaaaggatgccagtgtgcggcaagtttctgatcgggcgaatatttatacgaacagctgccatgccttgcggcgtatagcgcgatttgcgggtcgggaattatcttaaattgcgacggtaaaagtgacgttgtaacagtttgcgtttgggattatcacgcagctgaacaaaaaagccgcacggacgacgccgcgcggctcacagaggtgtggcttatttatacagcggcttttccgccaccgggatcagcagatgcgtttgccaggccgcgagggttaagcgcgtcagttcaccgagcgcctgataaaacggatgggcggcatgttccgcgaacacggcgagccagcgcccggcccacggcagcagatgccaggccagcagctgttcgcattcagcttcccgcttttcttccatcagccaggccgtcatcatcagcagcgtgccgatatgatcttccggttcattttgccccggcgcaaaaacaatgttgttgtcacgcatccactggcgcagcgccagcgtcgagtcgccgaacaggacattttcgcgatccagccacaccgatccccatggcggggcgggtaacgcccaggggccgaggaacaggcgctgccaggcgtccggcagcggttcatcggcagaggcggtaaagcgcgccgccagcggcgtcagcgcatcgggcagtagcggccactgttcctgccaggcaggatcctgaagcgccgccaccagcggggcggcctgttcgctctgcggcgggtagtaaaataacgcgcccagaacccgggcggcaacggcaaacgcctgacgctgtgcgtcatccataaaacactcctgatttatccaccaaccgccataccgacggtcatatgtaatccgtaaaacaggccacggcccagcagctcgcccgccagcaccaacagcagcccggccagcaaactgaacacctgtggctcacgacgccacagcagcgggcagatccagcagcccagcccggcggcgagcagcgccagacgccagacctggagcgcggcataatccggcaccagggcggctgcctgctgtactgacgacgagatcgtggcgagatccgcagtctgcatgatcaccaccgccacgcttgccagcagcgccagcacgctgataaaggcaaacacgccgccgttaaaggggatacgcgccagacgcagcaacagcgccgccagtaacgggccgctcagcagcacggtgaggaaaaacgcggcggtggtgtaaccgttatgccaggtcggcacggtgtcgatctgatacacccggctcatggcatacacaaacacgacgccgagggccatgctgacgacaagccagatcctgcccagggcttcaggcattttgccgattaccgccaccagccaccacaggccgccgacggcgaaaaacagcgatccggcggcgatctcgttgctcagcgccgacgcgccgatgcggttcagggaattaaatgcccgcaggggcgatcccagatgcatcatcgaggcgataaagcccacgcccatcagcagccagaggaaaaacaggctgcgggtaagccgggcgcggttttcgctgttatcggcgcacgccatccagccgagcccgccgacgataagcgcgccggtgacgcactggccgatgacggtaaataacaccagcggccattcatgccatccgttgcccatctcacacctcctgcgggttagccagaaagccggttttgtccccggtggggcggctgttggcgttgggtttgatcacgatattaggctttgtaaaatgcccggacggcagcggggcgacggcatcaaggctgccgtatttttcacgcagctcgtcaacgggcgcaaagtccagcgcgcgcagcgggcaggactcgacgcagatcggctttttgccctccgccacccgcgaatggcagccgtcgcacttggtcatatggcctttagcggcgttgtactgcggcgcgccgtacgggcaggccatatggcagtagcggcagcctatgcacacttcttcattcaccaccacaaaaccgtcgtcgcgcttgtgcatcgccccgctggggcagactttggtgcaggccggatcggcgcagtggttgcaggcaatcgacaggtaatacgcaaagacgttctgctgccagacgccgttgtcttcctgccagtctccgcccgcgtattcatagatgcgacggaaactgacctccggggtcaggtctttgtaatctttgcaggccagctcgcaggttttgcacccggtgcagcggctggaatcaatataaaagccgtactgagttgtcatgggttactccttaaaccttctcaatttccaccaggttggtgtgctgcgggtttcccttcgccagcggagaaggacggtgcgtggtcagagtattgatgcaggcgccatgatcgatgcggtcgcccgtcatattggcctgatgccatgcgccctggcccatggcgctgacccccggcatgatgcgcggcgtcactttggcggcaaggcgcacttcgccacgcccgttaaatacccgcacgatatcgccatgtgaaatgccacgctgtttcgcgtcgaggggattgatccacacttcctgacggcaggcggcctgcaacacatcgacgttgccgtagctggagtgggtacgggatttatagtggaaaccaaacagctgaagcgggaaggttttgcgttccggcgaatcccagccttcaaaggtggcggcatacaccggcagggggcttatcacttcatcttttgccagctgccagcttgcggcgatctccgccagctgcgcggagtaaatttcaattttgccggacggcgtttccagcggattcgcctgcggatcttcacgaaactttttataggcaacaaaatgcccctgcggatccttgcgcttataaatacccatcgctttgagctcgtcatacgccggcagcagcggatctttcgcccgcatcttcgcgtataaataatgcagccattcttcctgagtgcggccttcggtaaagcgctgaaagacgtccggccccaggcgttttgccacttcgcttaagatccagtaaatcggcttacgctcgaatttcgcggaggtggcgggctggatgaagatcagataacccatatttcctgcgtaatcgttgggaataatatcttcctgttcgacggtcatcagatccggcagcagaatatcggcatattttgccgacgaggtcatgaagttctcgatcaccacgatcgtttcgcattttgactcgtcctgcaaaatctcgtgggttttattgatgtctgaatgctgattaatcagcgcgtttcccgcgtaattccagatgaacttgatcggcacgtccagcttgtctttaccctgcaccccatccccggtggcggtcatctccggcccacgggcaatggcatcggtccaggtaaaacaggaaattttcgttttcaccgggttttccagtaccggcatgcgttcaatggtgagggtgtaagtggattcacgcgcgccgctgttgccgccgttaatgccgacgttgccggtgaggatcggcagcatggcgatagcgcgcgcggtcagctcgccgttagcctgacgctgcggtccccagccctggcagatatacgcgggttttgcggtgccaatttcccgcgccagtttaataatgcgatcggcgggaatgccggtgatggcggcggcccactgcggggttttggcgataccgtcgttgccgtcgcccagaatatacgccttataatgcccgttggcgggcgcgccttccggcagcgtgctttcatcgtagccaacgcagtagttatccaggaaaggctggtcgacaaggttttcgctgatcaacacatgggcaagccctgccaccagcgccgcatctgtgccggggcgaatggggatccactcatcttcacgcccggcagcagtatcggtgtaacggggatcgatgacgatcatgcgcgcattcgaacgatcccgcgcctgttcaaggaaatacgtaatgccgccgccgctcatacgggtttcggccgggttgttaccgaacatcaccaccagcttcgtgttttcaatgtccgaggtactgttgccttcattactgccataggtgaagggcatggcgcgggcgatctgcgcggtgctgtaagtgccgtactgacccagaaagccgccgtagcagttcatcagacgcgccaccagcgaagcggaaggggatgagcgggtaatattgccgccgacaatgccggaggagtaattaatatacaccgcctcgttgccgtatttttccaccacgcctttgagattcatcgcaatggtgtttaatgcctcatcccaggagatacgttcaaatttcccttcgccgcgtttgcccacgcgcttcatcggataattaagccgatcagggtgattaatacgtcgccggatagatcgcccgcgcaggcaggcgcgtacctgatgattaccatagacatcgtcgccagtattatcggtttctacccagatcacttcgtcatcacgcacatgcagacgcagggcgcagcggctgccgcagtttactgaacatgcgccccagacggttttatcggcactttctttcacagcctgctgcaccgcggcggcggcctggcgcagaccaaaaggtaatgtgaaaccaccggccgccatgacaagcgcaccagctgcagaggatttaacgagggtacgccggctgataccgccggtattatcgacatcggacatcgctcactccctgtttttataatgaatagcattacagctgaaatagttatcagcctgaggaagtgtgagggtactaataagggagtagaaaggtattatcagaggtcaatgtttaagaaattccccctgtaaagacagggggaataagtttactggggttcggtgcgggcgccgtcgctggttgcggtgctgcccgaggcggcgctcatccccccggtgcgggtatagaggatcttccaggtatcattggcgcaatggccgaccacctgcgcgtcaggtttatccgcctgatcgccggggacaatatccagcgtaaagccggattccggtacgccattattcacgatacgctgcgcaatatcgcttttgacgttttcacaggactccggggcggccataaccggagccgctgccagcattaatcctgcgcataaccagtatgtagctttcataaacgatcccttatctcatgaatttatctacagtttagcagtccgcccgggaagcatcgccgttgcgggaaatctcagaaccttccgcataacaggcgagacgggtgaggcggcaaaccgctgtatttgctactatgagggaatattttgcacctctggtaatctacatgaaaaaaacaatcattctggccgcgctaacggtagcgcttgctggctgtgataataatgcgcagggcccggcttcttttacgccggagatggcgagcttctcaaacgaatttgattttgatccgctgcgtggtccggtgaaggatttcagtcagaccctgctgaatgataaaggggaagtggcgaaacgcgtcaccggtacgctgtcgacggaaggctgttttgattcgctggagctgcacgacatcgaaaataataccggcgtttcgctgctgctggacgctaattattatctcgacggacaaaccaacgagaaaagactgcgtttacaggggaaatgccagctggcggcgttcccggcggcaggggtgacctgggacacggatgaaaaaggttttgtggtgacggcgcgcggtaaggatttgcaggtggattatcgttatgacgccgaaggctatccattggggaaatccaccacctcgaaagagatgcacttacaggtggatgccacgccgtcagcggataagcgtaagaaactcgattataccgccgtcagcgtgctgaacgacaaaccgcttggccatgtgaagcaaagctgcgactacgaccgccacgataacccggtcagctgtaagttgctgatcgtcgatgaaagcgtcaccccggcggtcgaacgtcagttcaccatcaaaaataccatcgcttattactgatcccgccgcctactgtgctgtaggctttaacagcgtcctgccgggcgctttatgctcggcaagatactgatgctggaaaatacacatgcggatggtgttgcgatactcgccgttaatgaagaactcatggatcagttcgccttccaccataaatccgagcttgcgataaatatggatggctttctcgttttctttatcgacgatgagatagagcttatacagatttaataccgtaaagccgtaatccatcgccagcttcgccgctttgctggccaggcctctgccctgatgttccggggagataatgatctgaaactccgcgcggcggtggacgtggttaatctccacaagctccaccagccccactttttcaccgtcgcattccaccacaaaacggcgctcgctctgatcgtgaatatgcttgtcatacagatcggacagttcaacaaaggcctcgtacggctcttcgaaccagtagcgcatgacgctggcgttattgtccatttgatgcacataacgcagatcttcacgctccagcgggcgcagcttcacgccgttaatctcactcatggtcaaatccttatgacgaaaatttacggcgcaaccacgcggccggtacgacggtcaagacagcgcagggtgttgttttcccagtaggcattgagattggcgctttgctggcacttatcgcgggcatcaaaagccgcgtcgtctttatcccactctttttccacgcgcttgttcactttgttacgcaatgaacgggtgtcattccactgctctttttccatcaacgcctgctggcggctctgggcgctgtcgccggattcaatgatcagtttgctggtttcagccattgcgccgggggtgaccatcaccgcgcccagcgtcagcatcgccatcaggcacaggcgtttgcgaagagagtttttcatcaggcattccttttaactattgcaggggcatattgcttatattctacaccatcacaagtcggcgacataccggcgtgaggggttatgccgcattaccgttgaccagaagttcactttccacgcggatcacgaaatcggtaaatagcgccgtgggtttaaccgtatttcccttgcgctgcaaatgcacaaaaccatgactctcaagggttttgagggtggtcgacaggttactgacctgacggcccgccagccgcgccagttcgctgattgtttcgggtttatgtgctgccatcatccgtagcagggtgatattttcattgctcaaaatttgcccgatagcattaagcgaggcaaaccagactttcggctcgtccggttccggcgtgtatttaccggcagcgatagcgagcattcttttacgaaggttttcctccgaaatgatgcctataagtgctttcataatgaaccctctatgtctttcataacgctatctacagcggcaaaaaaatcattcagcaactgcgttgccgactgaaaacagtaaacctgtcccggatcgattgcggttgtatggacatggtcataaatcaccattcgtgaccggaaccccccgctacgcggggatgtaatgccatgcgcattgtccatgccaaaaatccggtggttatgagcgttatgcagtgtaaggttgtagcggataccatgaggcctgaaaatcgaggcttcaacccggcgtgcttctattttccaccagtagccattgtcataacgaaactgataaccatccatatcgagtaaagtgctgagtccataatcttttgtatccataaacactccctgtacttatgagcggatcataacaactttatcaaaatacgcaatcaccccggctgcgcctggcgttccgcccgcaactcccgttatgatgcgatactgaacgtaaacagactgactacgccctatgatccggacctcactgcttttttttatcaccgcgctctgtgaaattattggctgttttctgccctggctgtggctgaaacgcggtggcagcgcattgttactgctgcccgcggcggtatcgctgtgcctgtttgtctggctgctgacgctccatccggcggccagcgggcgggtttatgcggcctatggcggcgtgtatgtattcaccgcgctgatctggctgcggctggtggatggcgtaaagctcagcctgtatgactggctgggggcggcggtggcgctgtgcgggatgttgattatcgtcgccggatggggccgcgccggttaatccacgctcagaacgagctgcggatagcgttccagccagcgtttgcgcctgatccgttcatcaaagatggcgcgtttctcctgctgaaaacgcggcgtggggcgcagccgcagggcgaacagatcgtccaggccaaagggcgcgataatatcaatttgatcggatccgcaaagccgcacggccacggcggtggcggtttccggccagtagcgcagggcatcttccacgctgtgataaggccggtcgtgattacgttcatgcatccgcgcctgattttttaccgaccagtcaaagtccgggcgcatctttctcaggcgctgttccagaagattatcaatctcttcaccggtttggcgggcatcaaaccacaccacatccacatcaccgcatggcggccgcgccggtcgctggtgcaggcgatcccacaccgcatcacgcaccagcccggcgccgatccagccattctccaggcccagcgacgccacagttttgagggcttccatacgtagcgcatcctgcaatagcaggcgacgcagttcatcagcatggcgcatcgcggcattcctgttcactcatggggatcttcattctaccgacagaggcgtcattttgtgagccagcgcgaaaaaacagatcttcatacttgtatggtagtagtgcggatggttagatttcatgcatcacaacaaaagaagcaggaattctcatgaagattgttagtgctgaagtatttgttacctgtccagggcgaaattttgtcacgctgaaaatcaccaccgatgacggcattaccgggctgggggatgcgacgcttaacgggcgcgagctttctgtggcctcttatctgaaagatcatgtctgtccgcagctggtgggacgagacgcgcaccgtatcgaagacatctggcagttcttctataaaggcgcgtactggcgtcgtggcccggtcaccatgtcggcgatttcagccgttgatacagcgctgtgggacatcaaagccaaagccgctggtatgccgctgtatcagttgctgggcggcgcatcccgcgatggggtgatggtttactgtcataccaccggccattccgttgatgatgtgctggaagactatgcccgtcacaaggagatgggctttaaggcaatacgcgtacagtgcggcgtgccggggatgaaaaccacctatggcatgtcgaagggcaagggcctggcctacgaaccagccaccaaagggcagtggccggaagagcagttgtggtcgacggaaaaatacctcgatttcacgccgtcgctgtttgccgccgtgcgcgaaaaattcggctttaacgagcatctgctgcatgacatgcaccaccgtctgacgcccatcgaagcggcgcgctttggcaagagcatcgaagagtaccgtctgttctggatggaagatccgaccccggcagaaaatcaggagtgcttccgcctgatccgccagcataccgtgacgcccattgccgtgggtgaagtatttaacagcatctgggactgcaaacagctgattgaagagcagctgatcgactatatccgcaccaccattacccatgcgggcggcattaccggtatgcgtcgtatcgctgattttgcctctttatatcaggtgcgcaccggctcccacggcccgtcggatctgtcgcccatttgccacgctgccgcgctgcatttcgatttgtgggtaccgaactttggcgtacaggaatatatgggttattcggagcaaatgctggaagtcttcccgcataactggacgtttgataacggctatatgcatccgggagataaaccgggccttggcattgagtttgatgaaaaactggcggcgaaatatccctacgatcccgcttatttacctgtcgcgcgactggaagatggcacgctctggaactggtaataaacagataatcgtcagccagggaaggccataatatccaccctacacgaaaggtaattatgtgatggtcagttcagtcgatataaaaagcgatggtgataataccccattaattcggcgtgttgcgtctgcgtctgccattggcaccgcagcagaatattatgatttctttgcctacggcacggcggcggtgctcttttttggacacttattttttccaagcgatgatcctttaatcagtaccctggcggcttttgctacctatgctgtgggatttctggcgcgtccattgggcggcattgtatttggtcatattggcgataaagttggacgcaaaaaggcgcttgtcatcaccatccttattgtggggttagggacattctgtattgggctgctcccgacctacgagaaaatcggtatctgggcacctgtgctgttaattttaatccgtatccttcagggctttggcgtcggaggtgaacaggccggggcggtactgatgacggcagaatattctgctccagagcggcgcggattcttcgccagttgggtgcagatcggcgcgccggtcggttttttattgccgctggcattatttgctatcctgaacgccacgctcactgcagaagccatgatggattacggctggcgtattccattcctgcttagcttactgttggtgatcgtgggactgtttattcgactccgtattgatgagtcgccggtatttgcccaaatccgccaaacgaaggccgaggagtcacgtccgttggttgaggtgatccgcgattaccccggcattgtgacaaaaggcgtctgcgccaaattgatcgaagcctgcacctttgccatgtttaccgttatcgtgctggcctatggcaaggcgaataatctcgacgccaatatcctgatggaaacgatgattgtcgccgttattctggaagtgatcgccattccactgatgggcgcgctgtgcgacaaaataggacgcaagccggtttatattactggtgcattactccaggtcattatgattgtgccgttctttctggctattaatcaggacagtttctggctcacgcagttagtgatgatcattgtactcagcgtcggtcacagtatgtgttatgcgccacaagcctcttatttcccggagttattcccgacacatattcgttgtagcggcatcgcgttaatctggcaaataggttcattaatcggtagcggagtattaggtctggtggcagtgaaaatattacaggttactggtgggcattattacggcctggcagcctacgtcattgtgcttggtattgtgtccattattggccttttgttaatgcccgagacagcaccttccaggcgagacgctgaataccacgaatggcagcaacattaatattccggcaagtcatttatagcgcatttgctgacgaattattcagagagtaatgaccatgaaaagtatcgtgattgaaacacccaataagctgctgattgacgaacgcccgttaccagaacccgcagcgggtgaagtgcgcgtcaaaataaaactggccggtatttgcggctccgacagccatatttaccgtggtcataacccctttgcgaaatacccgcgggtgattggccatgaattcttcggcgtcatcgatgccgtgggcgagggcgttgacgccggacggctgtgcgagcgcgtgtcggtcgacccggtgatcagctgcgggcactgctatccgtgctcggtcggcaagccgaatgtctgtacctcgctggtggtgctgggcgtgcaccgcgacggcggtttcagtgaatatgcggcagtccctgcgaaaaacgcctggccgatcccggataccatcgccgataaacaggcggtgatggttgaaccgttcaccattgcggcgaacgttaccggccagattaatcccggcgagaacgacatcgccctgatctacggcgcaggcccgatggggctgaccaccgtacaggcgctgaaaggcgtctaccgggtgaagcaggttatcgttaccgaccgcatcgaagaacggctggagatggcgaaacgcagcggcgcggatctggtgatcaacaacggcaacgcctcattgcaggatgcgctggatgcacagggcattaagccgaccatcattattgacgccgcctgtcatccgtcgatattgcaggaagccatcggtctggcatcccccgcggcgcgaatcgtgattatgggcttttccagcgaaccttcacaaatcgtgcagcagggcattaccggcaaagagctgtcgatattttcatcgcgcctgaacgcgcacaaattcccggtggtgatcgactggatacgcagggggcttatcgatcctgacaagcttgtcactcatacctttgactatcagcaggttaccgacgccattgacgtgttcgagaaagaccagcggcagtgctgcaaggtcttactgacgttcccgcaataacaacaataaatgcgagtgagtggtacgcatcttactatttcagagatagccattatgacccaagtaaacaatgaaagaacgacgtccgacctggtgaaagccgccgtttctggctggctgggtaccgcgcttgagtttatggatttccagctctactccctcggggcggcgctggtgtttcatgaaatcttcttcccggagcagtcggcggcgatggcgctgatcctggcgatgggaacctatggcgcaggctacgtcgcgcgtattgtcggcgcatttttcttcggcaaaatgggcgaccgcatcgggcgtaaaaaagtgctgttcatcaccatcaccatgatggggatctgtaccacgcttatcggcgtgctgccgacctacgcgcagattggtattttcgcgccggtgctgctggtgacgctgcgtatcattcaggggctgggcgcgggggcggagatctccggcgcgggtaccatgctggcggagtatgcgccgaagggcaaacgcgggatcatctcctcgctggtggcgatgggcaccaactgcggcacgctgagcgccaccgcgatctgggcctttatgttcttcgtgctggatcgggaagaactggtagcctggggctggcgtatcccgttcctcgccagcgtggtggtgatgattttcgccatctggctgcgcatgaatttgaaagaaagtccggtgtttgagcaggttaacgaaggggaaagtattcctgcgaaagtgcaggcatctgaaaccaccctcggggcgatgttcagcagtaaaaccttttggctggcgaccggcctgcgttttggtcaggcaggtaattccgggctgatccagaccttccttgccggttatctggtgcagaccctgctgtttaataagagcatcccgacggacgcgctgatgatcagctcgattctgggctttctcaccatcccgctgctgggctggctgtcggacaagattggccgccgcctgccgtatatcctgctgaatatctcggctattgtgctggcgtacccgatgatttcaatcatcgtggataacagctatacaccgggcgtgatcatggcgtcgattattgtcatccataatttcgcggtgctcggtctgttcgccctggaaaacatcactatggccgagatgttcggctcgcgtaaccgctttacccggatggcgatctccaaagaggctggcggtctggtggcggtaggcttcggcccggtgctggcggggatcttctgtaacatgaccggttcctggtggcccatcgtcgcgatgatgatggtctactcggtgattggtctggtctccgccatcctgatgccggaagtgcgcgaccgtgacctgagcattcgtgaagatgccgcagagaaaagggcgcagcagagcgtggcgggtgtacgtcgtccggtctgactaagcatcgcataaccatgcaggcgctgaatgattaaagcgcctgcattttgatacatttagttaccattctagttggtgtagtcagcaaatcctgtttcaggtcaacattccgctgacgggcatccgtcatcttatggaccagtgtttcatttaataagacgagtctcatccatggaaaacagactgttaaacgcgaaagccacgttaccggcttacgatcgtaatgcgctggtgccgcgcattgtgcacctcggttttggcgcgttccatcgcgcacaccaggcggtgtataccgatattctggccgcagaacaccacagcgactggggctactgcgaggtgaatctgattggcggcgagcagcagatcgccgaccttaacgcgcaggacaagctttataccgtggcggaaatgtccgctgacgcctggaccgcccgcgtcgtcggcgtggtgaaacgcgcgctgcatgcgcaggtcgatggtctggaagccgtgctggcggcactgtgtgagccgcaggtggcgattgtctccctgaccatcaccgaaaaaggctactgccactccccggcgaccgggcaactgatgctcgatcacccatttattgtcgccgatctgcaaaacccgcagcagccgaagtccgcgcccggggtgattgtcgaagcgctggcgcgccgcaaagccgccggtctcaatggcttcaccgtaatgtcctgcgacaacatgccggaaaacggccatgtgatgcgcaatgtgatcaccgcctatgcccgcgcggtggatgcaaatctcgccgactggatcgacactcacgtcactttcccgtccaccatggtggaccgcattgttccggcggtaaccgccgaaaccctggataaaatcgggcagctcaccggtgtgcgcgatccggctggcgtggcctgcgagccgttccgtcagtgggtggtggaagataactttgtggccggacgtccggcgtgggaaaaagccggagccgagctggtggcggatgtgctgccgtttgaggagatgaaactgcgtatgctgaacggcagccactccttcctcgcctggctgggttatctggcgggttatcagcatatcaacgagtgtatggaagatgataattatcgccgggctgcgcacaagctgatgttacaggagcaggccccgacgctgagcgtgcagggtgtggatctggcgcattatgccgacatgctgatcgcccgctacagcaacaccgcgctgcgtcaccgtacctggcagatcgccatggacggcagccagaaactgccgcagcgtatgctggactcggtacgctggcatctggtgcataacagtgacttccggctgctggcgctgggtgtggcgggctggatgcgttacgtcggcggtgtggacgagcaggggcagccgattgaagtctgcgatccgctgctttcggtcattcagcaggcggtgaagggcagtgcagaaggggaagaacgggtgaaagcgctgctgggcatagaggcgattttcggcaacgaactgccccatgaacatgcgtttgtcagtgaagtgaatcgcgcgtaccagttgctgttacgccagggggcgaaagccacggtggcgcagtacgcggcataacgtaaaaagccgggtggcggcgatgccttacccgacctacttattacgattttatcgctcacatgccgggtggcggctgtgccttacccggcctgggttctgaccacgtccacatttctgtaggcccggcaagcgaagcgccgccgggcaccacgtcaaccctttactcttccgtaaaccactcgcggttttcctggcggatcaactgtacggtttcgccgatctcctgcaaatgacgcgtcatcgcccgatccacgccctccacatcctttttctccagcgcggcaaaaatatccagatgctggctgaggagtttttcaggcggcgagacgtgatcaaggctcatgtagcgcacccgatccatggtcgctttaatattttcgatggtgtcccaagccagctggcagtcggcgatctgcgccagtttctgatgaaactcgtcatccagctgaaagaaatcattaagctgcttgcgatctatagcgatgcgctgctgatgcagattctgctcaagctgatagctctggctgtcgttgatcatcgtggccgcgcggcgggcgacggcgcactcaatggcctgacgcacaaaacagccattgcgcacttgctgcatggatattttattcacatagctgccgcgctgcgggcggatctgaataagaccgttttccgccagcttaataaaagcttcgcgcaccggctgacgtgaaacatcaaaacgcaccgagacgtctttttcagacagcggcgttccgggggcgataagacaatgcacaatatcccggcgcagaatgcggtagatttgctggtttacaggctgggttggatttaattgcgtttcagcggccattcgttgtgagttctcagacagttaacccggctaccataccattttttttgcgggcatcccagaaggcgaacgcctccggaacgcccggcaggatcagttgccgtaaaccgcgagcagctctctggccgccagctggccgagtggattggccgcgaacgggctgtcgccggtcagcagatgacgatctttatttacgctgcccttaatatcatcattgatgatattcatccccatcgcttttaattcctcgccaaaataccaggtcagatggccgggcatatagcccatatccggcgtctgtttatcggtggcatccgggaaggcgcagatagaatagccttgcagcggattatcgccgttgcgcagcgacaggaaagccgccgggccatgacacagcgaaatcacgaagcgatcgttgccgatggcccagcgcagggtatcggccaccgcgtcgctttctggcagcccgatcaacgcgccatgacctccagggataaacactgcagcatagtcgctgctcccgttaagtcctttaaccacatcggacagttttgcaggggactggaatctcgcctgatgcttgcggaaaaagggcataatgcacgtatcctgacgcggcatcgcccagtattcaaacttagccatctggcctgaaaccgtcgccacgtcaaattcgaacccggcggcgtgaaggtgccagagcggcaccagcgtttcaactggatgattgcccgtagaaaacaaagcgcccgtgtccgtctttagataacgctcatcggcagcaatcaccaggatctttttgccacccttatgacgagtgggataatcggcatcacttaaatcggaaacctcgctggtaaactcgcccagagaatattctgaggggaaaaaggcattatcttcagcatgatcaatttgtggctgtttacttttatcgttactcatcactcatcctcgctgatatagcatcaattactgtgtgattaattatatgccatgtacaacgatgcagtgaccaggaaaaatccctttaaatataaaagccttatatttactttgtgtgaggatatttcatataaaattcaagggatcaggcgaggtgagtagggaggagtaaataatacatacgccaaaacggcaaccctaatgattaaatcagggtcgccgctactggctgtttcaggataatatgtaactcattaaaaatgcattttcacatttttaatttttacattatatcatgtctgaaacgctattcggattttcttccgccgccatggctgttttgtccgccttttttacctgcttcggaagctttttgctgatcgtttttgaaattcccgccgctatgctggccgcctttgcgacctgcttctgatgccttttctttatcttccgcgaaattaccagaaccgccacgatgttcagtcatatatatttcctctttagataaaataatttgcagtgggaaaaagcacactgcgccatgacaacgctattaaatgtagctcagcctcataaaataacaagcgagaagtccgccagaaatatcacactaagacaattcctataaagatatattctccctggacgataattgcagatgcggtttatagttacataaagagctgtaaaacagggtgttatcgtctggctaaaattacattacagtgaatttacaggtgacgcatgaatatctggtttatacacgctggtggtaaggtaaaagagccattttgcccgttgaggtttggcggccgtatttttttattattacgaagcggcggttcgctatcaaaaccattgatgtggctggaaaaagagaagaaattcttgcgccgcgtataaattatatattctatatttgttcacagaattgtgaggcttcccgtttcgtttagcaggatactggcaggcatattttcactgcaattgtattccgctacatcggggctaagcgaaaaggggttaaacaggaaaaaatatgaaagttcatcatcttaattgtgggtgcatgtgtccggcaggcggcgcgttatttgacggttttagtaagggtatcttcgcccatttggtctgccactgtctgcttatcgaaacggagcgggacgggctggtcctggtcgataccgggttcgggcaaaatgacattcgccagccaggtaaaactttaccaggcttttttcgggtgatgaataatattcagcgacgggaaaccttgacggcgcgttcgcgcattgaagcgctgggattcagcgctgcggatgtccggcacatcattcttacgcatcttgatttcgatcatgcgggtgggcttaccgacttcccgggtgcgcagatccatctgctgcaaaccgaaatcaacacggcgcagcagcggcacagctggctggcccgtgagcgctatcgtccagggcagtggggcggtatctctggctggaacgggtatcaacctcagggcgaaaaatggtatggcttcgaggctgttatggcgctgaaagggctgccgccggaaattttactggttccgctgccgggccacacgcaggggcatgcgggcattgccgtcagccagccgcagggatggttgttgcatggcggcgatgcatggttctatcgcggtgaaatggatctgcaaagcccgcactgtacgcccggcctgcgtttttatcagtggatgatggcgatggataaccagacccggcatcgtacccaacagcaactgcgggaagtattcaaacgttataaccaggaaattactttcttctgcagccatgacgctaaggaactacatgctttcagtgagcatgacgggatgaataaccgagtgtaatattacactataattcatcagggggcgcctcgcccatgtcagtaattttcagggtgaaggatacaggcgcttataaataatgcatttacaggtaatatgtgcagacttaatgtttcaatataaagaaataaggagacgggatatgaatactactctgcaggaatgtatagccgcatgttataaatgtgctgccgcctgtgattactgcgcatcttcgtgccttaatgaacctgatatcgacatgatgagaaactgcattaaaacagatattgagtgttccgcgatttgtcggcttgcggcccaacttatgggcatgaacagcgaatatcacaaacaacaatgcaggctctgtgtggatatttgtcgggcctgtgcagaggagtgcgcaagacatgagcatgaacactgcaaacattgcgcagaagcctgccgccagtgcgcagatgcttgtcttagaatgcttgcctgagcctgaattataccgccgatagctcagcaggaaagagcaactgctttattagcagtgagtccgtggttcaaatcctcgtcggcggatcagcctctgtaggttatatttttaaaaactgattattaaaaaactgattattaatatgtctgctatttcatcctgcttatccattccacacaaaaatccagataggctcgcacgatagcggaagggtgtttatgacgggcataaacaaggtgtaacggcagacaatatttgttgatgtcaggtacaagccgtatcagctctccgctttccagccaggggcgggcagaaaaatccagcagctgggcgatgcccatgccgcccagggcgtaatgaagcaaaccccgggaattattggtggaaaagaacggatcgtatttcactttttccgctcccgaatcccattcaaaaacaccatggttcagactttcccaggccatcaccggcaggcgggccatttctgccagggtctgtggcgtgccgtgacgcgccaggaatgtcgggcttgccacaaacaccgcttccacgtacataacaggtttagcgatcacatcgtctgtatttatttcgcccatgcgcagcgccacatccacgccatcctcaaataaatccacgacccgttcgctggaatgacaaaaaacgttgatatccggatagcgttgctgaaaagcgatcagtaaatcccaccacagtgaaaaatcaggcggcacggacaggcgtaatttgccctgcaacgtatgggcagaggtgaccgccttttgcgcgtcttccagcagttcgacaccgggtcgcgcctgttcatagaattgctgccctttgtaagtgggtttaacgccgtggcgcgagcgttccagaagctgcacgttcagcgcctcctcaagctcattgatcttgcggctcagggtggaaatgggcatgcccattctgtcgctggccgctgaaaagctcccggcattcactaccgtaatgaataattttgctgcgttgtaatccattcttgtttccatatttgggcattatctgtttatttttggtgattccattccattttgcaaagggtaaaattcggactgtgtcattttcaggggatgtaaaaatgaataatcgtgtcactcaaattttaaatattcgctatccacttattcaggccccgttatatttcctgaccaatgccgaactggtcgctgcggtgtcaaatgcgggcggcctgggtacgctggggccgcacgccggtcaggaaagcctgccaggctcacgctgggtggcgctggatcggatgcgcgaagagatccgtaaagtcaaaaaactcaccacaaaaccctttgcggcaaccctgatcaacggcccggatatgggcttctggcggcctactgccgagatgctggctgaagaaggcgtcgaagtggtgcttatcaatgaagtgctggacgcagagatctacgacttttttaaaagccgcggcatcaaaattctctaccgcgccctgacgccgacgatcgccaattcgaaaaaagccgaaaaactgggcgcggacatcatcattgctaccggctttgacgaaggcggcaccgtgccgtcacgggtgattggcaccttcagtatcgtgccgatgatcgtcgacagcgtgaaagtgccggttatcgctgccggtggcatcggtgacgtgcgcggtgtgcgtgccgccctggcgctgggggcggaaggggtatttgcgggcagcctgttcttaacggcggtggaaaaccccgcggcggacaaagtaaaacgcctgattgtcgattccacggcggaagatttgctgctgtttcgcacgctacctgcgtattaccgcaccttacctaccgatctgagtccgacgctggcagaactggacgcgcagggtgccgatcgtgaaaccctgtttaaggctatgaacggctaccactccctgtggcaggccatgcgcctcggtaattttgatcagggcgtggtatccaccggtacgggtatttcggtcatcaaatccattcgtccggccgcagacattgttgccgatctcatgcaggacttttaattaaagaggtaaaccatgtctgatgtaatgccgtttcgggatgttacgcgtgaacggggttacccggacctggagcatcctgccaaccagtaccgcatcgaaaaagcgccgctgggcgaaagcgttacgtttcatcaataagtaacagactcagcagctgccgcagttgctgctgctgagtttcattaagcgtgccctgctgctggggctggggattggcgcgctgtttccgctatcgctgatcgtcacgctcgattacgccatcgcgccgcctcgctggacagcgcctgggccatcatgagcgtcggcatcgtgctggcacggctggcgttgttgtattacggttacaatatcacaaccttagccgcgacagcggaagccaggagtacgccagtgcgcgttttgttcgcccttttattgtcatcgttacttgccggatgcatcacctcatcaccgcaaagagcgctgtataaagcggaatacccgcaccgccaggatattcgtcagcaaaatgtttaccagtttaaaacgacgccgattaaggccagcggcgagcgttactggggcgcgggtgagttaacgcaacttttcagggtcaatgataaagacgcttccaccgttcagcttcgcttcaactatccggcaaaatcactggaagccgtgtcgctggatgcagcaaacagaacgctaagcaaagaaacctttatcttactcgatgagtctgcacccaaaccttccagccctgaaacgaactatttttatctgacaaaagacggccagctggtgcataaaaaccgcaactgcacgcctgacatgagtgtgggttgtcagtggtggaaccacaggctttttatcacacgcaacggagacatggcggtgcattatgaaaatggtagtgctgtgctgctgtttctggttttccccggttacggctcacatgactacctggaaatattctcaaaggtatcgcccgtcgccgacgtcacgccataatttcaaaaatactgtccgcctccggcctgaagcaggctgaggcgggcctcactcataatctgtaactatcgcagcaatacataacgcttccgccggggctgccgataaccgattactccttacattacctggtaaatctgatgcgtatccctgcacttaaacgtttattttccctgaaccgtctgcgttcagccgtttcttataacgcactttgccagaataaacctgtcattgaattcagtccgcaaggggtgatccataaagcgagtccgctttttctctccgcgatgggataccgggctgacgaaattattggtcaacatcatcggttattctgcccgccctcgctggtcaattcgccggagtacgaccagttctggcaacgccttgccaggggggaaagcttcagcggcaaatatctgcgtctggcaaagggggaacgtccggtatggcttgaagccagttatatccccgtcactgaccggcgcggccaggtgacccgtgtcatcaaaatcgcggccgatatttccgcccgcgtgcaggcggcgcttgagcaggaatctgtcgtcaatgccatcagccggtctatggctatcatcgccttcagccctgaagggatggtgctggaagccaacgagaattttctcgccaccaccggttataaacgcgatgaagtgattggtaagcatcatcgtctgttctgttctcagagcctgtataaaagtgatgaataccgccagttctgggagcggttaaatcagggggaattcttttccggtcagttcccgcgcctgaatcgtcgtggcgagccgctgtggttgcgggcaacgtacaaccctgtgttcaaccatgacgggcagctttataaaattgtgaaattcgccaccgatgtcacggcagatgttctgcgcaaccagcgagagcaggaggcggcggtacatgcatgggatatggcggtgcagacccgcggcagtgcgcaggctggcgccggggttatcgaaaacagtatccgaatgattgaccgcattgcgcagggtatgggcgatgtctccagcgatgtttcccggctgaacgatcagtctgacagcatcgacgggatggttgaaaccatccgcagctttgccatgcagacccggcttatcgccctgaatgccgccattgaagcggcgcgggcgggcgcgtccggtcgaagttttgctgttgttgccgcagaagtgcgaacgcttgcggcgagcgtcagccaggcgacagaagacattgagcgggtcgtcgccagcaataatcacctggccaaagaggtgctcagcggcatcgaaaacaacctgatgaatacccgggaaggggtgacgctgatgcgtgaagcgggtgaggtgatcgccagcattcagaagaatgccgccggggtcgagacggcagtgaaggatgtcgccctgtcagtaaaagccggataacgcctaatccgcaccggtgtacggatacgtaaaacatcagttatgcaattgtaataactgctttaattgagcgttgtatccccgggcgggttcttttaacatcgatgatgaaattttaaccccatcccgcaacggctatccagttgttatggaaagatgttcataaggatcaagatcatggaaataagtatccgcacgccgctcatccattctttgccgttaagtcagcacagcggatgtgaggtctggctgaaaatggaatcctcccagccgaccggttcttttaagctcagaagcgcagggcatatctgtcagtattacgcccaaaagggcgctaagggttttatcagttcatcgggcggcaatgccgggatcgccgtagcgcacagcggtcgtaaactgggtttgccggtaacggtcgttgtcccggaaaccacgtcggcgcgcgccagagagcttattgagctggagggcgcgaggctcattgtgcacggaaaggtgtggagtgaagcgaatgagcacgctttatcgctggtaacggatgacattttttatatccatccctttgataatccgctgttgtgggaaggcatcagcaccattgtggatgaagtggtgaatgatggattgcggcctgacgcggtgatcctgtccgtcggcggcggcagtctgctgtccggcatcgcacagggactggaaaaacatcacctggatcatatcccggtgtatgccgtcgaaacccacggcacggcttccctcaacgcctcgctgaatgccggtaagcttgtgcgtcttgataaggtcagcggtattgccactacgctggcggccagccaggtgtgcgaaaatgcctttaccgtggcgcgtcgcctgaatgtcaccggcatggaggtttccgatgaagaagcggtaaacgcctgtcgtcacttccttgatgatcatcgcgtactgacggaaccggcgtgcggcgtttcattgtccctgctgtatgaccgcaaagttcagtttaaccctgcggataaggtgctggttatcgtctgcggcggggcgtcggtgacgcgggaaagtattcaggcctgacggattttgttttcgatacgcacaggctgaatggcagggggtttccattcagcctgtgctgttaaggcctgacactcttagccgcgcgaagcgggcatgtgaatttcctgaattagccctcctgtccttcaaccagcacaaaggtgccggttgcagcaccggctcgtagtaagcgtgcggcctgataccccgggctgtcataaaaacgtttagcctcgtcaaaagagtcgaactcaaaaacaacatgcttttcgtgcgactctccctcaaggttttcatactgcccggaccaggcaataatttttggactgaacccctgcattacctctccggccgcccgggcatattccgcataagcgacaggatcggttacggtcacgtgagcgatgagatagcctttattcatttcttctgttcctcggcaaaaaagcgttacgcgaaatacgcggtgtgaaaagagtctattgagtattaatatcttcataaacaccccaaataatgacgcactgttaccctgagagtgaacaatgaagaaccttgagccgttggtgatttttgcgcgcgtggcagagcttaaaagcttcactcaggccgctgaaagcctggggatccagaaagggcgtgtctcaatggtggttcgcgagctggaacatgaaatcggcgcttcgctgctgcaccggacgacacggaccgtacagctgacggaagacgggcgggctttttattcccgcgcccgtgatctgctgtctgaggcggacgctctgcggtcaatgttcaccgatcccggaatgccattacggggtcggttgcgcgtggatatgcctgctgtgctggcacaaagccttattatcccggccctgccacagttacttgacgctcaccctgaactggaaatagagctttcaagtaccgatcggcgggtcgatctggtgcaggagggatttgactgcgtggtccgtctggggcccgttgtggatgacacgctgattgccaggcctctgggacagttgcgcatgatcaatgcagcaagcccggcctatctggcgcgctgtggtgtcccggagacgatagaggatcttcttagccagaaacaccgaatggttcattacatccggaactttggcgcgaaacccgaagggtgggagtacccgtccggcgatggctataaaacgatcctgctgcctggcgccgtcagggtaaacagtgttccggcctatcatgacgcgggactggccggtctggggctgattcagggaggatactcgtcacttgtcacgcatatcgaacgcggtgcgctgatggaggtgcttcccgatctgcgtcctgagcctctcagcgctgcttttgtcgtcgcacaccgccgcaatctgtcgccgcgtgtcagagcttttatggaatggacggaaggggttttaaaaccttatttcgactgagagctgtgatgagacagggcggatgtgccgccctgtaaaatcatcattcactctctggtaaatcggaacgggtcagtgtcgccctgacctgcggcaggctctgcggataattctgctggataaattcaatcattttttcccgcacgtaacagcgtaaatcaaaggccataggggaattctgcgccgtcatcaacagtctgatggtcatggttttttccgtggtgtcggttacctgaagcacctgagtttcctgatcccagagtcgggtttcactgagcactttttcaaagtgttcgcggagcggctgtaggggcatggagtaatccacataaagaaaaaccgtgcctaaaatttgcgcgttattacgcgtccagttctggaagggattttcggtaaagtaggtgatcggtaataccaaccggcgcagatcccacagacgcaccaccacataggtcaggtttatctcctcaatccagccccactctttttccaccaccacggcgtcatcgatttttatcggttgcgtaaaggctatctggataccggcaaataaattgaccagcgacttctggagcgcaaaaccaatgatgatgcccgccaccccggcaccggccaggatagtggtaccgaattgtcggacgccagggaaactcagtaaaatcagggataaacaaattgtgaccagtaagacaatcgcgaccttcttcacatacatgatctgcgtgcgaattttgcgggcgcgaagattgttcgaaatattaatgtcatagcgtataaaaagcatatcctgcgcaacattaatcagtcgaatcagcaccgaacaaaatgacatgataataaatatgttggttgtcgttctgatgaagttcagtgactcgggctggatatggacataattaatccctacacgaataaacagcaggggaataaagagaaacatcgatccacgaaggtgtttctcaagcgacttgaagagttttctgtcatggttttgccagaaacggataaactgcaaaaggataaatctcgcgagaaaacccaccgcaagagatacagtgacgagcaatacagcaggcacccatgccggagcgccagataactcaccaactaaaaaaggcatgttttccccttatctttgccaacaaatgagtcacgcttgtcatgcacctgtgtgctgacagacgcccattagtatatgaaaaattcagcaaatctcttccgtatgccgggcatcgtattcctgctgagcccgtaccacttccggcccatgtttcagtgcccagtcgtacagcgcactgaagggttcctgtaacgtttttgccaatggggtaagactgtattccacgctcaccggcgacgtgggcagcaccttccggtacaccagcccgttgcgctccagccgcttcagtgcgtcagacaaggccttatgagtaatgccatccagccgacggcggagttcattaaagcgtgcgggttcactgcacagcacggtgagaattaaaatcgaccatttattggtgatgttctccagcaccggccgggtttttccaacttctttcaggttatgaccttcaatctgacacatggcgatatactccgcgatacctggtataaacaaagtgcgtaattgttattaagtataaaaattatatcatctgctttccaccccaaaaggagtaagcagatgcaacaattagagaacaaagtggccctgatcctgggcggcgcaaaaggcattggtcttgccatcagccagcgatttgcccgtgaaggggcaaccacctggttcacttcacgccggagtgaggagttagacatcgccgttgctggcatagaaggcgacgccaggccgctgcgtgctgatgtcagcgaacttagcgaactgacacgcatcgctgacctgattaacgcggagtccggccggatagatgtgctggtgatcaacgccggaatggcggaacacgcgaccattgatgacgtcagcccggcgcactttgatactattttcggtctcaatgtgcgttccccattgtttgcgcttcaggccgcgcttcccctgctgaaagagggggcgagtgtggtgctgataggttcgattgccgatgtcatcggcaccaaaggctatggcgtctacggcgccagcaaagcggcattacgctctttcgcccgcacctggacaaatgagctcgccgcccgggggatacgtatcaatgtggtcgccccgggcccggtggataccgaaatgatgcaggccgcctccgaagagctgcgcaatggaataatcagcgccattccgttatccagaatggcgaagcctgacgaagtggccagcgcggcattgttcctggcgagtgatgaaagcagttatatcgctggcgccgaaatctgtgtggatggcgggctgacgcaggtttaatgaaatccgggtccggctggttgtaaaatggtaaacacgttccgcttctggttcggcgctgccacgcaaaatagggtggcagcgttgagcgagaggcggacatagggtgatcgtcttgcatcaggcactacttgtgagtggattaatctcagccaacagccagctttcaaagcgctccagcgctgcctcatttattcccgtttccgttgttttgactaaacagaatcttttgctcagactatttgatgcaggccatggagaaacaagcatgccgctacgcaattcattctcgatatacatccgcgggagcaaagcaacgccctgtcgtgccatcacggcagcgatggccatttcatgcagatcatatcgcacaccgtgagccggattatcgaggcgtattccgctttcgacggcatagtgatgccatgcatcaggattctgtcgacgatggatcctcggcagttcatttaacagttgattgacattattttttgttatcagtgcaggatggcataccggcagcagattttcctgaaacagaaattgcatacgcattcctgcccatgcggaatgttcaaaatgaataaccgcgtcaaatccacttccaggcaaaataaacggatccgttctggccgcaatatttaacgttatatccggagatacagcgttgaaactgttcaggcgcggaataagccagcgacaggaaaaggtgggcaggacggcaatgtccagactctgactaccttcaggcattcccattatgtactgcgtatcccgttcgagccgatcgagcgtttcccgtacgtgatgcgcatagcgcgtaccgacggggttaagctttacacgactgcccatacggtcaaacaatttaccattcagtaacgcttcaagacgtgcaatctgacggctaatcgccccttccgtcaacgacaactcttctgcagcacgggcaaaactgccgtgccttgcagcggcatcaaaagcctgcagggacgcactactgggtatttttctgcgcataacatcgtttcctttttcaggcccagtattctgccttcattgactaaatgtcactaatccgtgacgttttatcgattttacggggctgaaccatcttgtagcatgatgaaaaatcattaagcaaatgaatctgcttacgcctgtggctcatatggagataaacagatgttttataccgtggaatgttcatataacgatcctgacagcgaggcagaatggaatgccttttatagtcagcaaaaattacccgcgttgatatctgttgctggcttcacgacgtcgcaacgctttcgtgctatcaattccggctgccctgtttaccttgccattcataccattaaagatgcggatattctcaacagtgatgattaccgtttaaaaggaggcggcaatttctctcgatggcaggtctgtattactgactggcaccgtaacctgtacgaaggaaagggcattatcccggccgtatctgccggtgaaattctgctattgagcgcaacgccatcaggcgttttagataaagagttgggatatcgtgggctggaaatgcatgcggtagggctggataaaactcctgaacatcgcgttgcgtatgttctgccggttagcattgcctcgttatttactgaaatcccaggcatgtacctctatgaacctttgaccatgcaattgcaggatacggaataagggaggctaaaacatcatgcccaatctgactttttatattgctgaaaatcaggctgacgtgttgcaacgtgatgatgattttacgcataaatgccgcgccctttgctgtgacatcctgcgcgcagagcctcaaaacgtgcatatcatttttattgccgtaaagcctggatgcggacaaccggtctatgcccagctcttttatcgcctgacaacattacgaacccaggacgtgatggagaactttatgagggaactggacgctgccattcaacaggcctctggtctgacgccccgtattcgttgttttggttccccagcagaacagatatttgcacgcaactgatcccgaggtaaaaatgaaccaaccctttccgagccgtgagactggagattttcaaattacggcgctaagcgacggcattatgtcagccagtctggatttgctctcaggcatagaaaaagcggaggcagaccttattcaacgcaatgcgggtatcaatgagcccggcgatattcatataaactgttacctaatccgtggtcggggacgcatcattttggttgacgctggcgccgggatgcctggcaatatgcaactcacagcaaacctcgccgcagcaggtgtcagccctgacgacattgataccgtgttgctgacacattgccatccggatcatattggcggcctgctggatcctgaaaaaaagccggtttttaaacatgccgaaattatgcttcatcctctcgaagcacagcactggctggatgataagaaactcgaaatagcgaatgagcgcgggcaacgtaatatccggctggtccgccagacattagacgcttatgcccataacgtgcatttttttaacggggataaaattgcaggaagtattctgcccgtttggctaccaggccatacaccgggacatacaggttttcgcatcgatacggatgataaatgcttattaatatggggagacattgtccattatccgcatattcaatcagcacaaccggctgtttctattttattcgacactgatcccatccaggcagagcaaacaaggaagatgattcttgaaaaggctgtcagcgaaaaactgctcattgctggtatgcatttaggtcaggcagggtttgcacacgttctcagggagggtaatggataccgcatttcctgtactgacaaatgaagggatgtatctgttcggagggttattgattccctcaatacaacgttattattgtctgcggctcagaaactgagagaggaagaccctctctcttttcccgtatcacgcctttgcccgccgcaatcactcgcaaaaaggggaacgctgctgcgccgcggagagaagctgcatcgcatcttcaccggccgcggtgtagagcggagcgttttgattttcagccacggcataaatagcgttcgccacatcttccgcgtgcgtcactggcgcgtggggatcgcccgcccgctggataaattcattcaccaggcttccatagaccgcatcgtcccgcccgccagagtaagcccgcgcattttcaccaaacttcgtttccggcgagcgccccggtaatacaacgtgaacgcggatcccaaaaggcttcacttcgacggctaatgactcgctccaggcattcagcgccgctttactggcgcgataaaccccaatcagcggcatcgctttggtggtcacggacgaagacacgttgatgatcgtccctaattttttctctctcatcaacggcagaaacgcctgcgttaatgccagcgtgcccagcacattgatgttcattaattgctgcgcggtggagagggacgtcagttcaacgggaaccgccgcgccaagaccggcattattgaccagcacgtcaatcgcgcctgcctgtttcaccaccccggtaatactttccgcagaggtgatgtccagtggcaatatccgcagccggtcgctggcaggaaaaagcgtcgtatccagcgttctcatggtggcaatcacgtgccagcctttggctaaaaacagctgtgctgttgccagcccaaaacctgaagagcatccggtaatcagtgcagtcgacatggtaaatcctcgctgttggtcagagaagccatgatagtcgtagccatccggacaatatataatcagaaatccacttttcttgagagagagtccagtgtcagatccgttaaccgatattgttgctttactcaaccccaggcccacccataccaaactcgtcgagggggcagggaagtggcgtattgtccgggagtctgccggagaggcgttttactgcgccgtgttgcagggggaatgcctgatgagtattaacggtaaagcgccgacattgcttgttgccggtgatttcgtgctgatccctgcaacttatacctttgagaacaccagtgcgggaacgtctcctcctgaagacattacgctgccgaccctgctcggggacgggcacgtgaggatcggttcagcaaccggggatgctgaatttctcatgaatgtcgggcactgtgaattcgatacgccggacaaacagcttatcgtcgcgttacttcccaacgagatcctgatcaaagggcaacgtcgtttcgtcaccctgttcgatctcctgctggatgagagccgcacccggcgaccggggcgggatgcggtactgatgcatcttttgcaactgttgctggtggaagcgttgcgtagcgatccagcactgtcgacgacggcagggatcctgaaagggttacagcacgataagatcgccaccgcgctgcatctcatccataccaaccccggtgcggactggcaaatcgcgcagctcgcccgggagtgcgcgatgtcccgctcctcttttttcgccgtattcagcgagaccgtcggcatgtctccggggcaatatctgctgttctggcgaatgtcgttagccaggaaagcgctgatgggcggcaaggataaaatagaacagatcgccctgcgtacaggataccagtctgccagcgccttccacgtcgccttcacccgctacaccggcctgccgccgggggaattccgacgccagcatgtggctaatgcgtcctgaagcgcgctgaacgtgacccgttcaaatgctcacaacttaagtgcggcgacgatggcggcttccattttctgcggcgtggtgaagggggcgaaacgcttaagcggtttgccgtcgcgcccgatcaggaatttagtaaagttccatttaatgcgcttgcccggcaggccgggcagtgcgtctttcaggtaacgaaacaccgggtgcgcggcggcaccgttgacttccactttctcaaacatcgggaagctcacgccgtagttgatgtggcaggtctgagcgatgtcgtcggccccgcctggctcctgtttaccgaactggttgcaggggaaacccagcactaccagcccctgcgcaccgtactttttgtagagcatttcaaggccagcgtactgcggcgtgaaaccacacttactggccgtattcaccaccagcaccagctttcccgcatagtcggccattgagaaaggctcgccgcgcaggctggtggcggtgagttggtaaaaggtggtcatggtggaagcctcgatggagaaaattttatggggtagtggttacaggactggactttatcatgactgcttctggcacaaagcgaactataaacgatttatgtcacaatgagcaaaacagaccttaacctaacatcaattagtaattgataactggatacagcaaatgaatattgaattaaaagggcttagatcgctagaacttgaagataggttgataaactattggccaactgaccctgccagtttcggttgttggatcagagcaatgatagggcctaaagaccgtgacggtgctgaagcttttgatatgttggtatgtacgccagtctggcttaaacaagagcttgcatcatataagtccctgtctggcagaggaatgatcattgtcgaagaatatgattatgatgagatcctttcttatatagaaaaaaagatcattgtctgtaatgacaaggactggtcaaaagccgccatcaaactgagccgtttcagtttctgggaatatgaagattatcagccataagccaaatccagtgaatgacttatgacaaatattaagatacggcagaaagtagagcgcgagagccctgacgagcattccattcctcacgggtgatttcccagagttcggaatcaagcagaccgctgacatactctttcttttcagtcctgatgagccgcatgccactgctttctgaaataatttttgaacggctatttagagccgctttaggtgcacgcaacactgtcttatttaacgaattaaaccaatgatccgtagctgcattactggcctctcgcataaagccctggccctgatgctccggagctaaccaaaatccacggttattatcctcaacatcatacagacagattacacccatcagtttgtctggtgtttcaaggtgtctgatagtccagaaccaggctatcccatttgccatatcaggcaaagcaacgttattgacgtaactctcggcaccgttatcagggtagggccatggtactgaagagaccatgtagcgaactatctcccaacgcgggtaaagcaactgaatttgtgaggcatcttcggaggctaatggttttaacagcaagcgttctgtatagagtattggtattggcatacgtacttttccttgctgagcttgatatctatttctgtattacccgttcagtagcagtctcactttagctggatgtataagcggtcatcagatctgtacggctgtataatttatctgcttctgcgcgcactgatcttcttttgccatgctccagtcgaccgggtcaaccctaaatatggtggtagtgcaccctggcttcattgcgttagattgtccgcattataaggatcacaaaaatgaagctctttatggaaattattttgatgcgtcatggaaagccgtcttttacaggttcttcgagggtgacgagtctcgagatggacaaatggatttcacaatatgatctctccgatacgggcagcgatatggccccgcaatccagtaaatcattagcatccagcgcattgcacatcataagtagtcctcttcccagagcgctttcatctgtgagggcattagggcgtgaaccggacctcattgatgaggtcttcagggaagcagacttgcccgtattacgcatgccagcattcaggttatcccccatcttgtgggcgtctcttttccgcgtcatgtggctttgtggcttctcccgtaatgtagagaccctgagcctggctaaacagcgcgccgttcaggctgcgcatatcctcgtaacatcagcagaagaatcaaacgggcccgtactgcttatggggcatggggtgatgaatcgactgattgcaaaggaactcatctcgttgggctggaaagagggccatcgacagggcaatggttactggaacgctcgcacctacagcttacgttaagtaaagatctcaattacacatctgataatccctcaatgattttttgctaaacccttctttcagcctggcccggtttgtcaggggtaaaataaaaaggactacactcatgcgtaccgcaaaaatccgcgccatcctcggtggggctcttttattattgtcagttttagcctccgcgtccgcaacgcagactatgtccataccttcagagcatccgaacccgcagcgtatttctgtacagacgcaaggctcagggccggatgtcatattgatcccggggctggcgtcctctcgcgacatttgggccggtttagtcgcaactttacgtaaaaaccaccgtgttcatcttgtagaacttgcgggctttgcaggtacgcctgccatatccagtccacggggaaaagtcatcgtttcggcagttgacgccatcgctgattacattcaaagccagaacatccaggcaccagcgatcattggccattctcttggcggcgagatggcattgatgctgggggcccgtcatcctgaccaggtcggtcgtttgatgatcgtcgatgccttgccgttctatacgttgatgattgaccctgcggcgaccaccgaaacggctgcccggcatgccgcagctatgcgggatttgctactgcggcagtcgccggagcaactcacagagtttcagaaagcatccataaaccgtttagtgaagaacggggcggtgaaacctgctttggtgactgcggcgatcaattctgatcgcaaaactgttgcggatgccgtttatgaattgatgattaccgacctgcgtcccgagctcgctcgcatcaaagcaccgattgagatcgtatacgcgtatgatgtcttatacgggatcccggcagcctgcgtggatgcgatgtaccgtcaagcctacgcttctgcttccgacatccatttcacgcggatcgatgacagttttcactttgtcatgctggatcagccagaacgattttccaatgcggttgagtcatttttaaacaaataaaggatgctgctgcacatcaggttgacgctggagcagtatcttaagtccggccagcaaacatagctggcctgaacatcaggtcagcacgctgtatgtcctgacatagctaagtctgtgcagtgtccgcttctggcacaaagcggacaggatggctgggctaaaggtctgcttagagcgaggagcggaagtttgcaatcgagtcggcacatggataataagttttgctgtgtattaaagaaaagggagcatgtcatcgcgattagaaatgacggctgacagctttccatttctctacgctcattcagactcgcaatgttgctttcgatgacaggataagcgtacagccgcttgtttaatctgttcgatcacctctgccctgaactcctgatgcacataggttgctctgggatgagcaatcctgaagcaggtcgcattcccagcctcaaacttccatatttttttaggagtgacagatagggtcttagagccgcccaaatatttattcgataaacattttataaaatggtcggttcgtgaaccacatgcaaatattacaaaatcaggttttaaataccctatctgggtagccagaagtcttaatgaaacagacgctatttcctgaagttcgttttcagagcggagcagtgggctctttcggtcataatcccatgcaaataaatttgcatacactattgccttagggggtaattctagttttcgcgccagcaagaaataatactgcataaaacggcttcgtgatttcgtattaggagtgcacttatcctgatgctctttgtagcgagttaccgcttcttcaactacatgttcgacattaatattgggcatcagacccagaacccgagcaattttatttttatgatttccagtattccatcctgccgtttcacgcccaaccagcatgatttttaccggggagcgccagtactcttcagagggaacaggaagaaatacacctgaatatttatcctccatgagtgcaaatgattgagcgttaagacttttaaggatttctatatacgttttgatcagagcttccatacttttacctgtacctgacatcatgatgaattttcttttggcatcttactaaacttcaggcaatgcgattaatgaaatgtccgcctctggcataaagcggacatgatctcagcttagcagggcgcgaaaacgttaccctgtcacttcctcaataactttcacgccatcctctgtgcggatccagcgcggcgcattaatttcctccgccagatacgccatcacatccgccagcagccagcgcagcggttcttcctgttgtggcggcacgctgcggcaaagtaatacctgagccagcgctgcgcagtattcgccgagcgtatcggaatcgggagcaaactgaggtacgtgagtgggcaggctgtccacagtaaaacgcgcctgctgttccggcgggatcggctcgttcagctggggtttgagcagggcaaacacggcagaaaagcgtccgcacaacgccattcgcagcgccggatcgaggctttccgcctgggcttcggcgagctggtggcagtggtcggcaagaatagtgaaatcggtgtcggcatcaaacgggatggtaagtaacgggtgagtctggttgagggtcgtagccataagggcagcctcctgtaacgggtttaaaacccaccacctgaggttccaatctcatggtgatggactgaacggggttggaactaccggcgttacaggcaaccggcgcaccttacggtgcccccgtccagcccaccattgaggtgtaactgagcgcacgacatatgaaagacgctaacgcgtcgtatgtcgcctgtaacatttcgcagggttccaatcccggcacctgattttgcaggtgcgggcgaaagataccgttttcagcggaaaacggcaagacggcggcgtgatggaggcggttcgaatgaataaaatgcataccggctcgcagcaatatgaaagtggtctgaaaggttgagcgcttaaacggccttaacaatcccctaaagaaagccatcccatcctttttcaccaacggcctggatgccggtctcgtccagtcgctcgtctgctgcaatcatctgaataaaggttcttgacccttgaccgacggttcatcacttgcggcatcaaaataagtcgccagtaaaaactggcgatggattatgtttttttaatcaatatttttaagctagtggttctatggatatctttctatcgcccccaaatgaactttttaataattgtgctcgtggatatcttttaattagtgacatgacttcatcgagttcagcgggttcaaataaagggccaagtatcactgatttcacttcataaggatgaaacttcaggtcgctatagtgccccatgctcatcggtctggcataagtagaaatcctccactccttttcgtatgcccaatcttctgtttttatgaatgttatctcagtattaatatattcaagtgctttgttgtctggcttgaaaagcaactcagccataccttcaggcgtgtaagttagaggtattttattagtatacttaataggttttgcaattagccaggcgctgccaagaacgtctaggcaatcaaattcgataactatgcctttatatccatcagcataatggttccacatcggagtgattataggactctcagataagcacaaaattcttctttcattgagcattcctttccacacatctttcatttcttgtattgccgcaggggcgccaagtccgactggtggagcatctactaattcttgaaacttattaatcagttctgctggtatgcctaaaggaaagagtttttggtaaacatctaacagcgttctaattcttggatttaaattttggatgtcttccctaggattaatcaactcctcgatcaccttgcgaactaaagctttaccaatatttatctcatcaactcctagcatgacttctcttggaacatcaaaaggatcattaaatatgaccggagaactccatctaaggctacatgaatcaagtacaatctttgcagtattcaacgtcatgtacttataaaatgttgagcgttcatgcattctgtgaggtgagcgcataaattcctctttttaaatgtataatggctttcatcagtgtattgccagttatattgcatccaaacattttccatttcaattctatagctaaaactcaatcaaataattcacctcttttcgtatttgacgtaggtggccaaatcacgtgatgggtaatcaggttttctcatagaggatctcttctttttcaggggactaaacgcagtatagatacctgatgggaaagccgcctgtgacgctattaccatctggtcactcgttgttaacccggcactgctgagttaagcttaccggatgacgaaaaaagaaaacgaccacgccacgcgcggcacggcggaccacagcgtccgcgatcaggtggtggatgccgccaccgaacatttcagccactatggttatgagaaaaccacggtgtccgatctcgcccgcgccatcggcttttccaaagcctacatctataaattcttcgattccaaacaggccatcggggaagtgatctgccgcaaccggctggcgatgatcatggagatcgtcactgccgccattgccgacgcgcccacggcgtcggaaaagtttcgccgtctgttccgggcgttagcggaagcgggcagcgatctctttttccatgaccgcaaactttacgacatcgccgccgtcgccacgcgcgatcagtgggcatccacccgcgcctatgaagaacagcttaaacagttgattcaggaagtgctggtggaagggcgtaagtcaggggagtttgagcgcaaaacgccgctggatgaaaccgcgcaggcgatctatctggtgatgaagccgtatatcagtcccgtgcagttacagtacaaccttgaggatgccccgacggcggcggtactgctgtcgtccctcatcctgcgcagtctggctccttagcacagagaaaatagccccggctggcgccggggtcttcatatcagccgcggtgcacgctcaggcctgcaaaggtctggcttaccggcatcatttccagtgtgttgatgttgacgtgcttcggcagcgtcgccacccaccagaccgcttcggtaacatcttccggcgtcagggcggtggtgttctcgtaggtttttccggctttgtcgtcgtcgcctttgaaacgcacgttagagaattcggtgccgcccaccagccccggctcgatattggtgacgcgcacgccggtgccgtgcagatcggtacgcaggttcaggctgaactgctgtacaaaggctttggtcgcgccatagacgttgccgcccgcgtacggccagctgcccgccgttgaaccgatgttgatcacatgaccgcgattgcgcgccaccatgcccggcagcacggcgcgggtcatgtacaccaggcctttgttattggtgtcgatcatggtttcccagtcctcgacgctcgccttgtgcgccggctccatgcccagcgccagaccggcgttattcaccagcacgtcgatgtcgcgccattcagccggtaaattccccatcgcctgctcgatggcggcgcggttgcgcacgtccagttgcagcgtcagcacgttgtcgcccagttcgtctttcagcgcctgtaagcgctcctggcgacggccagtggcgatcactttatggccgttcttcacaaagcgacgtgtaataccttcaccaaaacccgcagttgccccggttactaaaataatcatctctctgttccttaacgctttttgtgttgccttagcatagttgcgcagcggcccggtggcaacgcataccgggcgagttagtagtgtggcaaataatctggtcccgtgacggggggatttggtactgtagaaaccgatcaacggttcaggggagtaaacatgtccgtcaccaatccactgtttgaacagagcacgctgccgtatcaggccccgcgtttcgatgcgctgcacgacagccattaccggcccgcctttgacgaggggatgcgccagaaacgcgcggaaatagccgccattgccggtcagagcgacgcgccggactttgccaataccgtcctggcgctggagcagagcggggagttgctgtcgcgcgtcaccagcatctttttcgccatgacctcggcgcataccaacgacgaactgcaactgctggatgaagccttctcggcggaactcgccgggctggcgaatgacatctaccttgatgacgcgctctttgcgcgggtggaagcggtgtataacgcgcgggacaccgccgggctggacgacgagtcccgccgcctgctggaggtcacgtaccagcgctttattctcgcgggcgcaaaactgcctgctgtcgataagcagacgctgaaagcgctcaacaccgaagcggcgcagctcaccagccgctttaatcagcatctgctggccgccggaaaagccgcagcgctggtggtggagagcgccggagagctcgacggtctgacagaggatgaaatcgcccgggcgcgggcagcagcagaggagagaggcctgcacgaccgctggctgatcccgctgctgaacaccacccagcaacccgcccttgcggcgctgcgtaaccgccagacccgtgaaaaactctttaccgcaggctggctgcgtacccagcgcggcgatgaaaacgacacccggcagattgtgctgcgtttaacgcagatccgcgcccgccaggcgcagctgctgggctttgaggattacgcttcctggaagatcgccgatcagatggcacataccccggctgccgcgctgcgctttatgcgggatattgcacccgccgcgcgcgcccgtgccgaaaaggaactggcggatattcagcaggcgatcgacgggcagcagggcggctttaccgcccgcgcctgggactgggccttctatggcgaacaggtgcgccaggcgaaatacgccatcgatgaaagccagatcaaaccctactttgcgctgaataacgtgctggtggacggcgtgttctggacggcgagccagctgtttggtctcacctttaccgagcgcgctgatattccggtctatcatccggacgtacgggtctgggagattttcgatgaggacggcaccggactggcgctgttttacggcgatttcttcgcccgcgattcgaaaagcggcggcgcgtggatgggcaactttgtggagcagtcgaccttaaacggcacccgcccggtgatctacaacgtctgtaactaccagaagcctgctgccgggcagcccgcgctcatctcctgggacgatgtgatcaccctgttccatgagttcggccatacgctgcacggcctgtttgccagccagcgctacgccacgctatcgggcaccaacacgccgcgggattttgtcgaattcccgtcgcagatcaacgagcactgggccagccacccggaggtgttcgcccgttacgcccgtcattatcagaccggcgagccaatgccggaggcgctgcgcgaaaaaatgttcagcgccacgctgtttaataaaggctacgacatgacggagctgttaagcgccgcgctgctggatatgaactggcaccgcatcagcgcggatgccgacatcagcgacgtcgacacctttgaaactgaggccattaaacaggaaaacctcgatctggaggcggtgccgccgcgttatcgcagcagctatttcgcgcatatttttggcggcggctatgccgctggctattacgcctatctgtggacgcagatgctggccgatgatggctatcagtggtttgtggagcagggcggattacgcccggagaacgggcgacgcttccgggcggcgatcctgtcgcgggggaacagcagtgatttagcggcgctctatcgtgaatggcgcggacatgatccgctgccggaaccgatgcttaaaaatcgcggactgagtcagtagcggctgacggtgataagaagcccttgttgaaaaacaagggcattgtcagtatttcatcagctcgccatcttacgcgctttgcgctttcgtggtatgcaggagcttgcggttaaacgtgtaccacaagttgaacaaattgcgccgtgtggatggagtttttccgggtcgaaggtcgtgaaaataaagctatttccatgacatattgggcaaagaaatttgagattgtaaataatccctcacgccagtcaggtggaagacaaacgctaacataaattcctcatcctgaaggatatatcttcatttttgtataaaaaacaagcgtgaatttttaaacagatcttcctcgtttacgctttgttgaatcaggtactgttaaggtcttatcgatccgtgacccgacagctaaatggcgggggtgcgcataaataaaataacgatcctatccatgcaagcatttccgccagcgtaactggcggattttttttgcctgtaaatcacccggcgctgcgggtcagaatggctttgcggtaatcgccgggggaaatggcaaactgcgcgcggaaatgatggcgcagggaggccgcgctgccaaaaccggtctgctgcgcgatctcgtcaatgcgtaacctggagttcgccagagactcccgggcgcgcagcagccgctcgttgaggatccagcgcgcgggcgtggtgccggtggcatcggcgaagcgccgtaaaaaggtgcgcggactcatgcctgcctgacgggcaagggcagccacgctgtgattctccgccagcgactgatgcagaaaatcaaagatcattcccagggatttactctcccgcgcccgcgctaccggacgcaccacctgctgggtttgcgccccgtcgcggtgcggctgcaccaccagcctgcgggcgacgttgttggcgatctccgcgccaaaatcttcgcgcaccacgtgcagacataaatcgatccccgccgcgctgcccgccgaggtcagcagcgtgccttcatcataatagagcgcgtcatccagcacctgaatggcgggataacggctgcgtaacagcggggtgtagcgccagtgggtggtggccctgcgcccgttcagcaagccggtggcggcaagcacaaacaccccggaacagatggtcataatgcggcagccgcgcgtactggccgcgcgcagggcatcgcacagcgcttccggcaccggcgtgtccgcgccgcgccagccgggaatgacgatggtatccgcctgcgccagcagatccagcccgccatcggccatgatgcgaatgccgccggtggcgcgcagttcaccctcgtccaccgccgccacggcaaagcggtaccagttatcccccagctccgggcgcggcagaccaaaaatttccaccgccacgccgaattcaaaggtgcataaaccatcgtaggcgagggcgacgacgaacggacggggcgatgcgggaggtaattttgtcatgatcctggcgttttctggcagaccggcaggcagtggcgcggcgaattaatggatacagtagtgttatcacaaacccggagaaaacacgatgagctatgtaaccgaattccctgccgccacgccggaagaaacccgcctgcattttctgcatcgcctgagcgtggaaaccgactgcgccgatgtccatcacgccatcaccactggcgatcaggattttgtgctgctgcacgtggtggggagcgcggcaacgttcgcccgccgtcatctgcccggcgcgatccatttacctcatgcgcaaatgaccgccgaacggatgcaggcgtggcccgacggcaccctgtttgtggtgtactgtgccgggccacactgcaacggagccgatcgcgccgcgttaaaactcgccacccttggcctgccggtaaaaatcatgattggcggcattaccggctgggaggatgagggctatgcctttgcgcagggggatgactgaatccctgcgatgaaggattaaatctgcgccgcgccgccgtccacgaacagctcgctgccgttgacgaagctgctgtcgtccgaggcgaggaacagggcggcggcggccacttcggatggttccgccagacgacccagcggcgtagtggcctcaacctcattaatcatctgctgattcgcggcatcatccggcgacaggttatgccagcctggcgtggaggtggagccgggcaccagcacattgacgcggattttgcgcggcgccagttcgaggatccagccgcgggcaaaggtgcgcagcgcggctttgctggcgctgtacacgctaaatgccggaatgccggtggtggcgctggtggagccggtgaggataatcgacccgccgtctttcagcagcggcagcgctttctgcacggtgaacagcgtgcctttgacgttggtgtcaaaaatgcgggcgtaatgctcttcggtgatttcccccagcggcgcgaaatccccgccgcctgcgttggcgaacagcacgtcgatctgccccgcctgctgacggacctggtcaaacaggttgtcgagatccgccatctttgagatatcacacggaatacccaccgcgccatgcccaatctccgcaaccgcactctccagttcgctgacccgacgcccggtcaggaataaacgcgcgccttcctgtgcaaagcgtttcgccgaggccagaccgatcccgctgttcgcacccgtaataacgacgactttatctgcaagcttacccatgatgtttctccgcaactctgtgtgagaaagcagtgtaagcacagactttcctgtatactagtacctaccaaaaggtatgtatggagaaaattatggagccggtctgcggccttgatgtggccctgcattacattggcggcaagtggaaaccgctgttgctgttttacgtgcagtacagcccgcgtcgtttcggggaatttaaacggctggtggagggcatcagcgagaaagttctgatccagcagctcaaagcgatgacggaagacggcatcatcacgcgtcacgatttccgcgaggtaccgccgcgggtggagtacagcatcaccgattttggccgttcgctggcgcaggcgttgcagccgctgtgtgagtggggcacccgtaaccgggaaaacatggccgacaggacggcgacggcggcgttaacggaagaaagatgaatttttttcatcatgcgtgagcttttctcatttgctatcccgaacaggatatgacatcttttttggatgtttagccgtccagaaggctataaattcaaataatgaactatcacgccagggtattacttttcactggcggcaaggagataagcatgcaacaacacgccccgtaccgcgccgatgtcgtcggcagttttttacgcccggacgccattaaacaggcgcgaatccagtttgcgcgcggtgaaatcgacgccgtgcagctgcgcgccgtggaagacgacgctatccgccaggtggtggaacagcagtgcgcctgtggcctgcatgtggtgaccgacggcgagttccgtcgcgcctggtggcatttcgacttctttgatggtctgaacggcgtggagcgttacgattctgagcagggcattcagttcaatggcgtgcagaccaaagcccacagcgtgcgcgtgaccggcaagctgagcttcggcgatcaccccatgctggaagacttccgctatctgcaaagcatcagcggcaatgcgcagccgaaaatgaccattcccagcccgagcgtgctgcacttccgcggcgggcgtaaagccatagacgcgacggtatacccgacgctggaccgctactttgacgatctggcgaccacctggcgcgatgccatccgcgcgttttatgacgcgggctgccgttatctgcaactggatgacaccgtctgggcctacctgtgctctgacgagcagcgtcagcagatccgcgagcgcggcgacgatccggacgaactggcgcagatttatgcccgcgtgctgaataaggcgctggaaggcaagccggacgatctgaccatcggcctgcatgtctgccgcggcaatttccgctcgacatggatttcggaaggcggctacgagccggtggcggaagtgctgttcggcacggtgaatgtcgatgcgttcttcctcgaatacgataacgaccgctccggcgattttgccccgctgcgccatgtgcgtcctggcaaacagcaggtggtgctggggctgatcaccaccaagaatggcgagctggaaaacccggaaggtattaaggcgcgtttgcaggaagcggcgcagtatgtggatatcaatcagatctgcttaagcccgcagtgcggctttgcgtcaaccgaagagggcaactctctcacggaagcgcagcagtgggataaagtccgtcttgtcaccgccattgccgatgaagtgtggtaagtgacagtgtaacgtattagttgcccggcggcgcgttgcttgccgggcctacagggggataatcattatcaccgtaggccgggtaaggcgaagccgccacccggcatttaaccccacccggcatcacgctttacaccgccaccttttccttcacgtcctgccatgggctgacccgcatccccagcagcatcatcagccaggccagcacaatcaccaccatcaggatcacaaacagcgaccagcccggcagattcgtcaggatcaccccggtggccagtgggtttaacgccgcgcccagccagcctaacgcctgggcagagaagtagctggatttcatacccgcaggcgcgatgttatcgatcaacaggtattcccccggcgcatagataatctcgccgacggtaaaaatcgccgaggctacgccccagaaccacaaattgctgcccgcgagcataaagcccgccagccccaccacaaaaaacagcgtcccggcggccattaacggctggatattgcgggcgttgatactgcggcccagcgcatattgcaggctgaccaccatcgcggcattcaccgacagcaccaccgccaccactttctcggcgaaattgttatccgccacgctcatcacgtactgggaaatacaggtggcgaaggaaccggcgacaaatgaggccagaaaaccggaaagggtgaaccacagcagcgccttatcccgcagcagcaccgacggcgaccaggcaacgctctcctcgccgcgcatagtgatgggaatgcgctgcacaaacagctgaataaacaccagcgggaaggcggcgcaggctgccgccagccagaacggcaggttgacgctctgcatcaccagcagcgtgccgaggggcggccccacggtccagccgatattcagcaccgtatagttgagggagaatatcttcgctttcgccgacggcgtcagggtgtccgagaaataggccttcagcacggtggagaacaccgaataggcgcagttgatcagcgcaaacagcgccaccaccacgatgacgttattactgagcgggatcgccgagaagccgataatgaagcaggcgatggcgatcaccatatagcgctttttgtcgaatttatccgccagaataccaaaaccgaggctgaaaaagacgccgatggtgagggcaatactcagggcataacctactgcatccaccgtcatgccgtactgacggctgagatagatcgtcataaagggcaacgtggcaccgcgaccaatggtcagcagtaacgaggaggcgagtagtgcgagggtggaacgggtttgtgttgggatcatatgcttgcctgacatcacattaattatcgttatttgctatgacttacagcaataacatgcagatccgggcttgtatagctaccggtttgttctggaatgcgaaaactgacctgccataatttgggatctgcctctgtacattcttttacgttaacgttacttttttacataaatttaaaaacatcggggcaatgatgacgcgtaaagatagtctgctggcgttgctggtcgtggtggtgtggggactgaatttcgtcgtcatcaaacttggactgcacaatatgcccccgctgatgctggcgggattacgattcgtgctggtggcctttccggcgttgctggtggtgtcacggccaaaaatcccgatgcgtctgctgttcggctacgggctgaccatcagcttcgggcagtttgcctttctgttctgcgccattaacttcgggatgcccgccgggctggcgtcgctggtgctgcaggcgcaggcgttctttaccatcattctcggcgcctgcgtgttcggcgagcgcttacaggcgaagcaggtgatcggcattacgctggcggtgttcggcgtgctggtgctggcgcaggcgagcctcaacggtcagcatgtggcgctgcttggctttctgctgacgctggcggcggcgctgagctgggcctgcggcaatattttcaacaagatgatcatgcagctgccggtgcgcccgtcggtgatgtcgctggtggtgtggagcgcgctgatccccatcgtgccctttatggtggcgtcgctgattttcgacggtccggctgtgatggtacaaagcctggtgaatatcgatctcgtcaccgtcttttcgctgctctatctggcctttgtggcgaccattatcggctacggcatctggggtacgctgctcgggcgctatgaaacctggcgtgttgcgccgctgtctttgctggtgccggtgttcggtatgggcagcgcggcgttattgctgggtgaaaccctgacgctgttacagctggtcggggcggcgctgattatggcggggctgtatatcaatatctttggcgtgcgtttccgtaaagcgctgccggtcagataaaaaaaagccccgccggagcggggcaaagcgaaattagccgtgccggttgtaataaggcacgcctaattcgtcggatttgtcgctgccggttcccatatgattaaagtcgaaaggcgactggtcgtgggccgacggcatgatcatcgcgtcgcggtcactgggcgcggcaggatgacgggactgctccgcatagctctgggcgcttaccagcatcagagcggtgagggcggcggagacgataattttcatgatttcctcgatacgtctaaaacaggcgtttctcaattacagtgattaataggcagcagataccgggtttcgccgtgcataccggtggtacggtatttgtgcggcggcacgtcaaagtagttcttgaaagtgcgcgtcagcgtctgctgtgactcaaagccataacgctcggccagatagaggattggctcgttgctctgcttgagcttttgcgcaatttcagtaagtttgcggctgcggatgtattgacctaatgaatggccagtttcttttttgaacatccgttgcaggtgccacttcgagtaacctgaacgctcggaaaccttctccagcgacagcggggattccaggttatcttcaatccagtccaaaatgctatgaatagtgatcgcgtcattattgcgtctggacatcgtcatacctcgttgttttacggcagtacttttttgagtaaatactcaagagttgccacttcgtctgccgttaagttttttgttagttcctgatgcaggtcttgtcctaataactgatggccgcgctcgcacagcgccgcgccatcggtggtcaaccgaatcagtacgccgcgcttatcgtgcgggtttggcgtacgttcgatccagtctttgcataccagacgatccagcatgcgggtcagggcgcccagatcgacagaaagcacttttttcagttccaccggcgtaatgcagccggcgcagcgaattgaacaaagcactttaaactgcgtcgcggtaatatccagcggcgacaggtaatcgttaagcaggcgatcttttttctggttaaccatatgaataagacggccaagtgggatgatttcgttaaacaagtcacttgtgttattcacgatggttgccccggcaagtaagtaatcacggcggatattattgccggggcaagtataagtcaactgaatgaatcgccgaatgccacgaattgctaaaacgtttcacgtcctgtcacttttctgctcctcgcccccctttacagatatacttgacgggtatttacctcatcacaggagtgaaattttcatgctggatcttattcgggcgattggcctcggactggtggttttactgccgctggcgaatcccttaaccacggttgcgctctttctcggccttgccgggaacatgaacaacgcccagcgcaacgaacaggcgcgcatggcctcgttgtatgtctttatcatcatgatggtggcgtactacgccgggcagctggtgatgaacacctttggtatttcgatacccggtctgcgaattgcgggcgggctgatcgtcgcctttatcggcttccgtatgctgttcccgcagcagaaagcccatgaaacgccggaggcgaaaaccaaatctgaagagctggaggatgcgccggacaccaatatcgcctttgtcccgctggcaatgcccagcaccgccgggccaggaaccatcgcgatgatcatcagttccgcctcaactgtgcgccactccagcgagtttccggaatgggtgatcaccgtcgcgccgccgctgatttttgcgctggtggggctgattttgtggggcagcctgcgcagttccggggcgatcatgcggctggtgggcaaaggcggtatcgaagcgatttcacgtctgatgggctttttgctggtctgtatgggggtgcagttcatcattaatggcgtgctggaaatcatcaccacttaccattaaaaaaacagcccctgacctggcggtgaggggctggcaattcagacggtcggcgcgtgctcttccagcgccgtcggccagcggcggaatatcagcaccgcccagatcagcgccgccagcgcagggatcgcgcccacatagccgatagcgctcatcgacccgtgcaggctcacctgattgcccaccagcgcacccgcgccaatgccgatattgaaaatccccgagaacagcgccatcgccacgtcggtggcatccggcgccagcgacagcaccttcacctgcataccaaggccgatgatcatgatcgccacgccccagaacaggctcagcaccgccagatgtatttcactggctgccgcggggagcagcagcgccaggcacagcgccagcagggcgatagcaccgctcaccagccctgaggcgtgggcgttacccagcttgctgaacagcacgctgccgatgatgcccgccccgcccaacaccagcaacagcagggtggcgaagctggcgctcgatccggcgaccgtcatcacaaacggctcgatatagctgtaggccgtatagtgcgctgtcaccaccaccacggtgagcagataaatcgccatcagcgccggacggcggaacagcaccggcaggcttttcagcgatccggagtgctcgctcggcagacgcggcagcagtttgacaaggcacagcagggtgatgagcgccccgaggccgataataaagaaggtggtgcgccagccgaaatactgcccgacgaggcggccaatcggcaggccgagcaccatcgccagcgcggtgccggtggccagcaggctcagcgcctgggcgcgtttgcccgccggggcgaggcggatcgccagcgacgcggtgatcgaccagaaaatcgcatgggcaaaggcaatgccgatacggcttaccaccagcacggtaaagttccatgcgaggaacgacagcacatggctggcgataaacagcacaaacaggccaatcagcagcttacgccgttccacctggctggtgagcagcataaagggcagcgacagcagcgccaccacccaggcgtagatggtcaacataattccgacctgcgcggtttccataccaaagctctgcgcgatatcagagagcagccccacggggacgaactccgtggtgttaaaaataaaggccgcaatggcaagcgtaaccacccgtagccacgcgacccggcgtgataccgtgttggttgtcataaatttctcaggcgtgaatgcaataagggaagacggcgatcttaaaacgattagtggtgaaaatacagccgttttgtgatttagatctcattttcctgcctgcgctgaccgataaaaacggctgcgcgctgcggtgccttatgtcatggtagccatcgggatccgcaacaggagcagacaatgcaggaaattgatttttatatggttgatgcgttcagcgaccgcgcctttggcggtaacgcggcggcggtatgcgtattaacggaatggctgccggatgagacgctgctgaagatggcgaaacagcataaccagtccgagacggcgttctttgtgcgccatgatgacggctatgagctgcgctggttcaccacccagtatgagattgacctttgcggccacgcgaccctcgccgccgcgcacgtgatctttaaccatctggggcatcctgatacggaaattgctttcaccacccgcttcgtcggcccgctcagcgtctcccacaatggcgactggctgacgctggatttcccggcctggcagacgcagccggtggaggacctcccgccattgctgttcagcgcgctgggcatcgaccatgcggtggaagtgcgcgccgcacgggattatctggtggtgctgcaaaatcagcagcaggtggaagccctgcaaccggatatcgccgccatgataccgcttggcaaaatggtctgcgtcaccgcgcggggggataaccatgatttcgtcagccgctttttctgccccggcgaagcggtggcggaagatccggtcaccggctccgcccacagtatgctgattccgtactggggcgagaagcttggcagaacgcaccttgcggcccgtcaggtttccgcccgcggcggcgatctgcgctgtgaatggcgcggcgagcgggtgagcatcgcgggtcaggccaccacctacctcaccgggcgcattcagctgaaacagccttaaccttacggcaggcgggcgatattggcggcgatgacgctggcggagtgacggaacagcgtcagctcatcgtccgccagctgtaattcaatgatctgctgtactccgctttgcgccagcacggcgggtacgcctatggcgatattgctcatgccgtactctccgtccagaatgcaggagatggccagcgcccggtgactgccggtaaagatattacggcagatctcggcgatggtgccggcaatgccgtattcggtgcagcctttacgggcgtaaatatcaaatcccagacgccgtaccttcgcggcaagctggtcgccatccagcggctgcccggttttccgctggtacacctcggcaatgggggagccgtaaaccgaagagtgcgaccacaccgggaactgggtgtcgccgtgctcgccgaggataaaggcatcaatactctgcgcgccaatgtccagcgcctccgccagcgtgcggcgcagccgggtggtatccagccagacgccggtgccgatcacctgattgcgcggcagcccggaaagcttccacacctgccaggtaatgatgtcgcagggattggtggcgacgagaaaaatgccgttaaagccgttagccatcatctgcggcacaatggtctgcacgatacgcgccgtgccggtcagctcatcaagacgggtctggccgggtttgagcgcgccgccggaaacggtgatcaccgcgatatccacatctgcgcagtccgttacttcacgggtggaaagggtcatcatgcccggcatataagcggcggcatcggccagatcctgcgcatgtccggccacgcgctcctggttaacgtccaccagaatcaacgcttcacaaatattctgattaagcagggcgtaggccgcagaggcgcccacgttgccggtaccgataatcatgacctttcgggctttggtattcatggatgttccgttttcaggaaaaagataactaaaagtatcgctcctgatcgggtgagcgcaatgcgctaaccggcgtataggaaaatcctatgacgccgtcccgcgctccgcgagcaaatcaataaaggcctccagtggccgggttttcgcccctcgccgccacaccagccaggtggtcagccagcgccagttctccgccagcggccaggcgctgatctgatgatgccccggcatactttccagcatagagcgcggcatcagggcaagacctgcgcctgcgatcacgcaggcaagcataccgtggtaggactccatctcatggattttacccggcgtggcgtgatccgcctgaaaccagctttcgaaatgccgccggtaggagcagttggcgcgaaaggcgtagatgctcatgccgttcacttctgcggcgcgggtgacaggcggatgcccgccgggggccaccagcatcatctcttcacgatacaccggaatgccctccagccccggatgcatcaccgggccgtccacaaaggccgcgctgagccgcccgtcgatcaccccgtcaatcatggtgccggatggcccggtcgccaggtcaaactggatccgcggatagcgctgattgtattccgcgagggtgacaggaatacgcacggcggcggtactctccagcgcgccgagggaaaacagcccctgcggttcgtcaccggcgaccacgctgcgcgcctcatccaccagcgcaaggatctgctggctgtagtgcagaaaactgtgcccggcgggggacagacgcagccgctggttttcgcggataaagagatcgacccccagatccgcttcaagctggcgaatgcgggtggtcaggttagacgggacgcggtgcacctgctgcgccgcctgggtgatgctgccggtacgggcgacggcgttaaacatctcaagctgggttaaatccataccattctcaattcgtgaacagtggggttaatattattcagttttcagaaatagcagaggcaggcaggatagggcaagtcttacattcattaagcgagaaaataatgacccattcatctgtcacccatgcgctgcccgtcaacccggcaaccggagaaaccctgggcacacgcccgtgggccactgcggaagaagtgaataacgccgtcgcgctggcggatcgcggttatcgccagtggcgggaactggatgttgagcaacgcgccgggatgctgcgcagggtgggcgccacgctgcgtctgcacggcgaaactatggcgcagcgcatccgccaggagatgggcaagcccattatgcaggcgcgcggcgaagtgaaaaaatcggcggatctctgcgactggtatgcggaacatggcccggcgatgctcagaacagagccgacgcaggtggaaaataatcaggcggtgattgagtatcgtccccttggcccggtgctggcggtgatgccgtggaacttcccggtgtggcaggtgctgcgcggcgcggtgccgatcctgctggccggtaacagctatttgctgaaacatgcgcctaacgtgctgggctgcgctgagctgctggcggacattttccgcgaggcgggcgtgccggaaggggtgtttgcccaggtgaatgccaccaatgagggggtgagccaggccattaaggatccgcgtatcgcggcggtgacggtcaccggcagcgtgcgggcaggggcggccattggcgcgcaggccggtgcggcgctgaagaaatgcgtgctggagctgggcggttccgatccctttattgtgcttaacgatgccgatctggatctggcggtaaaagccgccgtcgccggacgctatcagaataccggacaggtgtgcgcggcggcgaagcgctttatcgtcgaggaagggattgccgctgcctttacggagaaattcgttaccgcggcagcggcgctgaaaatgggcgcgccggatgtggaagagaactatctcggcccgatggcgcgtttcgatctgcgcgatgagctgcatcagcaggtgcaggtcagcctgcgtgaaggggcgagcctgctgctcggcggtgagaaaccagcgggcgcaggaaattactatccggccaccgtactgggtaacgtgacgccgtcgatgaccgcgtttcgtcaggagctgttcgggccggtcgcggcgatcaccgtggcgaaggatgcggagcatgcgctggcgctggctaacgacagcgatttcgggttatcggcgacgctctttaccggtgatgaagaccgtgccgcccgttttgcggcgcgtctggagagcggcggggtgtttatcaacggctacagcgccagcgatgcccgcgtggcctttggcggggtgaagaaaagcggctttggccgcgagctgtcccattttggtctgcatgagttttgtaatgtgcagacggtgtggaaggatcgcgtctggtgagcttgcccggtggcgctacgcttaccgggcctacatctcgcccccaggtccgtgcatgtaggcccgcgcaagcgcagcgccgccgggcaatgtcatggtactgtcatttatcttttgtagactcgcgcccattgtgaggttacagaagaatatcatgaacttattgcaaacttttcgccgtctgacgcggcgatttactccacggcagtttggtttgctggccggtattttttgcgtgatcggcctgttttccgcccttcagatctcctcctcactgctgctctcccgctcccttaacgaagcgcagcacaacgaacagcgcaatcagctggcgcaacaacagcaggtcaaactggatgagtcgcgcatcgcgctgttggccgccagcgatctgttaaaccgcgccggcgtctggtttatgcaggatcaggccaccggctctgacggcagctggcacagcctgatggaggaagcgcagcaggcgctggtcacctcccataaggcctgggacgactggctggcgctgaacccggtaaatgatgacgggcttattaacagctatcagcagttctttggcgcgatcaaagagcaggcggacgggctgacgcgcacgcagtccatcgatgcgttttttgccgtgcccgcccaggcctttcaggcggatttcaacgataactttgcccgctaccagcaggccagccagcaacgggcggagcaggggcgtcaggcgctgatgggcagtcttaccggcttacaggatctctatctgctggctccggcgctgctgctggctattgccgtggcggtgtggttcggcatgtcccgctgggtgatcacgccgctgcgtgggctgattaaacatatcaatctgctggctgcgggagatctctccacgcccttgccgcaggtggcgtattttaaccgtgaggtaggtcagctcgctgccagtatcagcaccatgcagcacggtctgttgcagctggtggtgcaggtgaacgacgccaccgcctcgatggtggatcatattaaccgtctggcggacggcaaccagaagctgtatcagcaatcggcgcgccaggcgaaagagctggatgaggtgacggcccatatcgcggcgctggaatctcacgttgaaggcaataccggctacgcgcagcttgccagccagcgggcggatgaggcgcaacaggtggcggcggggggcgatcgcatgatggatatggtgaatgcctccatgcgcgccattgtcgaacgctccgcagagatgcgcggcattgtgtcaattatcgacagcgtggccttccagactaatattctggcgcttaatgccgccattgaagcggcccatgccggaaatcacgggcgcggctttgcggtggtggcgaaagaagtcggtctgctggcacgcaagagcagtcactccacgcagaccattcagcaactgatccagcattcattacagggcattgaagacgggtcccaggcggtcacgcggctggaagataatctgcaacaggtaacggggctggtggggcatctgagtacgctgctcagtgatatttccgctgccaccctgaatcagggagagaatatccaccagatgacccgtcagctgcatggtctgaatcaggtggcgcggcataccggcgaactggtgagcagcgcggcgctggcctcgcagcaactccatgatgattctcatcaactgatgcaggcggtggcgcgttttcgtctgcccgcctgacggacgctctgctatactcccggcctcttatggccggggtgtaaggagcatactgtggcgatgattgataacgacgtactggaaaccatcctgacgcagatcaggccgcttatcgggcgcggtaaagtcgcggattatattccggcgctggcctcggtggagggcaataagctgggtatcgccatcagtacggtgaacggacagcactttgcggcaggcgacgcccatgaacgcttctccattcagtcgatttccaaagtgctgagtctggtggtggcgatgaaccactatcagaaagatgagctgtggtcgcgagtggggaaagatccttccggtcacccttttaactccctcttacagttagaaatcgagcaggggatcccgcgcaatccctttattaacgccggtgcgctggtggtgtgcgatatgctgcaaagtcgtctcagcgcgccccgtcagcggatgctggaaatcgtccgtaagctaagcgatgtgccggatattgcctatgacgcgaccgtcgcccgctcggagttcgaacattccgcccgtaacgccgccattgcctggctgatgaaatcctttggcaattttcataatgacgtgaccacggtgctgcaaaactattttcactactgcgcgctgcggatgaactgtgccgaactggcgaagacctttctgtttctcgcctgcgaagggcgcgcgccgcatcttgcggagccggtggtatcgcccttacaggcgcgtcaggtgaatgccctgatggcgaccagcggcatgtatcagagcgccggagaattcgcctggcgcgtggggctaccggctaagtccggcgtcggcggggggattatcgccgtggtgcctcacgaaatggtgatcgccgtctggagcccggaactggacgaggcggggaattcgctggcgggcattgcggcgctggaagtattgaccagacatatggggcgctccgtctactgatcggcaggcagacgctcatgaccttaacttgttatgccggagctttcattgccggctgataagccatatctgatatttttgattataagagctatttcaataaataatattacattttaggtgttattaggatgtaccattatcgatgaaacgcagcatcttaaaggatcaagatatgtattatccaaattcggtccgttggcgtgagacacaatatggcgggttaaggagattacggctgggtgaaattaatcttgcaagttctctctatggacacagtatttattacaacaaagtatgggtgcattatgatagttatttgcctttgaatcttcaaccaagcgatattggtatggcaccaaatggcgaaatgtggttcagagataagcatgaagatgatttttccatgcctaaaaaaccaagggttgaacaacaacacctttttatgcatgaaatgatgcacgtctggcaacatcagcgtggaatgtgggtgagaacaagaggtttaatttcccgttttgctgattatacttatgatctcgataaaaacaaattactggattatagcctcgagcagcaggcctctattgttagcgattattggttattaaaaacctatggctttaggcattatgcgtatcttatcgattatagagactataataatgatgaaccattttttgagctacttaataaatatgagcgtgtattagggagttttcctggatgagaaaaagattcactacagttctgttagttaccctgcttacaggctgtcctgggaaagacggactgaagatgagcagacagcggtcaatattcctgaatggtgatcatatttgtttttctttagataagcaggctgtacttacacgctacattttgacaacaaatggtgcttactataaagaattgctacatggaaatgctgtcaggctttcctatcctgatacttgctttatcgtccacctggaaaaaggcgtaacttacaatgcagcttttgcccttgatggagagaattattattatacgtttataattgataatgaaaataatatcttagtgccatggaggtaattgatgtcattgccagcttatatgtttctctatgatgaaaatggtatgttgttaaacaatggttctgctgggcttggacgtgaaggcgcagttgaaatattgagcagtagttatggtgttagccaaccagtagacgcttatacgggtagaattactggcacacggcatcatgagccttatattcttcataaggatgtcgataaactttctccgtttcttgtggtgtgtgtctgtgaaggtcgtcgactaaaaaaagcagaaataagatattacgaaataaatgatgccgggattgaaagggaaatctatagagtgacaatggaaggtgttgtcataacatatgtgaatgctaatcatacgtatattccaggttccaataaacacaatatgattgaaacagtcggactaaggtataatagtattgagtggttatatcttgacggtacgatcaggtattcagatgcgtggtcaaagcctctccctgtgcaagagaagaagtaatacaaccgtcaccaaagagcgcctgttgtgtccatcgacactgtggaaagctaaccaccatggttgaagccctaaccatgctaatggggcgttccgtctactgatcggcagagataagcacggataatattaagcgtcagatgattaagatggtaaaggacatgttaagctcctgtaccattttttctgaccttatgctcgccctgtgcgattgtctggaatactaatttaatgcgccctgatgtgatgacgccttttcgtttgttccgtgaagataaaccgctgcgtaacgctgtctgtatattcctgatcaccacgctgttttacgccattggcgcgatgctgcggctggtggaagagctgtcgctgttctggccgctgaatgcggtgatggccggtatttttgcccgtttcgcctggcttaatcgcctgcataattacgccatctgttataccgcgatgatgctctacgacgggctgaccaccgactggggcccggcctcgtttgtgattaacttctccaatatggtgtttatcctcacctttgcgctgctggtccagcgggacaaacatgtccccgtgcaggcggaagcgctctctgtcgccctgcggctgtttaattactgtctgctggcctcggtgctgtgtgccttgtgcgggacttttggttcgctgggtattgacactcaggcgttctggccgctgtttgccgactggttcagcgagcagttctccactggcgtgatgatcctgccctgtattctggcgttctcctggccggggctgagccgtccgtttaaggtgcagcacctgctgccgctgatagcgctggccctgagcattgtcgcctcggtggtgattggcggggcgggcagcctggcgtttccgctgccagcgctgatctggtgcgcggtgcgttattctctgctgaccacggcgctgctgacgctgatcaccggcgcggcggaaatcatactggtggctaactccatcattaatatttccatgtccgcgaaactgcatacctcgcagatgttttctgcgcgtctggggatcgccaccatgaccatctgcccgattatggtgtcagtcagcgtgaatgccattaatgcgttaatgaagcaggtatcgctgcgcgccgatttcgatttcctcacccaggtctattcccgctctggtctgtatgaactcctgcgtcaacaggagaaaattaaccatgccccgcgcccgatgtcggtgatgctgctggatattgattacttcaaaaccattaatgataactatggtcacgaatgcggggataagatcctctctgctgtagcgcagaaagtgcaacaggtggtggggaatgccggtaacgtggcgcggatgggcggggaggagtttgcggtgatcgccagcgtaccggatgagcagcaggcgctgcaactggcggaaaccatccgtcagagtatcgagcagcatcgttttcgctggcggcaacagacgctctcgctgaccgtcagtatcgggctgagtcatgcggtgagcgaattctggcagcgcaccgaaacctttaaccgtctgctcaatgaagccgatgaatatctctatcagtctaaaaaggccgggcgtaatcgcgtcagcgtgcagggcggtgcgcagactttattgatatgactgttaaataacttgccaggtattttcggcgtcaataatatggccgggtaaacctggtgagacatgcggcatgaacggatcggacaaactgaatattaacgccagggtaactggtctgcgatttgttcgccgcatgtatctgatgcgtatgctcggtacgctactctgttttttccctgttctctcggtgctggtggaacatcatcaaccgctgtggctgatggtgctgctgggcgtcaacgcgttcgtctggcccggcctggcgtttctgcgcgcccggcgttctgccacgccgcacaataccgaacatcagaatctgctgctggatgccggagcgggtggtttctggatcgccatgatggcgctgaatccgctgccatcggtggtgatcgccactattctgctgtcggacagactggcggcaggcggcctgaaactgctgcggaaagccgccatcgcgctggtggcaaccggcctgttcgcctggctgataagcggtatgccttttgaaccgcaggtttcccagcgcaccatgttcgccacgctgccgctggtggcgatttatatgctggcgctgagcgtactgaccgacgccattagccgcaagctgcggctgaaaagccgcgagctggagcgcatcgccatgatggatccgctgctggatattgcgaaccgtcgtctgctggaaaaacgtattacccatgaactggacaccctcaaccagcgctgccgcagctcaattctgatgttcattgatattgataacttcaaagaggtaaacgatcgattcgggcataaagtcggcgatgcgctgctggtgacggtctcgaaaatcctgcacgcggcaacgcggcaaaccgataccccggcgcggctgggcggcgatgagtttgtcatcctgctgccggataccaccctggacgaagcttatatcgtcgccacgcgcattatggacggcgcgtcggtgatgaccattggcgcggatatttcattccgcacgaccctgagtatcggcatcgccagcgccactccggcgatggacgacgtcacagactggctaaaagccgccgacgatgcgctttaccgcgccaagcgtgaaggcaagaaccagatctactgtcactgacaaacgcgctgaatgaactagactttatgcatgtctggcgagaagagtgcgttatgaaacaccctgaaatccccccaaatgaatcgcaaaggatggcctcgctgcacgagtccggtttgctggaaacggcatcccgggaacgcttcgacaggctgacccgtcttgcgaaaagaatgtttaatgtgcccatcgcgctggtaagtctggtgggggccgatacgctgcactttatctcctgcgacggcattcctgatggccgggtggagcggaaaatctccttttgtggtcatgtcattctcagcgatatgccgatggtggtggcggatgcccttaaggatccgcgtttcagtgaaaacccgctggtcaccggcgagcctttcatccgcttctacgccggttatccgctgcgcgtgccggatggatccaacgtcggctcgttctgcattatcgatcgtcagccgcgggaatttacccctgcggaacttgcggtactgaaagatttcgccgccatcgtggaggatgagttcgccaccatcagcgtggccaccaccgacgagctgaccgggttgtataaccgccgtggctttgaaaacctcgcgaaattcgccattaccgccgcccggcgtcgggcggagccgttaaccctggcgtggatcgatctgaaccgcttcaaatacatcaacgatacctggggccatgaggagggcgacaatgccctgaaggcagtggcaaatctgttgcgcgagagcttccgcgaggcagatttactggtgcgctttggcggcgatgagtttgcggtgcttttctccgataccagcgaagacggcgcctgggtggcgatgacgcacctggttgagcaggcggaagcctttaatgcgtcctcacaaaagccctggaaactgtcgttctcctgggggctgagcgaatacgatcaccaggcgatgccggatatgaaaagctggttgaaaacggcggacgatcggatgtacgccatgaaagagaaaaaccgttagcacgttgatcggtagccataagaaaacgctatcgcaacgccgttgcgttaaatatttgttatcagcatagtgatcattttgaaaaggaaaacatgatgatcactactgtcctctgccgcccgctcgggcgcgatgaaattatccagcgaattgacgaactctgtgacgtgctcgaagactgcgtgcgcggcggggcgtccgtcagctttatgctgcccatcacccgcgacacggccatgcacttctggcagggcgtggcggaaagcgtggggcgcggcgagcgcgccgtgctgattgctgagaatgccgactttcgcatcatcggcacggcacagattatcctggatcaaccccccaatcagccgcaccgcgccgatgtcgccaaacttttggttcaccaatctgcacgccgccagggcgtggcgcggcagttgatggataatcttgatgatattgctaagaaaaatggcaaaaccctgctggttctcgacaccgccacaggcagcgacgcggagtttttctatgcccgcagcggctgggaacgcgtgggggaaatccctggctatgctcagatgccggacggaactgtgacggggacgacaattttttataagaatttaacatccaacgcaatttaacgactgcaattgatcaaaacagggtttcatggtcgtaaagtctggtaagttatcacaccaatcttcccaggttgtatgactaatcaataaggaacccattgtgaaaacgatcaatcgtcgcgattttcccggagcccagtacccggaacgtattattcagttcggcgaagggaatttcctgcgcgcattcgttgactggcaaatcgatctgctgaacgaaaataccgatcttgacgccggtattgtgattgttcgtccgatccagagtgattttccgccgtcgctgagcacgcaggatgggctgtataccaccatcattcgtggtctgaatgacgaaggtgaagccgtcagcgatgcgcgtctgatccgttccgtgaaccgcgaaatcagcgtttacacgcagtacgatgagttcctgaagctggcgcacaacccggacattcgttttgtgttctctaacaccactgaagcaggcatcagctaccatgcgggcgacaagtttgaagatgcccctgcggtcagctatcccgcgaaactgacccgcctgctgttcgaacgcttcagccactttaacggcgcggctgataaaggctgggtgatcgtgccgtgcgagctgattgactataacggcgatgcgctgcgtgaactggtgctgcgttatgcgcaggagtgggcgttaccgaccgctttcgtgcagtggctggacagcgccaatgccttctgttccaccctggtggaccgcatcgtgaccggttatccccgtgatgaagtggccagcatcgaagcagagctgggctatcacgatgctttcctcgataccgccgagcatttctacctgtttgttattcaggggccgaaatctctggcgtctgaactgcgcctggataaattcccgctcaacgtgctgattgtggacgacatcaaaccgtacaaagagcgcaaagtggcgatcctcaacggcgcgcataccgccctggtgccggtggcttaccaggcgggcatcgacaccgtaggggaggcgatgaacgacagccagatttgtgcgttcgtggagaaggccatttatgaagagatcattccggtgctggatctgccgcgcgatgaactggtaacctttgccagcgccgttaccggacgcttccgcaacccctatatcagacatcagctgctgtccatcgcccttaacggcatgaccaaattccgcacgcgtattctgccgcagctgctggcagggcaaaaggccagcggtaaactcccggcgcgcctgacctttgcgctggcggcgctgattgctttttatcgcggcgagcgtgatggtgaaacctatccggtgcaggatgatgcccactggatcgagcgttatcagcaactgtgggcgcagcatggcgatcgccagctgagcaccagcgaactggtcaaagccgtgctgtccgttaccgatcactgggagcaggatttgacgcaggtatcaggcctggtcgagcaggtgtcgctggatctggacgccatcctgttacgtggtatgcgcgaggcggttaagccgctgtgctgataaccggttaacaatgacccggctgcggccgggtttttactcctcattctatagttacaacatccatttgctgtttagctccctgaactgtggcttcagcgacgtaatcgtctagcaatgaaacaattgcgcgacatttacttagcatttctgttgcattggtcctaagatgagtcctgaacagaggaggaacgcgcaatggaaagaatcgttcagatgatagtggtgctggtcgcctgcgttgcggtattcgccaccgcttacgacctctctcttgttaccgatttaccctgatcatgaaagggggcctgcgcccccttgatgcgttagctggccgggagctggaagaagcgcaccgaatggcgcaactgttcactttgttcggtcatggaaagggcagccaccgcagcctgttcaaccagcgcggcattctgctgcgtcacctgatccatctggtcaatggcaacgctgatctcgcggataccctggtgttgctcatgggatgccgaggagatttccgccacaatgttggtcactttgttcaccgaattgacgatgtcttccatggcccggctggccgtatccgcatagcgcgacccttcagtgattttctctaccgtgccatcgatcagcgttttgatctcttttgccgcttcggcgcttttctgcgccagatttcgcacttcaccggctaccacagcaaagcctttgccttgttccccggctcgcgcggcttccacagcggcattaagcgccagaatattagtctggaaagcgatgccctcgatcacggaaataatatcgacaattttttgtgaactgtcggcaatctgatgcatccgctggagcatatcctggacttcctttccgcctttgacggcggtttgcgaagtctgccgcgccagctcgctggctttgtaagcgttctcggcgttgcttttcacgttttcggtgatctgctgcatgttcgcagaggtctgtaccagcgaggcggcctgttcttcggtgcgctgtgacagatcgctgttgcccatggcgatctcactggcggcatgggatatagactcactgccgttgatgatgccgtgaataatttccgccagcttgccattcataaatttaatcgtcgccagcaaactgtgctgatcctgctctttcagattaatttgagtggccagcttaccggctgcaatttgctgcatgatttccaccgcataacccggttcaccgcccagttgccgggcaaggttacgggaaatccaggcggcgataatgccggtggctatcagtgcgaggatcaataaaccgcacagcacagacaacgcctgtttatatccgtcggcggcttgttgactggcccgattgccaatggctatttccatatccaccagcgtggctaaatctttcatcagctgtgtgcgatatttcgccgacaccgcgccgcttatttggctggcctcctgtaaacgttctgcatttaccgcctcaataacttttgcattcacatcgacaaattgtgtgaagttattgaccacctgagaaaacagcgcctgcatttccggcgtcatatgggacgtcagacgggcatagcgctgctgcgcattgagaaaaatatcctgattttgcagcagctcaaggcgatgtttttcccgctcggcgggcgttgtggagctgatgtactggatctgctgtaagcgcatttccgataacacgccacgcatttcaagggaggaacgcacccctggcatacgattatcgcgaaaagcatcaatattctcattactgacgttgagctgataaatagccaccacgcccagtaacaacatcatggcaatcagaattgaaaagccggttaataatttggttaagaccgttgactgtgcatattttttcataggagtaacttagtgataaaaggtaatactattaacggcataacctttaaaatattgattccgtaagttgatcctcatcacataaccatctatttaatttctggtgtaaatcaggcgtataaatactttaatgcgatgttttaaatatgtatttttgctgtgataaatttgccctaaagcgccccggatactcgggcagattttgccgggggcagggcggtcatgctctgactggctcatagctgtgcgcattttgtcgccttattcttttaatgaatcattgcattatgtgctttactgaaagaaaggacggggcgcaggaggaacggtgaacgtcggtaaatacatcgcgggtgcgttgtcgctcaactcttcgctggggcgcagcattaccttgtttatgagcggattgctaatcgcaggcatcgccaccagcgcctggacgctgaaccgttcctgggagcgcgccatcaaagagacggagcgcagcgcaatcaacctttcggtgtcgcaggctcgtcaggcggaagataccttcgtacaggcggaactggcgctgcgtgatatccgtcgtaacgtgccgcaaagcgggatcaccggtatggatccggttaaatttaaccgctttctggccgatatcaaagagcgcctgccacagctgcatggcctgttcgtctatgacgcccagggttttatgcgcgtgacctcttttggcaagctgcctgccattaccaataatgccgatcgggaatattttgtttatcaccgcgctaacggacacggcagcgtgcacatcgggcatgtgatccgcagccgttcgaccggggatctgattattccggtgtcgctgcgcattaatgacgcctacggcggctttgccggcgtggcgctggccaccgtgaaactcgactatttccgtcacttctataattacttcgagctggggccgcgcgatctgttagcgctgctgagcaccgacggcacggcactttatgccaggccatttgatgacaacgtcattaaccgcaatctctctgtcagcccgttattcacccgtgaactcccgaaacacgatcgcggcaacgccacctggctgtcagcgctcgataaagtagaacggatttatggctacgcgcgcctggaacgattcccgctggttgtggcggcggggtatgacaaaccggcgctgtggcaaagctggctcacggaaagcctaccggatatcatcctcaacgcgatgctgttgctgggcacggtcattatgggggcgctggttttccgccaggtgagacgcaacgtacgcgatcaggcggagctgactatgctgcgggatgagctgaccagcatcaaccacaccttacagaccatggcgctggcagatggcctgacggggctggcgaaccgtcgccagtttgatctgttccttgcccaggcgctgaaaacgtcggtgcatacgcaacggcccgtgtcgctgatcatgatcgatatcgatttctttaaacgctacaacgatcactacggtcacgtggcgggcgataactgtttgcgtcaggttggcgaaatactaatgaagctgaatctgcggcagagtgatttgatcgcccgttacggcggcgaagaattcgctatcgtcctgccggagaccgatctgcgcgaagcctttatgctggcgcaaaatgcggtggatgcggtgcgctatgcacatatcaaacacgaacattcctccaccgggcgcaaagtagtgaccatcagcgcgggctgcttcagcatgacgggcaccggcactgatgacgatgcgcggataataaaagagggcgcggattccgcgctgtatgccgcaaaaatcaaaggccgagatcgtgcttttgtggtgtcgccagcgccataagcattttcttaccccgaaaaagcatgcccgacggcatgcttttttttgggcgacgttttatagcccttcaataaaaccacagtgggcgtaacaatagtttaaccatcctgcctaaatatcccaacaaccagtaccatctgtaaatgaaatattgttttaatttactatatatattatttcaactgtgatgtggctagcagatctgcgacaatcggcagtgctagtatcccggcgggttctttgcatggaaacccaaaaataatggtgtaatcagtcgtacctactgggatgagaataatggatatacttttagggcttgttaaaacgcccgccgttatcatagcaatcgtcgcctttctgggattgttatttcaaaaagcctcaatttcccgtttaattacaggaacctttttatcttttatcggttttacgatgatcaaagtgggcggcagcatcttaatgaaagtgctgacggcctttagctcactgttttctaatgcctttaacatcgttggggtggtgcccagcaacgaagccatcatggcggctaccattgataagctgggctcaatcgctgcgcttatcctgttgttttccatgattttaaatatactgctggcccgttttacccgttgtaaatacatttacctgtcgctgcatctggtgttgtttatggcatttgccatcaccgcggtgctgatgcagttcggtttcagtcataccatgatgattatcattgcctcgctgcttatcggcacctatatggcggtatcgccatttatcctgagccgctttagccgtgaaatcatcggttccaatgaatacgctatttctcatgcggctatttcttcttatgttattggctcttatatggggaaatggttcggtaataaaaatagcgataccgaacatttaaatatcagcaataaatttgattttattcgtgagccaaatattgcaaccttgttaacaatgttggtgctgctgctgatctcctgtatttttgccacccagccgcagattaaggatgccatgaccgtggtgtatggcgcaggggcaggggataagaacgtggttatctttgtgcttgagcagtcggcgacatttgcctgcggcctgtatctggctaaagccggggtaaatttatttaccgcagagatcgtcccggcctttaaaggttttgcccgtgtatttgcgcctggggccgtcccggcggtggatgtgatggtgttattcaccaaagcgccaaacgccacgctgattggcttcctcatcagctttgcggttgagctggtctgtatcttcctgttcccctttatcggtctgccgattatcgtgccggggatcatggcgagttttatcaccggcggtgcggcggctatctttggtaatgccaccggaggattccgcggcgcggtgatcgccagcagcattaacggattactgctgtgcgtattaccggcgctgacgttgcctatcttctcgcagctgggcgcgaaaggcgtaacctttgcggatccggactttacgctgccgtcattgattcttgattatctgctgcggttattcagctaaaccagaaaccgggggagcaggctcctccggttttctgaatcctgttgccgcgctttaactcgtgagagccttgcgcaacaattgcattacgccgcgccggacagtatggtgagcaggattttttctttcttcgggatcaccatggcagagcatgtttccaaagacccgctgcacggcgtcacacttgaagccttactgaccgatctggtcgcccgttttggctgggaagaactggccgcgcgcatcaatatcaactgttttaaaaaagatccgagtatcaaatcaagcctgaaatttttgcgccgcacgccctgggcgcgcaaagaggtggaagatttgtacgtcagcacgctgggtgaaaaaagcgtagcatcgcctggggaagatccctgggctaaatggaagtagggcgaccatataccgcatgccctggccgtgccggtcggggctgataacatcgcggcacggcacatttgtaaattcccttttcaaatcactgacaaaagtaatcttgctaattaattcttaacagtccactatgcgtcatcggtttggcatacagaccttatgaaagcagttttagtaaagcagtcctcatttcaagcgttatccaaagatactcttctgcatgagcctcctcctaagcgcccaataagtcatcatctgcaacaggccatgttcgccacgacgtgtggctcaaataattaaaggaagtatctatgtctaataaaatgactggtttagtaaaatggtttaactctgaaaaaggcttcggctttattaccccagccgacggcagcaaagatgtattcgtacatttttccgccattcagagtaacgattataagaccctggatgaaggccagaaagttgagttctctgttgagaatggcgctaaaggcccggcagcggctaacgttaccgcgctttaaccgcgaaaatcgcactgacgcttacgacagcgatgacggtataagcctgagcagataagtgaacgtgataaaaaaacccgccatgagcgggttttttattattttagcggcaggatttatacgccattattcaggcagcgcatagaccacgacctgatcgccaacctgatccttcaggatagtattcccgcctgccacgaacgccacatactgacggcctttatattcatagaccgatgggttcgctaccgcaggggcttccacctgatcggaccacagctcttcaccgctctcaaccgagtaggcgcgaactttggcatccatcgacgcgccgataaagaccacgccgccagcggtgacagccggaccgccgatagtcggtgagccccagctttccggcataaagaagccgtactgctgagacgcgccaaccggacgacgccatttcacatcaccggtatgcatatccagcgcgacgatttcgccgaacggcggctgccagcacggcatacccagccagttattcgccaccatcagacgcataccgtaaggcgcgccttcctgcggtgcgaaaccgctttcgttaccggaacctttatccgctttatcgtaatcttcgcggctgtaaagcttcacatactgcacaatgtgcgaggtgttgacgatggcgatctgtttttgcggatcgaatgccacgccgccccattgcacgccaccggcgctgtccggataggtcagggcgccttcgcctttagtggttggcggcgtatacatgccttcataggtcaggttatcccacagacgggagcactggcccgcgcccaccatatccgccagtttccagatttccggctttttcgattgatcgagcagcggggcgggtttggtcgggaacggctgcgttggcgaaagcacttcgccctgcaccgaaccatcgccctgcggcaccggacgttcttcgattggccagacatcctcgccggtcagacggtttaccacaaacaggaagccctgtttggtcgcctggatcagcgccgggatctgtttgccgtcaacggtgatatccatcagcgtcggcgcggagttgatatcataatcccacacatcatgatgcacccactggcgtgaccagaccactttaccggtgttaatgtccagcgccgtggtggaagtgccgagcgggatcggatcgacgcggttaccgccccagtagttaggggaaggagaggagaccggcagatagaccagaccatgggcttcatcggcagacatgtgcgtccagacgttggcggtaccggtacgtttacgaatttcttccgggatcgcctcaaaggtccattcgcgctcgccggtctgcgcattaaatgaaaacacgctgcccggaggcgcttcggcataagcccagtctttaccggcccagccaaccagcagatgattaccgacgaccgttggcggttgcagtatcgagagcggatatttggcgtttaccgtgttccactgattaatatccagcacgcctttatcagcgaaaccttcgcacggcttaccggaatcggcgtccagcgcaaagagtttgccatccaccgtacccatatagacgatcttctgacaggcctctccggcgaccggattttttgcctgccagtaagagacgccacggtttttcagtaccggctgcgtcagcgctttgcgggaagatttggtgtcatagtgccacttttctttgccggtgcctggatccagggcaatcagacgatcaaagggtgtgccgatatagatcgtttcgttggcgaaaatcggcgtggctgaccagacggtggcaggcgtatcgcctttgccatccgacacatcgccggtatggaactcccagactttcttcagtttaccgacgttttccgccgtgatttgcttcagcgggctatatttctgggcgttaagctggccgtggaagctgtcccaggtggcggaagacggcaccagagatgtcgccggattgccggcagattcaacttttttgccgtctgactgaccggaagacgcctcgtcagtggtttttgtggtgccgggatcttgctgatccgctgcgtccacgttcactttttcctgtgttcccatcgaggcttcagcggctttgtcctgcgcctgaagggagaggggcgcgaccagtagcgccagcgccgtcatgctgactttcattaagggatagtgtttatcgttatacacgggcgattcctcagacttttacgcgatggttgtgatgcgcggggttgcggctcatcatgatcagaccaatgagaccgactaccattgcggccgtaatgatgtactggtgcagcagcgccgctgcaaaaccaataccgaccagcatgatcagcgtaataatcaccagaaaaatgcgcataccgcggcgggatacggcacgtatagcaaaggccagcagcgccaccacgacacagtcgatagccacgcccagtgcgccgatggtaccggtgacgccggtaagcggcgtcagccaggcgtatagcgcgacgacgaagccgatcacggcagccagcagcagcagccagctgccggtgcgcgaggattgagtttgtaacatccaggaagtccccatcaaaaataaaaaaagagtaacaagggtgtatcggtgaattttgcagctgacatgcgcagcggcaaagttcactgaacgtaactcagtatagaagatggttttttttatggggcgctcaaatctgggagttgccggtcagcggttcatcataaaggtttaagatgcaggcgtgccggaatgttaactttagctaaacttaaatctcagctcttaacgcaaagaggagaaggtaatggctgatccaatacttattgatacgctggagtttggcaatgatggtgcgaccgctcagaagtatgagatttatggcgatgatgagcaaagacctgcctatgcgctgatttaccggcaagatcagggcgagtggatcaaacttgatgaaacgcttgagtttgcggcccgggaggagcaaaaagcagcgtcgtctaccatggattatggatccagtgacggcctgccagaactacgcgatctccccggtgaagcgaaagagcgctgcaaaacacactggcaggaaaaccagggaaccggtgatggcgcagcttcgtcagcgtaaagcgtcaacgccggtaactgtgcagcatgctgaaatgaacgtccgcgccaggcgggcgtaattatgttaaatgtagagcggcgatattccaaagtcatctcattgtcttaccgcttcaaagtcgtatcccttcattaacagctttcaggctgtaatattgataaaacagcctgtagggtgtatcttcagaatacagcctgagagttgtatcagctcccgttaaagtggcctcctcattatgaaaaatgtttacccgttaaaaacgcttaaccagctgcgtccattactccttggttttcgcaaagcgcatggcctgacgcaaaaagaggtgtccgaaaggttaggcgtaacgcagcagacttacgcccgtctggaggccaatcctgccagtgccagcattgagcgcctgtttaaggtgttttccgtcctgggtgtcgaaatcagcctttcctcagcgacccttgcctcagagaacaggcaggcggagggaaattcagatttacattcacctgcacggctggagaaatggtaacgatatgagcaggataaagccgcgtttagcaatatggatgaatggcatccacgtcggattctgggagaaaagcagaggggaagatttattgcgctatctgccggaatggattgctgacgggcagggcaggcctttatcactgtcccttccttttacacccggtaatcaagcctggcgcgggaatattgtccgcgactattttgataatttattacccgacagtgaagggatacgccgacgcctggcgatgcgctatcaggcagaaagtcttgaaccttttgacctgctgacagagctgggaaaagactgcgtgggcgcgatacaacttttgcatgaagacgaggagcccacggatttatattccgtaaaatatcgtccgctttctgcatcagaaatcgcgacagccttgcgaaatactacccaggtattgctgcccggcaggcaggatgatgctaacgatctgtgtttatcgattgccggcgcgcaggaaaaaacagccttactgtggcatgaaggccagtggtgcatgcccgaaggtaatacgccgacgacccatattttcaagttaccgctcgggctggtcggcaatatgaaagctgatatgagtacgtcagtagaaaatgaatggctgtgttcgttgcttcttgaacactacggcatccccgtggcacgaacggagatcgcgcagtttgaagatcagaaggccctggtggtagcgcgttttgaccggaaatggtccgccgatcggcagtggatcattcgtttaccccaggaggatatgtgtcaggctctgggcgtttctcctttacgaaaataccaggcggacggtgggccgggtatttcggacattatggaaatactgagtcattctgacctggctgaacatgacagagcgcagttcttcagagcgcagattattttctggctgatggctgcaacggacggccacgccaaaaatttcagtatcgcgatcgcgccgcagggccgttatcatctgacgccgctgtatgacgttttgtcggcatggtcggtgatcggtcacgggaataatcagatcgcctggcagaaatgcaagctggcgatggccgtccggggcagcagcaattattaccagatttaccgcatacaaaaacggcactggatcaaccatggcaagctggctggcctgggtgagcagcagatagaaaccatgctggatgaaattatttccgtgacgccgggcgtcattgaccgtgttatggcgttacttccgcagacgtatccgcaggaacttgctgacagtatttttaatggcatcaggcagcaatgcaggcatctggaagaaaaatagttatgcatcctgaggacgggtcacggaaagctcaatgccacacaatctgcataaatgcattctggtgcgcataatgtatattatgttaaattggatttatggttacgcgcaccgcctgtaagtctgtccccgcccctcatcatcacgagccgatctcttatacaccgcttaaaacaaacccggcacgacagccgggtttatattgcaaccttatgcgactcacgcaataaaccgttattccacgtctgcgccagcagcatccggcaacgcctgttccagcacgtcggtacacagacgcacggtttcgcgtaatcgcgcttcgctgtaccctgcccgcgcactggcggaaagtccggccatcacggttaccataaaatccgtcagccgttcggcttgatcgggatactgtcgcgcaatgaaatcgcggatcatggtttctgctgcctgatggatttcgcaggccgcttcgcgcgcttcccgatcgtcactatgcgtgccctcgaccaccatacagccgctggcgatgggatcggcaacgtagcgccttgccgcttcattcagcacagccgccaggcactgcgctaccgggcgatctgtacgcaaaatttcggcaaaagggatcgcgccctggcgggaatagcgcgccagcacacgttgatacaggccgaacttgctgccgaacgcggcgtaaaagctgggtggattgatgcccagcgctctggtcaaatccgctacgctcagggcgtcgtatccctttgaatgaaaaagtttttgcgcagttgcgatcgcctgctctgcatcaaacttgcggggacgccccggtgttttactttgttttgtagtgaccactacataactccttgacaggctgcgtgaccgttgaatattgtaatcatcactacaatatcacaaggacacgcacatgacttcatttcagcataaatccgttctggttattggcggcagccgtggtatcggcgcagccatcgttcgccgcttcgctgccgaaggcgcatcggtcactttcagctacgcgggatcgcatgatgctgccacacagctggcggcagaaacaggcagtaaagcggtgcaggcagacagcgccgatcgcgacgcggtgatcaatctggtacgcgcggccggaccgctggacatcctggtggtgaactcaggcattgcgctgtttggtgacgcgcttctgcaggatagcgatgtggtggatcgtctgtttcgcatcaatatccatgcgccctaccacgccgccgttgaggctgcgcgtcagatgccggaaggcggacgcatccttattatcggctcggtcaatggcgatcggatgcccctccccggcatggcttcttacgccgtcagcaaatccgccctgcagggcatggcgcgcgggttagcgcgggattttggcccgcgtggcatcaccatcaacattgtacagccaggtccgattgatactgacgccaacccggaaaatggcccgatgaaagatctgatgcacagctttatggccatcaaacgccacgggcgtcctgaagaagtggccggtatggttgcctggcttgccgggccggaagcctcgtttgtgaccggcgccatgcataccattgacggcgcatttggcgcgtgatccgtcggggttcggcatcgccgaacccctcattttgccgtttctgccctgcccttactccagcgccagcaatgcaaagctcgccagccagtgaccgccgctgtaatggcttcccaccacatgctccacgctggccgtcagatgacgcgccacggcttcgcgcagcggcgtctgcgccggatggttttgcggtaaagcttttgcgatatgcttcatacaccaggcgcggctcaggttgagcccgtcaagatgcgcgattttcggatcggtacggtcgctcacttccgccgggttcatcagcgccgacaccgatcccacatgcggcaggaatgcatcgaaccacgccgggaatttatccgccactttactcatcagcagggcttccgttaacgcgccggaaatatactcatcaccccctggctcataatgcgcaggataatccgtatcggcctgataaaagcgcgtcgccgcatccagaatggcctgctccagcggacggtcagtcagcgccctggcataatccagccccagcgccagcgcaaaggccgtgttgtaatgcgttccgacgcggatcggatacgtcagcttgctgaggtaatccatcagccggttgcgaatatcctgggttaatggctccagcagttgatgccacttctgcgcctgcggcagtgaggattgtttcagctcctgcgccagcgccagcagccagccataaccgtacgggcgctcgaaggatgcgcggaacggcgcgttaaagtacgccagttcctgggccacgttttcttccgtcatgtgttcgtcaaacagcgcaacgatgtcatcacggcaggacaactccgggtatagccgcacgcagcgtaacagcaaccagtaaccgtgtaccgccgagtgccagtcaaaacagccataaaaaatcggatgcagcgcgcgcggcggtaagacatcaccatcatcattaagcagatgcataatgtgattagggtattcctggcgcagataggttaaaggcattctggcgaatgcatccgcctgatgttgcgttaattccataacagctccttagctcaatgccgcgcttagcgaaacgcgaggaaatacattaaaatgacgttcaccaccagcagcgtcagcgccgttgggatctggatcttgatcacctgatatttatctttcagttccagcaacgcggcgggaacgatattgaagttcgcggccatcggcgtcatcagcgtgccgcaataacccgcatacataccaatcgccagcagcggcgccgggttgccgtgatgaacgttaatgaggaatggcagcgcgatccccgcgctcaacaccgggaatgcggcaaaggcattacccatgatcatggtaaacagcgccatgccgatacagtagatcaccaccagcatgaagcggttatccggattgacgaacagactcaccactttttgcaccgactcgccggtattcgccaccacaaagaccccgccaagcatggcaagcatttgcggcaggatcaccgcccagccgatagtgtccacaagacgccgcgactggcggatcgcatgcagcggcgttcctttcgtcagccaccagcccgtgaggatcgcggcgacgcaggcgacacagagcgcggccagcgtgagctgcttctgatctagcagatacacgccgccaatggaaacccctttcaggaacagcgtgccgatcaccgtcaccacggggatcatcagcgccggtaaaaacagccagtttttcagtcgccgggatgaggcttcccgctcttcatcggtggacattttatagtgtcctttgcccaccagcccaaagcctgccagcaacgcaatggcgatcacgccgccgccaatgatccggtaagccagcgatttgcccagctcctgcaccatcagatcgccgaacaggaaaatgccgccgaatagaaaccagaatagcgcggtggtaaagcgtttcgggttagcccgatcgcgcagcgtcataatgaccagcagcatcacaacaaagccgatgaggtaatagacgcggttaatggtgatcaaggtgctcatcgtgtcgcctcctgtgcgccctgctctgctttccaggccatgacgtcgcgacgaatactggcatcaaggcgcaacaagcgggtcatatgaataattaatgcggcgatagcggtgggaatagcccacaggccgatatgcagcggttcaatgccctgaatgccgctctctttcaggaaggcgtcaatcagcagtaccgcgccaaaggcaataaaaatgtcctcaccgaagaagacggcaatattgtcacaggcggcggcatgggctttgatcttatcgcggatatgttgcggcagttcgccgtattcattgagcgccgccccttcggccatgggcgcaagtaacggacggacggtctgcgcatggccgccaagggacatcagtcccagcgcggcggtaccttcacgggcgacaaaatagagcatcagaatacgtgccgaggtggcgctggctatcttcgccacccaggcctgcgcccgctctttcagcccgtaatactccagcaggccaatgaccggcaggatcagaataaaggtggccagtgagcggctgtttacaaatttttcgccaaaggtttccagcagcatgccgaaatccattcccaccagcagaccggtcgacaggccggcaacgaccaccaccagcagcgggttaaatcgcagtgcaaaaccaataaccactatcggtatcccgatgagcggcagcagcgtagaaccgtccataacttttatcctgtctaaagtgagcgttgcgcgccggcggctatttttttaatacttcacatcaaggcgaagcgtgatccataacggcgaaagatgttgtgttttgccagggatctgtcattcgcacagagcctgtactaaaaatctataactgaacggcaaaaacatgtaaacaatttatcaataaaatgttcttattttatcgctttgcgtttacatttttggtgaagagtcacaatccgataagggacgttatgaccacaaaaaagagtgccacctcaacgcatcacgacgatattgctgacggccgtatcgtttcctcccgccatctggtttctgagcgttgcgcagagttatcggagctcgagtacgcgctgatcatgaccagcaatgcgtttaacaaatggatggtgcgctgtatgaccgccgccggtgagccggatatgggcgcttttgacgtttcgcttctgcatcatgtgaatcaccgcaatcgcaaaaaaaagctggcggacatctgctttgtgctgaacgtggaagacacgcacgtggtgacctatgcgctgaaaaaactggttaaggcaggctatgtgaccagcgaaaaggcaggaaaagaactctttttctccaccaccgatgaaggtaaagccttatgcatgaaataccgtgatgtgcgtgaagcctgcctgatcaacattcatgctgaaagtggcatagcaggcagcgccattggcgacacggcacagttgctgcgtaccatatcttctctgtatgacaccgccgcgcgggcagcggcatccttgtgacgcagcgttactgcacgggcgtgaactgacgggtcacgtccccctgtttgatctcgccatcagacaggctgagcgccctttccccctgactgaagtcgattttattgagatccacccagaccgtggagggagaatccgccagatcaaacatcatgatgttgtttttaagatcgcttatcccgcgccagagggtggtactgttctccggattcctttcggttgagatagcgaacggcgtggacagcgtgcgcatgacggaaagcacgctcatacgcgcctgcatggcgaaattcttaccgggaaccaggttaataatagtgtccatcttgtcagggctgatttgttccagccagcctgtcgcgcgcataaaacggtctaccgagtggggagaaccaggcatgtttctggcgagattcttttcgttataataatcatatattttcagcatggattcataactgggatcgttggtcattacggcgttgcctgctttgggatatattttcagtttacccccggcaatttcaataatcatattcgcgccgctgcggtcggtaaccatataatgcagtcctgcgtgcatgcccttgctaatcatatgtatcggctcgcttttaagcgctttttctgcctcctcaaccgttgcgaaattatccagcacgtactgaataaaggtttttgcctccagggttttctctgccggtgaagccttgccgtatttcgcctcgccgagatataaaagatcggcctgcaaccccttttcattcatgcctgattgcggcccaggtgacacgggtgcaggcgtcagaggatgagagtgtgcctgctgaaagtatggcgctgcaaaaaagagcaatgactttcttatccataatgtagctcctgaatttcctttttataatgaccagtccaaccttagcagtcagcggttttagaaaaataagcaaattaaaagatgttcagtgttcactgcaaaagacattaaatgcgctttataaaagtaaagaaattaacctcactgctaaaatggttattagcgttgctacactattatggtgagatagctgatcgtattatttcacccttcatgatccagatcatatttatgtctgaatgatgcttttactgcgaaattgcggtgcagaaagccgccgtaaagccgatatgcaatgatgaatatcaaagcgggttattagtttcgcaggagagatcatgaagttgaataatatgagtgtgggtatgcgcatgggaaccggctttgcccttcttttgctcatgtcagtcattatgggaagtagtgcattctggctgactatgagcagtgagaagaaagtagaagaaatgatctcctggcatcttgttaaagaaagaatgattgaagactggacaaggcttttaaatactaacagcggagtagccatgacggcgatgagcaccgccgatcctgccctgcgcaaatcgttgcaggaaaccgtggagaaaggatccgcggacatcacccgtgttcaggaagaactgacgccgttattgcgcttaccgaccgggcaacgcctgctggcgaaagttagcgcggcgcgtgaaaagtttgtctccttacgacaggaaggacttcagcttgcaggaaacgggcaggatgaacagatcagcgcttttatactgaatcgcttttatccggcaacccaggaatacacccaggcactgaccgagctgcgtgattttcagaaagcgctcatcgataaaacctatgcggacattcggcgggacgcgaatcaatcagaaaacatcattctgacatttattattgccagcatcatcctgggcatcattatcgccgggtatatcacccgtagtattacgcgaccgctgtctgaggccgtaagcgttgcaggcaatgtttccgcaggggatttgacggtggaagtgaatgtccgctcagacgatcagctggggatgatgatgcagtcattaaaggatatggttgccgggctgggcagtaccgtcacggatgtcaaacagggcgcgctgaccatttcccatgccgccagtgaaattgacgccggtaatcaggatctggcgtcacgaacggaagaacaggccgcaagcgtggaagaaaccgccgccacgctggaacagcttacttcaaccatcaaacggtcggcggataactcccgccatgttaaccagctgtttagcgaaaccggggacgtcatccgcaaaaatggtgcgcgtatgaatgacgtgctgctcagtatggaagatattcataatgcctccggcaagatgaccgacatcgtcaccgccattgaaggtatcgccttccagaccaatatcctggcgcttaacgccgctgtcgaagcggcacgggccggtgaacagggccgtggatttgcggtggtcgccggtgaagtgcgcaccctcgcccagcgaagctcctcttcagccagagagattaaggagatcatcggatcgtccctcagcaaaatcgacagctgtcgtgaactggtggatgaagccgataaaggaatgaaaggcatcgtgaataatgtgatcgacgtgcagcagctggttgatgaaatcgcccgcgccagcgccgagcagagcgacggcatcacccagattaatattgccatgggtcagattgataccaccacgcagcagaacgccgcgctggttgaacaatcttccgctgccagcgcatcgctcaaggagcaggcgcgtctgttgttaaacagcgtggaggtctttacctgtcatgacgctgacagggtgcaggcctgagataacttcccgccagccgtggcgggaatgcttaccctttcccgccggtgattaacactcttcccttttctgccgataaccattccggagacctctggataataatcatctgtacccggtgatgggtgagcgataaaaaatgaactggcaacctactcaagcgcttaacgctgtaaagaccgacaccctcagcatagtgaagaaatcaatgctgattatgatcctgatgattgcggtgatgtttatcctcgccatcacggccacttatcatgtggcaggcgatcaaaatgcgcgttccgatttccgcagcgggaatttgctgaaaaaagcgatagaaaaccggaccgccaccatccgcgatcatctggcggactatgccgactggggagaagcctacattaatcttcaccagagtatgaatttacagtgggcatgggaaggacagaacctcggggattcgctgtacaaattatttcagtacgaaggggtttttgttatttcacccgacggtcaaaccaaatacagcgtgctctacggcgaacgcgtgcaggatccgttcgaaaactggctgggtaagccggttttacaggcattgcagaatgagctgatgttcactaaaggcctgccgctgacgcgcatggtgattgccaaaggtcagccggtgattattggcgcggcctggatcaaagccggaagcgatagccgcgtactcaccacctctgataaacactcgctgatgatctttgtcgataaactcaccccggaaaaacttgtcctgatgggtaacgagtacggcgttgaacaggtgagctataacaggcatggcggcacgccgtatcgccagggcgaggtgtccatccccaccgatgagggcagcatgatcctgaactggaaaagcgatgatccgggtggagcgctgttaaagtgggagttaccgttattgctcggtatggcagccattacgctgttactggtgctggcgctgctacgcaacgtattagccaaagcgcgcagcaacgataacaatatcgggctattaaaacagagtcagctggcgctggcggcgagtgagcggcgttttcgcgatgtcgccgaagccaccaccgactggatctgggaaatagaccatcagcgtaaacttagctggatctcagaacgtttcccggcgatcaccggctatccaacccgtcactggctcgggcgaagcctgaccgactttttgccccagtctgccgccgagatttcgcagtggttcagcgatccccgcgcggatacgctttttaccttaaaaaactgccgttatgtctccgccagcgggcagacccgttattgcagtctggtgataaaacgcgtcgatctgccgggtggcagcacgacttacaggggcacggcgacggacgtcaccgccgagctggaagcccacgaacgcgtgaaattcctctcctgccatgatgaattaaccggcctggcgaaccgcatgtatctgaaggattttctcgaaaccagagtgcgtgagcagccctattttggccatcagattgcggtcattaccctggatctggataaattcaaaccggtaaacgatctctttggtcacgccgccggcgatacacttctcaaacaggtcgcacgcctgctggaaggctgcatcaataaaaacgatctggtcagccgccacggcggggatgaattcgtgattattctttccgatattcagcacgtagcgcagatcgatgcgatatgtgaaaaaattaatgcggcgatcacagcgccctttaagatagtggagaacaacgatatttatatcggcgtcagcatggggatcgcgctctatccgcaggatgcgcaaacgccctgggatttaatgcgcttttctgacatcgccctttatgaagcgaaaaaagaggaacatacccgctggatctacttccgccagaatatgatcgagcaaatcatccagcggcgggaaatggaaaacgatctgcgctgcgctatcaatgaaaaccagttcattttgtattatcagccgcgctacgacctcaagcagtcgcgtattaacgcggttgaagccctggtgcgctgggaacatccccgcctggggctgctgatgcccgaccagtttattccgctggcggaaagttccggcctgattatggggctgagccgttgggtgctgaccaaagcctgtatcgatatcagcgaaagcctgccggagatgatcctgtcggtgaatatctccgccgtggagtttctcaatcccggactggtgcagcgggtgaaggaggcgctgaaggtttccggcctgcctgccgcgcagcttgagctggaagtcaccgaaaacgtgacgctgtcacaaccggagcgcgtgctggagatcatgcatgaacttaaatccatcggcgtgcgcttcctgattgacgattttggtaccggctattcctccctgaactatctgcgtacctttccttttgacggcatcaagctggataagtcctttatctttgccatggagtcttcagagaccgcgaaagacgtgatcgagaatatgattaatctcggtaaatcctactccctgaacgtcacggcggaaggcgtggaaaccaccgggcaactcaccatgctggagaagtataagtgcgatgaggcgcagggctactacattggcaggccgatgccgctggataaaatccagctcaataaaatgatgtgatacgggagccgcgaggctccctgttttacccgcaggctagcgcgccgggcgcaggttaaccgccagttccgcggcagacgccctgaacgctttaaggacgttttcatccggcagcgcggccaacgcccctttggcggtggtggccagcgcgccgcaggcgctggcctggctgagggcctgcttcagctgcgtcagatccgctaacgcattcccctgcgccaggcttgccagcaatcccgccataaaggcatctcccgcgccggtggtatccagactgtccaccttatatgcgctcatctcaacgatctgatcctgccataacaccacagagccatccgacccgcaggtcacgaccttcaggcgcgacggatacccgcccaaaatcgccagagctttgtcatgctgcgtggtgccggttaaccagtacagctcctcctgtgaaagcttgaggatatcggcctggcgcgcaaaatgacgcaccgtgtcggacatctcctgcgcatccggccacatctgttcacgcagattgatgtcaaaactcagcagaccaccgcgctgtttaatgctgccaatggcgcgcaccagggtttcgcgacaggtcgtggctaccaacgccagcgaacaaaaatgcagaatgtcgtcggcaaattccggcagcccgtccgccgttaaaaactgatcggcggagggatcgaccagaaaagtgaaactgcgatcaccctcgtcccccagcgacaccagcaccgtgctggtacggtgctgcgcgtcaaactgcatatgacgggtatccacgccctgctcagccagcgttgtttgcagaaaatggccaaagggatcgtccccggtacggccaataaagccacaatccgcgccaagtttcgccgcgccaaccgcgacgttaaccggcgcaccgcccgcacaggcgctgtactgcatctctccctgcggtaacaagtcgatcaccgcgtcgcctaatgcccagatcttcatacactccccttaacctgattatcagaacaaatatttaaagcgcacccgcgcgccatagcggtcgtcattgctgccgctttcagacgccgaggcatccagccaggaggcgtaagccccgaggtaaatattgaaattcggcatatccatgatctccggcagctgccatgaggtatgcagggtgtggatgtcgtaacgaccgggggcgaggatcgcgcagtcgctgtcacagtcggcatcgacgcccgccatattgaagcggtcgattttgttatgggcgtagatatagcccagctcgacgcgatgccagagggcattgattccggcgctgaagtctttttcgtctgccgcatccaggtaggcggtgctcagattcaccaccgcgccgttttccgcgtcgatccgctgggtgttccagctcatggtcataccgtaaccggtgcggctggactgatcgcgaaagcggccgttctcctgctgatagccgtaagcgttattgaccagattgctctccagcgcggcggccaccgtccaggggccggactgccaggcggcgaccgggcgcacatagaccacgtttttgcggttatcgagtgcgtttccatgatagttctgatcgacgaacagcgaactgccgtcctcaaccagcgtattgacctcgaaataccagttatcaaggtttttactgagcaggaaattgccgccgctgttgctgcgtccgcgcccttctttcatcatgtagatatagccgtagccatcgctgtagagatcgttggcggtattaccggaatattcaataaaggtatcctgattaaacgggaacatatcccaggcttcaaaacgccctattttaattttccagtcatcctgctggccgaagaaaaaagccgcgtcgtcaagattcattttgccgctcatatccgccagcggctgtacgctgaatccggcatatttgccgtctgcgccctttctcatcccgtcgaagccaagcagaatgcggccgtttatatcccagcgctctttttcacccggcgtccagtctttattagcgctggttttaagggacgtcagccctccggtgcggctggcgccgtccatattaaattccacatcgccatagaattttaattcgtcggtgtcattcacctgtaaagagggttttgccggtgcagcgctggcaaccgcacggggcgcgtcctgccgttttaaggcgcggatctccgcttccgcgctggcggctcgcgcttcggtggccttaaggcggctttccatttgcgccagacgcgcttccagtgaaagattttcctgcgcacagaccacgctgctgaatacagacgtcaacacacaaccgatccataatattttcatcggggaaccttttttattatttcgctattcaatcattaatggtgcagagggtattccggcgacagcgacagcaataacccgcccgtcgccagggacgggttattgataatctgagtgtgatttattccagctgccaggcgccgccgtcggttaatgaagcgcttccgctccaggcgaataaacgtaattcccggtttccggcatccggataaatacggctgctgaggcaggcttcgccgttattcacaaaaacttcaacggaggagctgtcgataaacagccgcacactgagatcgcgatcgggggataacggcacgctgcgcgtcccgcataaagcgtgctgcggataataccgctccagcaccagccgctgctgctgggcatcgacatacacccgcaggccgtcgccgaggctgatgccgtattgttcggcggtgctgtcggcgctattccagttcagcaccacttccatggccccggcgttttccgccacgctgatctgctgatttttaagggtgctgaccggccacgggaaccaggcctgacgcaggctttccacctctttcgccgggcgcatttgcaggcggttatcatggctcaggctaagttcccgcggcagggagagcatgcccgcccagccgtcctgctgctccggcagcggcgactcccacatatccagccagccgatcacgatgcggcgtccgtccggcgttgcgaaactctgcggcgcgtagaaatcgtggccgtgatccatttcggcaaactcaccggcgcggataaaaggctggccgggctgccagtcgcccaccagataaccgctctggaacagattgcgatttttgaagccgtcggcgttcatgccctgcggggagaacatcagcacgcgcctgccgttcagggtgaagaagtccgggcactcccacataaagcccatgccggcttccgcttcatcgagcacgccttcgtcctgccactggcgcagatccgccgagcgatacagacgcacctgtccggtttcgcccagacgtgcgccgacgatcatgtaccagctatccccttcgcgccagactttgggatcgcggaagtgatgcacgcccggcggcgtattcaccacaatgccctgccgctcaaagtggatcccgtcgcggctggtggccagacactgcacctgatagaggttgtcttcgttaccggcgtcgccgtgaaatttatggccggtgtaaatcagcgcgagggtgtcgccgtccaccaccgccgagccggaaaaacaaccatctttatcttccggtccttccggggcgatggccaccggcaaatgttcccagtgcaccagatcctgactgcgcgcatgcccccagtgcatcggtccccattgcgtggaataaggatgatgctggtaaaaagcgtgataccagccgtcgaaccacaccagcccgttgggatcgttcatccagcccgcacgggccgccagatggtaatgcggataccagcgcaggttgagcgcgtcgcgctttaccctgagttcctgttcagcgtcagcaattgagtaggtcatagtcttcactctttattcagatagcggaaagttggggtacctgcggatccgctgaagccttgccggatcgcagtaaaaagatggagataaaggtgatgccgaacaccagcatgcccataaacagataggattcggcgaagccatatttttcgtagctgtagcctgccagcggcgacagcaccgaggcgatcaccgaactggtgcaggcaaatcccaccagatagagcgtggatgagaggcgtttgtcgaaattcaggctgttgtatttgaagatcgccaccagcagcaccggcagctcgacggcgtgcagcagtttggtgatggaaattagcagcggcccttccaccagcccggaggcgatcatgcgcattgccatcaccatgcccgcgaagatcaggccgtttttcgcgccgacgcggttcaccagccagggcgcgcaaaacatcccggcggcttcaagaaacacctggaaggagttcagatagccgtacatcgcattgccttcctgcgacgtggcgaactgtgacgagaaatagaccgggaactgctgatcgtagacgccataaatacaggtgccgacgacaaagaacaccagcgcccagaagcgcggcagcgtcaacagacgcagcgcgtccgccagggtgactttaccgcccgccaccgcctcctgcatggcatggggcgcggaggagacccgcagacgggccagcagcaccatgaacaccagcccggaacagctggcaaccgcgaagttcagccgcggatcgatgttaaacagcagcccggcgaaaaaggtcgccaccgcccagcccagcgatccccacatgcgcgccttaccaaattcaaactggctctgacgcgccacgcgttcggtgtaggattccagcacgccgatgccgccgttaaaggtcaggccgataaaaatgccgccgaatacgctgccgagcagaatgttaatggtcagcagatgcccgaacagcaaatacgccgggccggagaggatcagcatcgccgtcagataccacagcagatgcttgcgcagaccgagtttatcctgcacaaagccgtaacagatctgcgcgaacagcgccgaaaccgacagtacggcaaaaataatccccgtatcccccgccttcagcccgacttcctgatgcagccagatggaaagcagcgagcctgaggaggaccaggtgacaaaaaagaagaacagcaaggcactgagtaaagggtaactgtgagaatgatggactttcatcatggcgatctcgtgttggagtaatgcgctaatggtaacgttaacaaaatctcaccttcacgccgttttgctgagattcatgatgttaatcacaaaagttaacgttaacataatggagatgagatcgcgatcaacatttcagacccacagactgcgacacagcggaaaaggaatagcgtatgatccttttacatcagcaacttagttatactgccgctggcagcgcggcaatgatggagtaaaagaatggcctccctgaaagatgtggcaaaactggcaaacgtatcgctgatgaccgtctcgcgtgcgcttaacagcccggaacggctaaaaccggaaaccctggctcgcgtacagcaggccatagaacagaccaattacgtgccggatctgtccgccaaaaagatccgcggcgcccatgcctcccccagcaccatcggcgtgctggcgctggatactgtgaccacgcctttctcggtggagatcactctttctattgaagaaaccgcccgcgcccacggctggaacagttttgtggtcaacatgttttccgacgacagcccggacaccatggtcgatctgctgctctcccaccgaccggacggcattatctataccaccatgggcctgcgccaggtgccgctgcccgccaagctgctgacgctgccctgcgtgctggcgaactgtgaaagcctgcacgatccggtggccagctatattccggatgacgaacagggtcagtacagcgcagtgaaagcgctgctggcggcgggctatcgccgcccgctctgtctgcatctcccggaaaagcatctggcgaccatccgccgccgtcaggggctggagcgcgcctgtcgcgaagcgggtatcgatccgcatacgcttaaccacgcgtatatggaatttggcgatgaacactaccgcgatatgcccgccctgctgctggcgcatatccacgacggcagaccgcagttcgacgcggtgatctgcggtaacgaccgcatcgcttttatggtctaccagacgttgctggcacaggggctgcgcattccgcaggacgtggcggtactgggttacgacaatatggtgggcatcggcgatctgtttgtgccgccgctctcgacggtgcagctgccgcattatgagattggtcgtctgagcgcgctgcatatcattcaacagcaaactcatcgcgatactgtccgtgtggaaagcccgctgctgctgcgcgagtcgttgtaaaacgcgcccccggacaggcgggcgcgtgtgccgggattactcttttgcgatcggcgtggcgttctcgtcgattttcgtctcgccctgaatggcggtaattttcttctcaacgtccgccacctgttcactgctgtgcaacagggtgtaggtcagatcaaactgcgtactcgcccctggctggagctgcttcacgcgtttctgctcgcgctcgatggtcaccggataggcaaaactggtgcccggctcaatgccggtgacgtagccctgtttgagggtgtcggtatttttccatagcgtcagcaccggcaactggcgggtgtcgaactggatggatgcgcccttatcacccgctttgttcaccacggccgccagcgtctgatgatcttcccctgccagcggctgaatgttgaataccatctcgtcaaagcctttggtcggcccggcgtaggtctgccagtttttcaggccctctttggcatagtcattgaacggactgatagcggacatcggcgcgaggaagcgcgcgccctcttccaggatcggcatgccgaagttgctgtgatagatgatctggtaatcgtgcggatagtccgcatcgttggtcagcacatcgtgcaggctgaaactgttgctgcccggcacgtagcgcagctcggtcagggtctgcaaatccgctttcttgaaggtgctctctttaatcaaccctcgaatgcggatctcatagggcgcggcgtccgctacctcgacttccacctgcgaggcgggcgtattccccgctttgccatggagcgtatagatttggccgtcagcggtgaccggatgaccggtccattcgtagccgcagcgcaccatcatttcgttgaaaccttccagccagcccagcccgttacggctttccagattaataaacgccgggttaaccacctctttcaccggcgactcccagcccatttttgagccgaagccttccacacgcagcagattcataccgcgcgtcggactgagggtgatggtaagcccgtccttactggtaaggatgagtattttactcccttcctgcttaccgccatgtagcactttttgctcaatgctgaaactgtgatctttgacgttcagctcctggctggaaatcttccagtttcctttttccacgccctgttcagcgctggtcagcacccaggtttttgccgccacctgtcccgaaatcattactgcaagcaccgttaaagccagtttaattttcatttttcgtcctttttgctgaatcgattattgactgacccgcccgaatctactgattagcaggttaaagaaatgtgacgaggttcacctgccgggaaaagcagcgtttttaagggaaattatgtggttttgatcgcatgaggaatgaaaaatccccgcacgattgccgtaattatgcggggttgaacagataatgctttaacgattcagcggctaaacaggctggccgggcacgggtgtggcgcgaaaggcgttaaggctgcggtccagtatgacctggtgatccgccccggaatccagcaccgtattgtgcgtggctgcggacgccaccagcacggctgtcaccgccagcgcaacgcggcgatccgttgccagcaaggcccccacctgggtggtaaaacaggagccagcgtcagcagactgttcagcacctgcttcgcgggtggcgatgatatgattactagcgatgtaattcccctgcccgacgacgagatgaatgatcaccggccttgtgtccggcggtgtgctaagcgccgtgtcgggggacgcagagatatgattaccgatcacggaattgtgatcgccattgatatgcaccagcccgaagctgtcatcaaggccgttatcgtagccctgcatcggcggccacggctcgcggtcacgcagcaaatggttggcggaaatcaggttctccgagcagttatcttcaaggatcaccatgcccggataaaaggcgtgaaaacggttgccggtaatacttgatcgcgccacccccgagaaatgcacgctgcttttaccgcgcggaaagatattattggcggcgatcagcagcccgccaaaattctgcgcataaatggagtagcctttgtagcctgccccgatcaggttatcggtaatttttgaggcctggcccgcgccgcgcagttccacgcagttaccgcattcggcaatgaaattatcatgcaccgacagcgcgtcggcgtggtaaatggtcaggccgtgctccagatagacaaaacccatgccgttgatgcgaaacgagtcctgggcgctggcgatataaatccccgtcttaccgttcacatagctgttttccggatcgttatgccccaggtcgtcatcgacgaaatgcagcccatcgatgcagaagccggaaaactccaccgagctgatgcgcggctcgccgctgcgctccacataaaaggccgcccctgcatgctccggctgcccgtcgcctgcggcaatatccaccagaatacggctgccgcccggccagatttcatgccagttcggccattcattttgcggcgcgttaaagcggatgctggaagacgtaaagccatgcccggcgcccatgattttcaggtaactgatgtcgatgagtatctgcgtggtgaggtgataatcacccggcggaatataaatgaccgcgccgggcttgccgccgccgttactatcagtctgcgtttgtcggcttttaatatcggcgatgatgctgttgatcacctcgccaatatctctgtacgggttaccggtatgccagcgggtgacatcataatggttattgctcgtcatcagtagatcctcatttacatgacagaaagttcgcgtttagccaggtcgactttgattctttccagcagttgattgtcgagtttgaaataacgcaccatccaggcgctgatgaaatagctcaccatcggcagtaaggagaacatgataataatgccctggagggtttgcggattttgttgcggctggttggcgacgtagccggtaaaggagaggatccaggcgacgatagccccggcgactgccagccccattttcagcataaagagattgcccgcaaaggagatgccggtcagacgcttgccgtatttccagtcaccgtaatcatccacgtcagacatcatcgcccacagaatcggaccggactggatcaaatgcagaatattgatcacgataaacagcgccagcagcggcgtcagtgattgcggatcaacgaaccacagcgcgaatgacagaatgccgagaataatattgataatgcggaaaagcttaattttatcgaaacggtcggtaagcggtttggcaatcacgctgccgaacatattgcaggcaacgccgagcgccataaaaaaggtcacaaatcctaccgaggcgtgcatcacataggtggcgtaataaatagtcaccgccccacgaataaaggccgggaaaacgtttaaaaaggtaatagagatcatcagcagccactgatcatttttgatgatgtctttcagatcgcgcattaaggagtcattggcttttactgatctcacccgctctttaatactgctgaagcagaacaggaacattagggtggcggcagcacccatgatcatcatggtctgctgaaaacccgccgcgcggtcgccctctcccagccattcggtgagcggcagaatagacgaggacacaatcagcgtcgccagtccgttcaggaagaagcgccacgacagacagcccagccgctctttctgattcagcgtgatcacacccgccaccgagcagtagggaatatttatcgcggtataaatcagcgacatcaccagataagtcacccaggcatagattattttgccgctcatcgtcagatcgggcgtggtaaacatcaccaccgcgcccagaccaaaaggcaccgccatccacagcaaccacgggcggaatttgccccagcgacttttagtgcgatcgcatattgcgcccatcaccggatcgctgaaggcatcaaatatacggatcaccagaaataaggtgcccacgacgccggcatcgaggccataaatatcggtgtaaaaccaggtcagataaagtgccagcacgctccagatcatgcaggaaccggcatcccccatgccgtagcccactttttctttcaggctgagcttttcataagcgctgtgctttgatgttgtttttacagacagagtgacagacatatcgtgtaccttttcattgcgcagtcgtgaacgccgggcacgggtcatcagaccggtcccatccgggataaatgtcgtggtaataaaattcagataaaaaattaacgcgtcataaggtggtgatattcagcctgacgctgctctcgcggataattaaccgcgaaacgatctccaccatgtcgatactttccagctggctgttatttttcaccatctgaaacgccaggtgcgcaatttcatttattggctgcgcgacgctggttattttttgtgtttgcgccagcacagtattatcaaagctggcgatggcaatatcgtccggaacggtcagcccctgcgctttcaggccatcgataatgtagcaggcggcgacatcgttatagaccagcagacaggtgcagcgcgccgggtcatttttcagtttatcgatgatcacgtccaggttatggatatgcccggaggttctctccccctcgcctttaccgatccagaactggtgcgccagcgccagttgcaggccgtgcccggtaattttcctgctgtaggccgacaccttgcgattatccaccccgtcctgggcgataaaaccaaaggcagtgtggccggtatgaataaaatgcccggcgatattctccgcgccacgggtctggttaatggacactgaattaaaaaagcgggagacctgcgtgactaccgccaccggtatgtgggtggcacgaagccattccgataattccgcctcggcttcagtgggcacccacagcagactgtctatgcccatgccaatcagactatgaataatctgtttatcctgttgcggctgattctgatgcgttttcacaatcaccgatttgccaatatagcgggcctcttcttcaaaggtggccagtaattcgcaaaagtgagggttgaccagattgggtaataccacgccaatcagacccgaacattttccgctgagttgcacggcgcttttcagtggcacataacagagaaaatccatggcatcccgcaccgcctggcgcgtttccggattcacgcccggatgattattcagcacccgggatacggtggcggttgatacaccggcttttttggcgacgtctttcagggatgccataagaagttactgtgtctctgtttgatgtgcagtaactatagagtgtgatcaggctcaaaaatgttagcccgttcacatgtcatttcgttacatcggcacagagatcgggatctcatttttcatttgattcaggagagactaccatcattaccagttatctaactcattgacttaagtctgaataccatgaaaatgacgccacccacaccgcttaatgcgaatccggagactatcatcgcccgttatcatcgcttgccgcgcctgcgccgcgttgcccgcgtggctgcccttaccggctgcgctctgctgcttgccagctgttcctccagagcgccgcattcgctggtcaccccgctgccgccggtgacaaagcagccgctggcggataaatcatcacagtctgacgaaccggtgcgcggggtctggctggcgacggtgtcccgccttgactggccgccgcgtgagtcggtcaacggcagcagcagcgcggtgcgcatccggatgcagcaggaagcgctgaaaaccaagctggataatttgcagcggcttggcatcaacaccgttttcttccaggtaaaacccgacggtacagcgctgtggccgtcaaaaattctgccgtggtcagatatgctgaccggaaaaattggtcaggatcccggttacgatccgttgcagtttatgctggatgaagcgcaccggcgcggcatgaaagtccacgcctggtttaacccttatcgcgtctccaccaatatcaaaccctctaccgccagcgagctgaacagtacgctggcgctgcgtcctgccagtatttttgtgctgcaccgtgactggatccgtaccgcaggggaccgctatgtgctcgatcccggcattccggaagtgcgcgactggatcaccagcattgtggcggaagtggtgacaagttacccggtggatggcgtgcagttcgatgattatttctatgcggaaacgcctggttcgccgcttaacgacagccagacattccggcagtacgggcagggatttgcttcgaaagcagactggcggcggcataatacgcaacagctgatcgaacaggtgtcgcgcaccatcaagcagctgaaacccgaagtggaatttggcgtcagcccggcgggggtctggcgcaatatttcccacgatccctccggttcgaacacgcgcggcgcggcggcctatgacgaatcctttgcggatacgcggcgctgggtacaacagggattgctggattatatcgccccgcagatctactggccttttgcacgggatgcggcgcgttacgatgtgctggcgcactggtgggcaaacgtggtgaagccgacaaatacgcgcctgtatattggcgtcgcattatataaagtgggtgaagcgtcgaaaaatgaacccgactggacaattaacggcggtgtgccggagctgaaaaaacagatcgatttgaacgagtctgtgccgaatatcaacggcactattctgttcagggaagactatcttaatcagccccagacccgggaggcggtcagctatttgcgtggccgctggggaaaataacgcttacttaccgtgaaatacgatggtgaaaccctgttcgtgccagtgctcaaactgttcctgctggcggcgcgtcagggttttacctgtccagataaaaatatgctgccccgggaagagttccggacgcggcagatccagcggttcggcgagcacgtcaatatgccagcctcgctgcgaaagacgccaggcttccagccacagccgggtacggtcgtcagtatcccagccaatcaggagcgcctctttacctggttttaaacgtgcctgcgcgacacagctcacggcgtattcaatcagcgcgccatccagcaggctgctcatcgcgcgggcagtattttgatcgagatttaaacgctgacgcaccggggtataaacatgatcgattaaggcatcgaccgggtgctcacgccctgcttcattgattttggcgcgtaagttcgcaggattcacgcggcgcagcacggccatcatctcttcctgctgtaatgaccagccgtcgtccaccgccacttcttttgcttccagcaatgccttcacctttccgaccggtacgccgcttttgatccaacgcttaatatcttcgatgcgctgaatatcctcttcatcgaactgtcgatggccgccttcactgcgctgaggtttcagcaatccataacgacgttgccaggcccgcagcgttacaggattgattgcgcatcgttcagcgacatcgccaatactgtaatgagccataggtctcctttgtacatctatttaacacttcaccttaaactaaccaatatcctgagcttgtacaaacccttttttgttgtacaagaattatgtgactgtttatcaacactatttataattttcgaatgaaaaaaaagccccgcttctgcggggcttgtacaaaggtgtagcggatgattataagtcggctttcttttccggccaggccacctgcgggatttgatcaaaggccggacgggcaaaaagatgtccctggaactggctgatgccagccgactccagccacatccattcttctgctttctcgacgcccaccgcggaaacggcaatttccagcgagtggcagcatttaataatcgcctgtatcaccgcctgccgcggaccgcttgtatgcacgttcttaatcagctcgcggttaatcttgatcctgtccggctgaaactgcgtcagcaattgcagaccggcaaaacctgcgccgaaatgatcgatggccacgctgatacctgcggctttcagctgacgcaccgcgccggtaaaggcgtcaaaaccggatattacctcgccttcggtaaactccacgatgatctgttccggcaccagtccgctggtggcgataccctctaacaacacatcaaccgcttcgggtattttcaccagcgtcatcggcaatagatttaccgacaacgcctgctcatgcaggtttaatccccccgccatcgcaaaagcgacttttttgctgtgcagatcggcaaggtatacctcatccccctgcatacccgcaaaatacgcctgcgggccgccgccatccggtgtacgtaacaacgcttctaccgacgcgatttcacgggtcagcgggtcgataatgggctgaaacgcaaagctgtactctgttgacgttgatttcaacggtgcgccaagttgtacaacctcatcatcgggtacaaattcccatgcatcgccggcagggatctcaaaataattctctttttctgtggcttcgacaaaggtgcggaagaattgcagcgccctgtcgttatacgttaactgatatttcgacgtgcctttgtccagtacgacctgcaaaacttcctctttttcggactgccgtaaatcaaacaattccataccggctttgccgaagcgtcttgcaggagcgtaatcatacagaagctccactacgttatagtggcgttggtcgcgacagatatgacggtaaatttccaccacattttcttcagggccttcaagcaactggaagaagtgcgtgccgttgaaaagtaaaatgcccgtaacatttgcccgactatttatctggtttgcacccgctaccatttcttccagcgatttaactgaaacgttatcgcatatatggctgcggtagatgatggttgtgagcattttttccccgagagtgtgatatctgcggccaacattaacagatgccaggctattcgtcttgtccgtctgtggtcttcagaaaatatatttttgtccagatattacagtggcttaagcccgatacgaaagtcattctgagtacaaatttgccttgtataagctgtacaactccccatttacaccgccaatttattttcgaccctaacagactgaaatgaggacgatatatcctccagactccaaaatacctaaaaacctgtacgctggctatgtacaagtttagaaagtttgtataacttagtcgacaagttaacaagttcagcacatttaacaggagcgaccaatgcaacaggacgggtataccttcgattcatctgctgccattgcacaatattttagtaaagccgctctgccgactcagcaggaaacgctgggtgaaattgtggtggaaatcctgacgacaggtcgccatctcaatcgcaaaaatctttgtacaaaattactggtacgccttgaacaggccggcagccaggaagaagaacaacattatcaggcgctgatcggcatgttatttgaacggcagatttgatgtctttcacttaagaaatcattagatttcgaatgaaagcaaagtgtctgtatattccctgacttcagtcagccaataaactcttaaccgcggtgaaataataatgaattccatgattgcacagcaaccagacgtattttcagcactgcacaaccccgctttatccgcttatgttcgcaacgcctctgatttaatgccggatgaatccgccctgctggctaccgctatcagaagcctgctggtgtcccagggacatgccagcaataaagacattatcctgtggttaatcggtacgctggaaaccacgcacgatgccactaccgctgacgtgatccgtcactgccttgaactggtggtcagctacaccatggacgacatctgagacagatttaactctgcatcaggccaatggattggccccccctctttacctcgccttttgcttccccggtttttgcatttcatcccccactgtctggtttattcattcagccaatcaatgtgattcagcccacactccgccatgaaaccggttgcacgcgagtcgttcactgctagcatgaaaccggttacacgaaaagtcacataaaaatttacccataaaaaaggtacatgaataatggcagttatcagggattacaataagttagccagtgacatccttcgcgaggcaggcggtgaaaataacatcagcagctttacccgctgcgccacccggttacgcctcgtactcaatgaaactccggcggaagctaaaacgcgcattcaggatctgcccggcgtcatcgccgtggtggaaagcggcggtcagtttcaggtggtgattggtacccacgtcgccgacgtattcaacgcgctctccgccctgctcggcgaaaaccatgccggtgcaacagcaaaaccgaaaacccgctggctggatgcagtgatcggcaccatgtcggcggtgttcgcgcccatcgtttatattctggcggcagccgggatcctgcaggggctgctgattgtggtcgggcttatcgatgccgatgtaaaaaccaccggcaccttcgccattctgaactttatgtcatggacgccctttgcgttcctgccggtatttatcgccataaccgccgcgcggcatttcaaatgtaacccctatattgcggtgctctgctgttgtgcgctgatcaacccggaatggtccgccatggcgggccgtatcgcgggcggtgaaaccattactttcctgttcatcccgctggcgaaaacggtgtacacctcgtcggtgctgccgccgttgtttcttgtctgggcgctgtcgtggctggaaaagcgcgtcgagcgcatcctgccggacgtggttagcgccctgttcactccgctggtgtgctttgtgatcattgtacccttgacgttgattatcatcgggccggtaaccacctgggcggcgatgggcattgcctccggctataacgcgctctttgcggcagcccctgcggtggcagcggcggtgattggcggcgtatggcaaatagtggtgatttttggtgttcactggggcattacgccggtgatcatggcgaacttcgacacccagggctatgactccttccaggcctaccagaccatcgcggtgatcggccagatggcggcggtgttcggcgtcttcctgaaaagccgcaaccgcgaactcaaaaccacctcgctgtcggcgggcgtgacggcgattttcggtattactgaacccgctatttatggcgttacgctgcgctttaaaaagccatttatctgtggttgcatcggtggcgcggttggcgctgtcgtcgccagcctgtttggttccctctattacgcgtacgccgccctgcctggtctgttcacgctggtgaacgccatcagcccggacgcgccactgtcctttattggcgagctggcgggaagcgccacggcgatcgtcctgaccattgtgctggtacagtttgtcggctttgaggatccggtggctgaagaacagcgtagcgaaccggcaaataatccagtgacggctgcgcctgtcagcctgaaaatcatgagcccgctggacggcgaagtgatggcccttgaagatgtcgccgacgacgccttcgcgcagaaagcgctgggtgatggtatcgccatccggccgcagtcgggcctggttgtcgctccctgtgacgctcgcgtagaaacgctcatcgactctcatcatgcggtcgggctggcgtgtgataacggcgcagagctgctgatccacgtcggcctgaacacggtgaatttacaggggcaacattttcgcccgctggtcaaagaaggcgatatggtaaaagcgggtacgccgttgctggagtttgataaagaggctatcgagcgtgccggttacgacctgaccacgccggtactggtgatcaacagcgacgactaccgcttaaccaaacatcagtctcacggagatatccggcagaacacgccgctgatgaccgtggcctgaggcagtcatcctgcggcagagtggccaattcgctgctctgccgcacaatttccgctgcaaaatccccttactatcatgctcctgctgcataataggcagaggtattgataacaagcaggaatttatggtcacgatactggatgttgccagaaaagcgggcgtctcaaaagcgacagtgtcacgcgcgcttaacggtaaggtagtggtcagcgaggacgttaaagcccgcatctttcaggccattgaagaaaccggctaccggcctaatctgctggcgcgcaaactggcgaccagtgaatcgaattccgtcgggctggtgatcaccaacggcctgtataacggccccttcttttccgccatgatttaccaggccgcgacctgtagtgaagatcaccagcgccagctggtgctcgccgacggcaagcacagccgggaagatgagcgtaatgccataaatttcctgctgcagctgcgctgcgaggcgatcatgatctatcccaaatatctcagcgttgacgaacttgatgacatcatcgatcagaatacggtgcccgttgtggtgattaaccgcgagctgaagcgtaaccgcaataacgccgtgtatgtcgatcatcaccgttgcagcatgcagatgatgaactatttgctggaacaggggcaccgcaccattgcctttgtgggaggcgctgaaggttccccaacgggcgacagccgccttgccgggtatcgcgatgcattaaaccaggcgggaattgtcccggatgaatccttgatcgtgcgcggcagctggagcacggaaagcggctatgaagccgggtgcgcgctgctgaaacagcgtcgcgacatgacctgcattctggcggccaacgatgatatggctatcggcgtcaccaaagcgctgaccgatcagggtttccgcgtaccgcaggacatctccgtcgccggttttgatgattccactatcgggcgatacttcaccccgacgctgacgacggtacatatcccgatggatgagatgatcagcgacgcggttcgcattctgttatcccccaccgccgaaagcgaaaccgacccgctgccgcgccacgagggaacgctgattattcgggagtcggtggctgcacgtcgctaaatgtgcatgaggtgttaataaaatgcctcctgcgaaaatgcctggcctgcgtttattcaggaaatgttctttttatttgcgttaagtcttgaggtcgttctttaaataagagtgccgatatttttatttatcaattttataacacgcttatttaatccctgcttaaaaaatatttcttccgcctactatccgtcgcattgcgcttagtagaaaatgccacgccgaaaacaaaaatatgcactgcccgacacttattttcagggtttacctgaaacacttcatcgtggggattttatgaagcgtaacactcctgttacacaaaaagagtatttgcttaaagatggtatgacattaatgtcgaccaccgatacgcacagccatattacgtatgctaactccgcttttattgacgccagcggctatgaagaagaacagctgacgggcgaaccgcataacgttattcgccatcccgatatgccagcggcggcctttgcggatatgtggtttaccattcaacagggcgaaagctggacggggctggtgaaaaaccgccgtcataacggcgaccattactgggtacgcgccaacgtcacgccggtttatcagcaggagcggcttaccggctacatctcggtgcgtaatattccgttgcgcgacgaaattaacgccgccgaaaaactctacgctgcggtaaatgaaaataacctcaaaggtcaccgcttttataaaggcctgctggtgcggcggggtttattttccttcctgtcgctgtttcagtggctcagcctcgcccggcgaattcatcttggaacaggtattagtctgctggcgatagtagcgctgcaaatgacgcccgtgatgctgccggtgaaaataagcgccacgatgcttatcctggcgctgttatcatggtttctcaccgcgcaaattgcgcgaccattaaaaaccattcttacccagatgcagaaagtgatctccgggcgcaaggccgattacgtgcagtttaatcgcgtcgatgagatcggtttactgctgcgcatggtaaatcagtccgggcttaacctgaattccctggtggatgacgtcaatacccaactgcacggcatccggcagatcagccagcgcatcgccaaagaaggcgtctccctgcatacccgcacggaagaaacttcagccgatttgcagcagacggcagcggcggtggaagaaatcgccagtgcggtaaaacaaacggcggaaaccgcaggcgaagcgatgctccgcgccgatgaaaccagcggcaatgccatgaacagcggcaacatcatgaaacagaccatcagcatgatgcagtccgtatcccgtgataaccggcagattgttgacatcatcagcgtgatcgacagtatcgccttccagaccaatattctggcgctgaatgcggcggtggaagctgcccgcgcgggcgagtccggacgcggttttgcggtggtcgccgccgaggtacggcaccttgcgcagcactcggcgtcggcggcgaaagagatcaaaacgctgatcgagaaaaatgtggccaacgtcagtcatggcgtggcgatggtggagagcaccgaatcgcacctgacggccatgatcgacaacgtgctacagatgtcacagatgatcaaagagatcggcaccgcgacccgggagcagacccaggcgctggcgctgatcaatgagtccgtctcacgcatcggggtaatgacgcataacaataatggcatggtggagctggtcactcacgccgcaggagatctctctgcccgcgccgcgcgcctgcagcgggcggtgcaggtttttggcagccactaatctgctatagttttcagccttatcagacctcaaggctgacattgtgctgcgatcgttacgcatttctttccttatgatactggcggcagccgggtcgttcagcgcgatggccgctggcgcacagtatctgccgcctgccggttttaccctgcccgttcgccctgccgcgacgacagcagttacctgcccgccggtgccgccgccctttaccggtgcgctgcgtttgcgcagtaaatatgaaggatccgacgccgcccgcgccacgctgaatgccggtgcggagcaggcctatcgtgacgcgacccgcacggtcgatgcgatggagcgccaggtcagcaaactggtacaacggggcgacagccattgcgctatagacgcgcttaaccgctgggcgcgggccggtgcgctgacctccacagacaccacgcataccggcagagcggtgcgaaaatgggcgctggccagcttttcatcggcctggatccagctgaaattcgccccacagtacccactcaaagacgatccggctgccgcttcacaggtggaaaactggctaagccagctcggcacgctcgtcgcccgcgactggaaagggctgccgctcaacaaaatcaacaaccacagctactgggcgggctgggcgctgatgtccacggcgctcgccaccgggcgggacgatctgtttgctgatgccgtcgctctgctgcgtaccgctttgcgccaggtggacgatcgcggatttttacctaacgaacttaaacgacggcagcgggcgctggcttaccataattacgccctgcaaccgctggtgatgctggcgctgtttgcccgcgccagtcaggttccgctgagcgacaccgaaaccgccgcgctgaaacgtctgggtgagcgggtgattgccgggctggacgatcccacaccgttccgcgacgccacgggcgttaagcaggatcgtcactttttaaatcagccgaccaatctggcatggatggaagcctggtgctctctctatacctgctccgcggcagtcaataaccgccttgccccgctgcgcccgctcaataacgtgcggctggggggatcttatgcgtctgacagagcaaaatctggtagcgaggggccactagtcaaacttcggttcccccgttacactcactgtattcattcacctgataaatataaaaggaggttacttatgctgtgctgtgaattgtttatccattcacatcattttggcgatcgccactgctcaagcgttaccagtatcgtgctgcgataactgaagcttgagcgaagctatcacctgactcccttctctcgggcttaccgggttatcgtcagcgatgtttgacgaggcacgcgcgtgcctgtaactcttgagtaagcaatgagcacattactaactgcacaatcccttcgtgtcgatacggctttcggttcgctgtttcgcgatctctcttttaccgtcaaaaaaggcgaccgcattggtctggtgggctataacggctgcggcaaaagtacgctgttaaaagtgctggacggcaccctttccccgaccgctggcgtctattctgtggcccgacactgcctgctggcgcgggtcgaacaacacctgcccgatgagctttcttctctctccatgcttgacgcggtgctgtcgcaactgccgcaggcggaacgcgatgcccggcgctggcaggcggaaacgctgctcgccagccagggcttcagcgagcgggagtgggaattatgcgcgggtacgctcagcggcggccagcacacgcggctgttgctggcgcgggcattgatccgtcagccggatctgttactgctggatgagccgagcaaccacctcgatctgccgacgctgctgtggctggagcagtttttgcagcgctggaacggcagctttgtgctggtgtcccacgatgcgcgactgctggatgcggtgaccaacaccacctggatcctgcgcgaccagacgctgcactgttttgccctgccatgccaggccgcacgacaggcgctggctgaacgggatgaagccgacgccctgcgtcagaaagccgaacagaaagagatcgaccgcatcaccgccagcgcgaaacggctggcgacctggggacaggtctacgataacgaagatctcgcccgcaaggcgaagcagatggaaaaacagatcctgcgcctgaaagaggtgcaaaccgacgtcaccgccggtagtcactggacgctttcccttcagggcgatgcgctgcgcgccgaccgtctgctggagttgagcgaacttgatgtcgctccggcagcggatgctgcgccgctgttcagattgcccctgggccgtatcaaaagcggcgatcgggtggcgattatgggacgcaacggctgcgggaaatcatcgctgttacgtctgctgtggcagcattaccgtcaacagcggctaagtgaaggcgtggtgctgcatccgcgcgttaccatcggttactacgatcagacgctccatcagttgcatgatgaggatacgctgttcgatgcgctggagccgttcgccccgccgccggaggtgcggaaacaggcgctgatcgccgccggtttcgcctgggcgcgtcacgggcagcgggtcagcaccttaagcggcggcgagcgctcgcgtctgctgtttgtcggcatgtcgctggcgcgttatgccctgctgatgctggacgagccgaccaaccatctggatatggaaggcaaagaagcgctggcgcagacgctttccggctttgacggcggcgtactgctggtgagccacgatcgtgatttgatcgccagcagctgtaaccgtttctggctgattgaggacggcgagcttcacgagtggcacgacgtcgaggcggtgtttgcgcgactgcgggagccggacgcggtgacggcacctgtcgcggcgggatcttccccccggcccccggagactgatggcgatcggctgctcgctgagctgattgccctggaaacccggctggcggaagatttggcgcgcaagccgaaacatcagaagccgcaactacaggcgcagtggcgagccgctattgacgacatcaaccggcagctggagtagcgaaacccgcgccgggtcacagactgttctgaaacccggcgcggccattgatatttggcatggaatgacccaacatcaaaggtgccgcgcacttttcgtaccgcgcggcattggctttcgctatgggattacgctcacccgtcaatgttgcgggcgcgtccttgaaacttgtcacaggattaaggagtcagcatgaaaacgaatcgtcaggcacgtcacattctgggtatggactacaaagtgtctaaccagagaaaaatcgttaccagtgaagatcaaccgacggtagtcacccaccgcaccggtcgccatcgtcgcgcgaagtcataatgttatcgcccggcgacgtacgtctgccgggcctgctgaacccgcctcgcaattctttaacattctccttacgattagacgcatccgggaagtatttgccatcggcatgctttatacttgcgccgccgccgtccccgtcagcatgcaggcgacgggatcgttttttaaggagttttgagatgttactgaagtataaaaaaaaccgttctctgtacattccctatgccggtccggtgttgctggaattcccgctgctcaacaaaggcagcgccttcagccttgaagagcgcagcaacttcaacctgctgggcctgttgccggatgtggttgaaaccattgaggagcaggctgaacgcgcctggttacagtatcagggcttcaaaacggaaatcgataagcacatttacctgcgtaacatccaggacaccaacgaaactcttttctatcgtctggtcgataaccatctcgacgagatgatgccggtgatctacaccccgaccgtcggctccgcctgcgaacgtttttccgagatttaccgccgcgcgcgcggggtatttatctcctatcagaaccgtcacaacatggacgacatgctgcaaaacgtgccgacccacaatatcaaagtgattgtggtaaccgacggcgagcgcattctggggctgggcgatcagggtatcggcggcatggggatccccatcggcaagctctccctttacaccgcctgcggcggcatcagcccggcgtacaccctgccggtggtgctggatgtcggcaccaataatcagcagctgcttaacgatccgctgtatatgggctggcgtcatccgcgcatcaccggcgatgagtattacgcctttgtcgatgaattcattcaggcggtgaaacagcgctggccggacgtgctgttgcagtttgaagatttcgcgcagaaaaacgccatgccgttgctgacccgttaccgggatgaaatctgctcctttaacgacgatattcagggcaccgctgcggtaactgtcggcacgctgattgccgccagccgtgccgcgggtagccagttaagtcagcaaaaagtggtgttcctcggcgcaggctctgctggttgcggcatcgccgagcagattatcgcccagatgcagcgtgaaggcctgagcgaggaagccgcccggcagaacgtctatatggtggatcgttttggcctgctgaccgaccagatgccgaacctgctctccttccagagcaaactggtgcagaagcgcgacaacctgcagcactgggataccgatgcagaagctatgtcgctgctggatgtggtgcgtaatgtgaaaccggatattctgatcggcgtctccgggcagaccggattattcactgaagaaattattcgtgaaatgcataagcactgcccgcgccctatcgtgctgccgctgtcgaacccgacctcccgcgtggaagccaccccgcaggacattattacctggaccgaaggccaggcgctggtcgccaccggcagtccgtttatgccggtccactggcaggataaaatcatccccatcgcccagtgtaataacgcctacattttccctggcatcggcctcggggtgatctcctccggcgcgtcacgtatcagcgacaacatgctgatggccgccagcgaaaccctggcgcagcactccccgctggccaaccacggcgaaggcatggtgcttccggcgctgaaagatattcagaccgtgtcgcgggcgattgcgctggcggtggcaaaaatggcgcaggaagaaggccttgcggtgaaaacttccgccgaagccttgcagcagtccatcgaagaaaacttctggcagccggaataccgcagctaccgccggacgtctatctgagttttatggcgccagcgataacccgctggcgtcattttaatcagctatgatagaatgtacggcaatttaccgtacatacgaaggttgaccatgtccaccgcgaaaaaagaacgctttgatttccggcttgatgaaagtctgaaaaaacaaatggaagaagccgccagcctgctaagcataccagtcagtacttttgtgatcgatgcggtgcgggagcgggcagcagaagttattaatgagcaccggcgtatcgtgctggatgagcaaaactgggagcgcattcagaccttgctggacaatcccccacagccaacggaacgcatgaaagcaatggctgcacattatcatgacaaagacagctggacgtggcagaagaattaacgttaagcatagagtcatacgatcctgcccgaacctatcggacagaaaatttcagttgtggcgttgaggcgctggatgtgtttttaacgtcccagatgtctgttcagcaagagcgacgtattctgcgttgctacgtgctggtcacaaacgaagccgttcctgaaattatgggattttataccctctcgggggcttcatatgaaaaacagcacctttccggatcccagcaacgcaaactaccttatcgtaacctgccctgtgttctgcttggcagaatggcggttgatcgacgcctgcaacgacggggtttcggtgagaaattattgtttgatgccctacgccgcacctggttaaccgcgggcatggtcggcatctatgcgcttttcgtcgaagccaaagacgaggccgccgtaaaattttatcagtcattaggcttcacgctttcaaaatcgcagccgttaacgctcttctaccccgttaatcagttcgaatttttaatctgatccctggctagcgaaaatagtgttataaattcgccttcggtattcagaaaaataacggacgagggatgacccaaaaaagagcaacgctgaccggcttactggcgattatattatggagcaccatggttgggctgatccgtggcgtcagcgaaggactgggaccggttggcggcgcggccatgatttacaccctcagcggtttattattactcctcaccgtgggttttcccgatattcgtcgtttcccgccacgttatttactgataggtagcctgctgtttgtcagctatgagatgtgcctcgccctgtcgctgggctatgccgcgacgcgtcaacaggcgattgaggtgggcatggtaaattatctgtggcccagcctgaccattctgtttgccatcctgtttaacgggcaaaaatccagcctgtgggtgatccccggtctgttgctttccgtgcttggcgtcagctgggtactcggcggtgagaatggtctcaacccgcaggatattatccgtaatgtggtctccagtccgctgagttatattctggcattctgcggggccattatctgggcagcgtactgtacggtcaccagcaaatatgcccgcgggcataacggcatcaccttttttattttgctgaccgccatgagcttgtggatcaaatatgcgctcggcgagcagccgccgatgatgttcagctggccggtgacgctaaaattactcctggtggcctgtgcgctgggttttggctatgcggcatggaataccggcatcctgcatggtcacgtcaacgtgctcgcggcggcatcctatttcacgccagtcctctcctcggcgctggcggcgttgctgctgagcgccccgctgtcactgtcgttctggcagggggcgctgatggtctgcggcggatcgctgctgtgctggtacgccacccgacggcgttaatccgtctggcggttatcggtacccgcaaggctaaaccagatccccaccgccaggataaacagcatcacgcctgcgctgcttaaggccacactgtgcgagctgataaaggccgtttttgccgcctgcataacagcggcggcaagtccaggctccagcgtctgcgccagttgtaccgcctcaccaatggacgacgtcgcctgcgccgcctgactgacggtgagcgcatccggcaggacgatggacgtagcaaaactgcggcttagcaacaggccaaaaatggcgatccccagtcccgcccccagctcgtaagccatggtttcgattgcgccggcggcggccgctttctcttttggcgcggcggccataatcgccgcggtggaggccagcagcgcgctggcggcgctgaaacctaacagcgccatcagcgcggcggcctgccactgctggctgctgaagtcagtgaccgacaggccaaggaaactcagcgcgctcagcgccatgccccccgtcgccacccggcgcagcccaagccgcgacaccagcagaccggcgatggggccgctgaagccgctcgccagcatcaccggcagcataaacaccccggcggcgaaaggcgtaaagccatgcacaaattgcagctcctgcgccattaacagctcaaatcccaccagggtgatcatcgaagtgatagccattatcacgccgcttaaaataatgcgattcgtaaacaggcgcatatcgatcatcggcgtgcgggcggcaagctggatacgcacaaaggtcaccagcaggatcatgccgagcaccgccccgcctgccagtaatcccggcgcgaccgtggttttcagcgccattttgacgcagtagaccagcagtaatatcgccacaatcagcatcactgcatgaccgaaattgagcggctgatcgcggcgaccggtctgtcgcggcaccagccaggcggtcagcgccatcaccaccagaacaatcggcacgttaatcagaaacaccgagccccagtaaaaatgctccagcagcagaccgcccactagcgggccaaaagccgcaccgccggagccgactgccgcccagatgccaatcgccatatttcgatggcgggtttccgtaaaggtggcgcggatcccggcaagggtggcgggcacgatcatcgccgcccctgttgccagcaacgcccgcgccaggatcagcccgctggcgctggaggcgcttgccgccagcagcgaggccacaccaaaaagcgcgctgccacacagcaacagccgtttaaagccaatgcgatcgccgagcgcgcccatcggcagcaccataccggccatcaccagcgaatagatatcaatgatccacagcagctcattgctaccggggcgcagggtaatactcagcgtcggtaccgccacatgcagtacggtggcgtcgatcgccaccggaatatagaccagaacaataatccacaacgtcagccactgacgaaacatagccctctctccctaatttggacacccgtccagaaatggcgatcttacgtaaagttggacgcatgtccagcttattgttatattcttttcgcccattattcagagagccgctatgaactacctcaatcgggaagaccgccgggaaaatattctgctcgccgccatgcgcgtggcgctggacgagggattatccgccatgaccgtgcgccgcatcgccagcgtggcgggtgtggccgcaggccaggtgcatcaccactttgcctctaccagtgaactgcgcgcgctggcgtttatccgtctgatccgcgtgctgctggacaccgaagtcgtgcccgaagacgccagctggcgtcagcgcctgcattccatgctgggcagcgatgatcgcggctttgagcgctatatcaagctgtggcgggaagcgcagttgatggcgatgcgcgatccggaaattaaaggggcttacgtactgaccatggagatgtggcatgaggaggcggtgaaaattatttatgccggacagcaggccggcgagttcacccttagcgacagcgtggaaaacgtcgcctggcgactgattgcgctggtgtgcggtctggacggcatgcacgtgctgggacttgaggggctggatgacgaagctttcgatcgccacattgaccgggcgatcgaactggagctttaccgctgacggcggccctgttacttctcccgggcggcgatccccgccattactgcgcttagctgtgacaacgtcacgccgtgccgggcatcgtcagtccccagaccgaagcgggtctgtaagaattcatggagcgcgggcacatccacagcgttaaactgctctaccacctccccgtcctgccagtgggtgaagtgaaaattattgagcgtcagtttgctgccatccggcagatgacgacacatcagcagatgatggcggaaatgcgagtgcgggaagtgcgcggtataaagattcccggtcacaaaatcagagaagtattgctggcttaaatcgaagcggtacatctgctgccagcgatcgtgatgcctgaactgtaagatccagtcatcgccttctcgttgcaggcgataaagaccgtgcggcgttttctgctcaacatccgtttgcagccggattggcgcggtgatggtctgcccaccaaaaccgacatccgccagccagggttcgccgtccagctccaccagcagtatgcggtgcgtgcgcggcggcatctgctccgggttggccatcaccacccgaccaagcagactgcgaacactgaagccgatttcccgcagcccgcgttcaaacaggccgttcagctcaaagcagtagccgccgcgccgggcgacaaccagcttggcgaacagcgcctcgtccgtcagttcaatttcccgcggcaacagcacgtcgagattttcaaaagggatagcgctgttatggtgctggtgcagcgactgtagggtcggcagatcggcctgcgggacacccgtccagttcaggcgttgaaaccaggctgttaaaaaaggactcatttcacactccggcaaaagatgagtcctatttatacactggatgaatattttgatgcggcaatttgtgcactgccgcttatgcccggccttttcgctgcataatgcccagcgccgtcagcatcaggatcagcccggtgaccagcgtcagcgtcgccatcgccatgccctgcccaacggaaccctgctcaaactgacgccagataaagattgcgacggtttgcgtaccggcaggcgccagcagcagcgaggtcaccagctcccgcgaggcgatggcgaagaccatcagcatggccgccagcagcgccgggaacaccagcggcagaacaatcagccgcagcgcctgcaatgcgctcgcgccatgaacgcgggcggcaggctccagattaccaccgagctgccgcagcgcgctgccgacatagcgcactggccagggcatcagcagacagcagtaagagagcagcaaaatcatccagctgttataaggcgacaccggccagaaggtgcggttccacagcaggatcagcccgacgcccaccacgatccccggcagcgcggcaggcatcaaggacagcgcatccagcaccgcgcggccccggattttttgcaccaccaccagccaggccgccagcagcccgagcacgccggtgaccagcgccgagcccagcgccagcgacagactggtgccaagggcggacagcgcatccccctgttgagagaacaacgcgtgataatggctgccggtcacgttatcccaggaaagtccgccggagagcgtggacataataccggtcaccgccatggagatccccggcagaccgaccgccagaaaacccacgccgcccataagcagcatcaccggcacggtggcgatacctaatgacgcgccggtattttccgtgggtttgcccgtcacgctggtcacgtctttatcccccaccagctgacgttgcagccaccagccgccaagcgcgataacgatcagcatcagcgacagcagcgacgcgccaggcagatcaatcggccagtcggccagctttttctcaatgccgacggtcatcatcaccacgccggatcgcgatcccagcgccgccggtacgccatattcttcaacggccagggtaaaggccagcagcatgcccgccgccagcgcgggcgagagcatcggcagcgtgacgtgccagaaggcgcgccaggcgctggccccgtgcacgcgggcgacaatcgccagccgctgcccgctggcaagcaaactgcgggataccgcaaaatagaccaccgggaaaatgttcagcgtcatcaccagcacgatcccgctgcggctgaacagcagatcgttgagatcaaaccccgccacctgcgccagatagccgttggtctgcaacaccagcatccacgaaagcgcggcgatatagggcggcgtaaggaacgggatcaaaaacagcacatcccacaagcgcggacacggcaggttaaatagcccgcgcgccacgcccagcggcaaaccgatcagcgcgctcagcagcgctacgcctgcggcgatccacaaggtgccgccgagcatggagggcagttgcggatcgctgaattgcggcaatatggcgctgaacggcgcggcaaaagaaccggcgctgaatgacgggaaaatcgcctgtaaaacaataaaggacagcggcagcgccaccagtatcaccagcagcgccagcgtcaggacagaaagcattctctgattcacaacggatcctgaagacggggtcgcccccgtcggctgaatttacttgctgaaaagggtattgaagcgttgcagcacttcgctgcgctcgctgttaccgtcctgactggttggcagaatatgcagatcgttgagcagcgggcgtttggcctgcacgtcgctgcgcgcgggcatcagccaggcatcggctaccattgcctgaccttccggcgacagcacgtaatccacaaaagctttggcatcgtcagcatgctgggtcgttttgaggatcatcatgggtcgcggcgcgatcaccgtgccgctggccgggaaaatcaccttcagggattcgccctggctgatattaccgtaggagacgtaatccaccgcgccgaacaccgccgctttcgccccctgcatcaccggcgtcaccgcctgggcgtttgggccgctgaccaccataccgttctgcttcagcgcgtcaaacagcgcccaggctttatcgcccatgctgttttgcaggccgatcagcagatcgagcgacgcaccggacagcgccggatccggcgtggtcactttatctttaaacgccggggcggtcagatcctgccactctttcggctctggggtaccgcttttggtgttccagacaatacccagcgccgacacgccctgcgccacgtattcgctggttttcagcgctgcgggcaccttttcggcattgctgctctggtacggcagcagccagccgcgggtatgcagatcttctgcggtatcccaggaggcggagatcaaaatatccgcctgcggattggcctgttcggcttccagacgtgccatcactttgccggtggtggcctggaaaatattcactttcacgccggtctttttctcgtacccgctggcgagactttttgccagcgaacccggacctgcggtatagaccgtcagcgcgtgggcgctggagatcatgacggaagacagcatcatggcgagagcaactcctttcttcacagacattacagctttcatgcatattcccctgaggatggtgtgacagcgcgtacagcggcaatgctgcccgcagaaagatgcacgatgcggtcggccagcagttcggcttcccggcgatcgtgggtgacatagacggcggtgatgccgagctggcgcagcaggcgcgacatctcaaggcataacgactcacgaagttcactgtcgagattggagagcggctcatcaaataacaacacgcgcggctcagcgacaatcgcccgcgccagggcgacgcgctgttgctgcccgccagataagcctgccggtttacggtcggcgaaatccgccaggccgacgcgatccagcgccgccagcacgcgggccacccgctcaccgcgcggcacgttgcgcatcttcagcgggaaagcgacgttctgcgccaccgtcatgtgcggccacagggcgtagtcctgaaacaccatgccgatgtcgcgcgcttccggcggcagtgaccagtggggtttcgccaccagacgatcgccgaaatagatttcgccttccgcaggctgcgtaagcccagccagcaggcgcagcagcgtgcttttgccgcaccccgacgggccgaggagcgccacaatgctgccggcgtcgacagtgagatcgatctgattgagaacggtatgtgagccgaaggcgaaagagacgccctgcagccttatatcggtgaatgcgttcacgatcgccctcccgcagcgggaagccgacacgcgcccgggatcgacatccgccgggccgcactcacctgtggaaaacacaggggagtaaacatattgttatcctctttgggacttagtaaggcgagactatagggagggagtgtgacggatagattacgcttaggttacgacttgctttccggacgctttcagtcccttaatgcgtcatcaacctgacgaggacaatatcatgagccattttcgccctgtcgccctggagcatgccagccgcctgcttaatcacgggccgaccattatgatcaccagccgcgacgaacagattgaccgccggaatgtgatgtccgccgcctggtcgatgccggtggagttctcgccgccgcgcattgccattgtggtggataaaagcacctggtcgcgggagcttatcgagcgcagcggcatgtttggcattgttatccccggcgtcgctgctaccaactggacctatgcggtcggcagcgtgaccgggcgggatgaggataagtttaactgttacggcataccggccattgccgggccggtactggggttacccgttgtggaagagaaatgtctggcttggatggagtgccgcctgctgcccgccaccgccgcgcaggaaaaatacgatacgttatttggcgaagtggtttccgccgccgccgatgaacgggcgtttatcaacggtcgctgggattttgatgacgataagctcaacaccctgcaccatctgggcggcgggaattttgtggcgagcggaaaggcgttgagtgtgaagtaagcgccgggtggcgctaacgcttacccggcctacaaaaaccaggcgtgtgacgtgtaggccgggtaaggcgcagccgccacccggcgcaaaaatcacatcgaataacccggttttttgattaactcatccatttgcgggccgatttgcgtatcccacacctgcgctttccagtcgtccggttgcacctggctgtacgccacgctcaccgaactctccttgctgtcaaaatgactgacgatcacctgggtgatggcctccgccagcgcggctttttgttcatcgttaaaatcacgcgggaaacttttaatatcaacgtgtggcatagcaggctccttattgagataacgttaaacctaacacaccgcaccgccgcagattatcaattgatgccgttattcagaaagtccctggtctggcgcgggctgcgcagacgcacaaagcggatatgcgcaaaggccggatccgccatatccgcttcataacgcgcgcggttgctgcgccaggttttcagcgtccacagcagaattgactcacggctgaaaaacgactgccgaaagctttcacggttgccggtgcccggccagagttcctttttatgccaggcgcgtttcagggcgcgcatgacggcctgacgcagggtacgggcaaatccataatccacccataccaccatatccaccttttgccatttcacaggccgtgtgcggttgtaattaccatccagcacccagcctggcgtggcgttcagcttttcgccaagcagcgccagcagctcttcatcggaaacgccctgccagttgggtcgccagtacagcgcatccatttcgatataaggcacatccaggtgacttgccagacggcgggcgagcgtagttttaccgctgccgctggtgccgatgacgttgattttcatgcgcaggctgactcttcatttttcattcatggaaattatgaaactaaggatccctgaattagccggatggcgcaagctcacccggcgctgaaaagggtgcgcttaataagtgatccccggcgggttgatttgtgacgttgtcactgcttctccggcttccccccagcgtgccagtaccttctgatactctccccttgcgatagcgccatccagcgccgctttcagcgcctcaaccagcccgttgccttttttggtggtggtggcgacataggcttttttcggaccaaggccgaccactttggttttaccggtcagcgccgctttataaaacgccactgactgcggaccgaaaaacacatccgcgcgcccggactgaatatacagattgcccgaggcgtcatcggtcagatagaccggcagcgcgggttttcgtcctgcccgttcgttttccgtgttccagccgagcaggatcttctcctgattggtgccggagccgacaatcaccttgcgccccgacaaatcctcaggtccgtgcactgcctcaatgggactggtggatttcaccgaaaacgccagcgaatcgacgcggtaggtggcgaagtcgtacttctctttgcgctgctcggtgacggcgatattgaccagcgccacgtcataacgcccggcggagatgcccagcggccagtcttcccacgccgtcggcaccagctttaacttcagcccgaggctgtccgccagcaggcgggcaatgtccggatcgctgccgatgcgggtacggttatcgctggcgagcagcgccagcggcggcgaattcagcgccgaaatagccaccgtcagcgtacccggttcgacaaaggcaaaattcggcggaattctggcgatcgccgcctcatcgcgctggctgtgcaacggcgtctcgttagctttcagatcgataccctgcgcgccgctgagcgtactgaccagcaacagcgcccataatccctgtttcatgctctctccttacaacactttggataagaattgccgggtgcgcgggtgctgcggatggttcagcacctcgtcgctgctgccctgctccacgattttgccgtccaccataaacaccacgttgtcggccacctcgcgggcaaagccaatttcatgggtgaccaccaccagggtggttccggaacgcgccagctttttgatcacatccagcacctcgcccaccagttccggatcgagggccgaggtcggctcgtcaaacagcatcacccgcgggcgcaacgccagggcgcgggcaatggcgatgcgctgttgttgcccgccggaaaggtgccgtgaccaggcatcggctttattacgcagccccacgacgtcgagcaattcataggcccgctcgatggcggccttacggctaagctgtttgtgggcgatgggcgcttcgatcaggttttccagcaccgttaagtgcgggaagagattgaagttctggaacacatagccgacgttgacgcgctggcgcaggatctccttctccttgagttcatagagtttgtcaccctggcggcggtagccgatgtaatcgccgtcaatctggataaaaccttcatcgacacgctccagatgattaatcgcccgcagcagcgtggattttccggaaccggacggtccgaggatcaccgtcaccgaacccggcgctaactccagtgaaatatcatccagcgctttgtgacggccaaagtatttgctgacgccggtaatggaaatatggccttcatgagaggtgtgcatggactggctcctgtggctgagcgacgcgacccggtgcggcaacgcgggcgacgcgggtggaattgatagctgagcggcgctcgctgcgcgccatccagcgctccaccagatgctggatcagcgacagcacgctggtgatcaccagataccacaccgcccccaccatcagcagcgggatcacttcctgggtgcggttgtagatcatctgaatggtgtaaaacagctcaggcatcgccagcacgtacaccatcgccgtacccttggcgaggctgatgatctcgttaaagccggacggcaaaatcgtccgcagcgcctgcggcagaataatgcgcagcgtgcggcggctggcaggtagccccagcgcggcggcggcttcatactgcccgtgatcgacccccagaaaaccgccgcgaatgatttcggcggtgtaggcgctctgcaccagcgtcagccccaccacggcggtggagaattgccccagcacgttaatggtgtcatagctcgcccaggtgatgccggtaaaaggaatgccgatggcgagcgtgtcgtagagataggagaaattataaaggatgatcagcaccacaatcagcggcagcgaacggaacagccagatgtaaccccatgccagactgctcaacagccaggacgacgacagcctggcaagggccagcaggccgccgaagatcacgctcagcaccgtgccgagcagggtcagcagcagcgtttgccccagcccttcgaggatcaccggatcgaagaaccagcgggcaaatacgctccattcccagcgcggattaaaggcaaccgactggatcacaatggccagcaccagcagcgccacggccgcgccgacaatacgcagcggataacgcgcggggatcactttaatgggttcagatgttttcatgttgattcctcaggctgatttccccagcgccacgccgagcgctttggtaaagcgcaaccgtccgtcataaggcggctggctgtagatttccggatcgcgctcgacatcaaactgcgcctcatagccctgactgagatagagcctgaccgcttccggctgacgaaaaccggtggtcagataaatacggctgtaacccgccagcaccgcccgccgctccagctcgcgcaccacccgcgccgccagcccctgctgacgcagggttttgtccgtccagatgcgttttatttcggcggtatgcgcatcaaagggtttatacgcgccggtggcgatgatcttcccgtcgcgctccagcacaataaacaacccctgcggcggcaaataccattcggtcagctccacctcggcgtctttcgaaaaataatccccgtagcgcgcggcgtattccgcaaataaaccttcgatgaccggctgaagttccggtgcttccggtgagagatcgcgaaaatgttcgctcatgggccgctccttaatcgccaaggcctggcgggttgatttccgatgacgggatgcgttcgacgccttctccccagcgggcgagtactttctggtagtcgccgtttttgatcgcgccgttaagggcggtttgcaccggctccgccaggccactgccttttttcagcgtcacagcgatgtgcgccgctttcggccagccgccgtccaccacgcccaccagtttggttttttgcgtcagcgccgctttccaggcacccgtgacgttcgggccaaaaaaggcatcggcgcgacccgattgcagcgccagcgtctgggcggcgtcatccttggtgtacaccggcacaaaaggcttcagccccttctgctggttcgctttatcccatgccagcaggatcgcttcctgattggtgccggagccgacgataatgcgcagtccggcgatgtcttccgctttctcaatgttgctgattgggctggttgatttcacgtaaaagcccagcgaatccttgcggtaggtggcgaaatcgaacttctctttgcgctctttggtgacggtgatgttgctaatggcggcgtcatatttgccggacgccacgcccagcggccagtcctcccaggaggtcggcacgacatttaattccagtcccaggctgtccgccaccaggcgggcaatgtccacctcgctgccgagcagggttttgttgtcatcggaaaacaccgtcagcggcggcgagttcagcgcggcgaccgccacggtgaatttccccggctgcacaaaacggtgatcttttggcaactgcgcgatcgcctgcggattggccggagtattgatcggcgtcttattggcctcaatgctgacgccggtgccattgatagtgacctcttttgcatacgccagcggcgttaaggcgagggtcatagccagtaagagtgaagttttctgcatagcgttattctctattttgtttttataaactgattcaccggcaattcgaggcccagactttcgcgcagcgtggtgccggggtagtcggtgcggaacaggccccgtgcctgtaacagaggcaccacctggtcaacaaagcgcgggaaggtatccggcgtaccgccctgaataatgaagccatcggcggcgtactggctgaaccactgttcaagaccgtccgccacctcctccggtgtaccggcaaaacgcgggcgcggtgaggcggcttccagcgccacctgacgcagcgtcaggccacgttctcgggcattgcgtttgatctcatcggtggtgctgcggaaactgttttgccccagatcgccgatgtccgggaagggttcatccagcggatactggctgaaatcgtgatgttcgaaatagcgccccagatagttcagcgcatcggtaaccgataccagcgcggccgtggtctgatactgctgctccacgtccgccgcgtcttttccgacaatgacgctgacgccctgaaatatatgcagttcatgcgcctgacggccattggcttcaagctggagcttaacgtcgcgataaaaggctttggcttcttctaacgtatcgtgatgggtaaatatcgcgtcggcatgtttggcggctaatttcttgccatcatcagacgcgccagcctgaaatacaattgggcgtccctgcggcgtacggccaatattcagcggccccgccaccttaaagaattccccttcatgattaagcgtatgtaatttcgctgcatcgaaaaactgcccgctcgctttattacgcacgaaggcatcctcttcccaggaatcccacagcccttttaccacgtcgagatattcatcggcgatgcggtaacgcagcgcatgttccgggtgtttatcgcgggagaaatttttagccgacccttccagcggcgacgtcaccacgttccagcccgcgcggccattactcagatgatcgaggctggcgaactggcgcgctacggtaaagggttcgctgtaggaggtggagagcgtcccgaccagcccgaggtttttggtcaggctggcaagcgccgataataccgtcagcggctcaaagcgatttaaaaaatgcggaatggatttttcattaatataaaggccatcggcgacaaataaaaaatccagtttgccctgttcggctttcagcgcggtttcttttacaaaatcaaaattaatactggcgtcagcggcagcggccgggtgtcgccaggcggacatattccctgacgcgccatgcaaaatggtgcccaggcgtaattgtcttgcgcttgtcatagaatgtcctcagtcagtatgtaataacgctttttctgccagccgggcgaaatatcgcgccgccccttccagtaaggtgtcgtcgggattaaacgccggatggtgtaaaccgtattcgctggcgctgccgatgctgacgaacgcgccggggatctgttgcagataaaccgcgaaatcctcaccgcccatatgcagctcagcgtgataggtgcgatagccctgctcgtcggcgacgcggcgggcaaaggcggcccacttttcatcgttaactaacgcctccgggccgtcgaaccaggtcaccgcgatctccgcgccgaacgcctgtcctaatccggcggcgatctcgttgacgcgatctttgacctgctggcgcactgcacgcttatgggtacgcagcgtgccttccagctcgacggtttccggcagcacgttccaggtattgcccccggcgatgcgcgttacgctcagcaccaccgaatccagggtattcacgttacggctggcgacgctttgcagggcattcaccagctggctggcaagcaggatggcgtcgttgccttcatggggccgcgcggcgtgcgcgcctttgcccttcaccgcgatcacaaaacgatcgacgttggcgtaaaacggcccgccgcgggtggcgaactcgccgacgggtaagcccggttcgttatgcatgccgaaaatcgcgctgacgccttccagcgccccggctttgatcaggcgtttcgcgccgccaaaattttcttctgcgggctggaaaagaatgcgcacccggcctgccagttgctgctcgttcgcttttaacagcagtgccgcgccgagcatcgcactggtgtgaatgtcatgtccgcaggcgtgcatcacgcccggattcagggagctgaaaggtacgccgctggtttcggcgatgggcagcgcgtcgatgtcggcacgcagcgcgatgattttttcccctgtccccacttccgccaccacgccggtgggcagatcacagggcagcaggcgtagcccggcgacttccagccactggcgcacgcgacgggtggtttcgaactcctccagcgacagttccgggtactgatgcagctcgcgccgccagtcgattagctgttgtgcaaaactcatccggcgacctcctgcaaggcgtttgctgaggcgtgcgcctccgccagcagacgcagggagtcgaaacgcggctggccctccgccaccggcgtatcaatgacaaattcatcgatgccgtggtcgcggtgcagttcgtcgagggcggcaagaacgctccgggcggtgcctttgatcactgcggattcccgccgcacgatctgcttcgccgggctgcccgcctgccgggcaaaggcctgcgcctgggattcgctcgccacggtgacgcgctgcccgttttccagctccacgccccacaattcgatctgcgccgcctgccggtcggcctgttgctgcgtcggggcgacgatcgcctgcacggcaaccagcgtgttgcgcgcgctgttctgttgccagatgccgagcacctcgcgcagcaggtttttgtcgccgttaaggtgcgcggcaaagacaaaattccagtccagagcggcggcgaggcgcgcgctttccgggctggcgccgagtaaaaaaccgtcgacgcgctgcggcggcaccggggtggctaatacggtttcggcttcctgttcgttaacgcgcagcgacagccagtgatccagctgcgccagttgatcggcaaagctgcccttctcctgcgcgttaacgccctgctgtaacgcccgcgtggacagcggcagaccgcccggcgctttaccgacgcccagatcgatacgccctggcgccagcgacgccagcaggttgaaattttccgccactttataggggctgtagtgttgcagcatcacgccgccggatccgacccgaatacgccgggtttgcccgataatccaggcaatcaccagctccggcgacgggctggcgagctgtgcggtgttgtggtgttccgccacccagaaacggtgatacccccactcatcggccagtctggctaattgcagggtacgcgccagcgcctctgctgcggtttcgccttccgcgaggggacttttatccagaatactcagacgatatgacatgcgcacactcactctgcttaacatgtcaccattaataaatgcctatgaaacacttgtgaaacaactaaataacatttgaaaagctaaaaagtggcaaagtgccgtttcagggttatgaaggctgtcaatttttggcaggccaggctttgcgtagcttacggtttgcaggtaggatgctgcgccatgttttgtcttatccatacgcagaatgactggaaagacagtgcattaattcgtcagggcaatcgtttgttctgtcctgacgggtgaggaaatccttcgatgattcagacaggtcaacaggtaactcaatgaacaaaaacaacaacagcgcagcggagcatcatgctgcaaaacgtcgctggttaaactctcatgaagagggatacaacaaagcgatgggcaaccgccaggtgcagatgatagcgattggcggggcgatcggcaccgggctgttcttaggcgcgggcgcacgattgcaaatggccggtccgtccctggctatcgtctatgccgtttgcggtatcttctctttcttcatcctccgcgcgctgggcgaactggtgttgcatcgtccgtccagcggcagcttcgtctcctacgcccgtgaattcctcggcgaaaaagccgcttatgtagcgggctggatgtacttcgttaactgggcgatgaccggcatcgtcgacatcaccgccgtggcgctttatatgcattactggggcgcgttcggcgatgtgccgcagtgggtgtttgccctcggcgcgctggccattgtcggcaccatgaacatgatcggcgtgaaatggttcgccgagatggagttctggttcgcgctggttaaagtgctggccatcgtggtgttcctcgttgtcgggacgattttcctcggcaccggtaaaccgctggacggcaacgccacgggcttccatctgatcaccgataacggcggtttcttcccgcacggtctgctgccggcgctggtgctggtgcagggcgtagtgtttgccttcgcctccatcgaactggtgggcacagcggcaggcgaatgtaaggatccgcagaccatggtgccaaaggccatcaacagcgtgatctggcgtatcgccctgttttacgttggctcggtagtgctgctggtgctgctactgccgtggacggcgtaccaggcgggacaaagcccgtttgtcaccttcttctcgaagctgggcgtgccctatatcggcgacatcatgaacatggtggttctgactgcggccctctccagcctcaactccggcctctactccaccggtcgtatcctgcgctccatgtcgatgggcggttccgcgcctaagttcatgtcgaaaatgagcaagcagcaggtgccgtgggcgggtattctggcgacgctggtgatctacgtcttcggcgtggtgctgaactacctggttccggccagcgtgtttgagatcgtgctgaacgtggcggcgctgggcattatcgcgtcctgggcctttatcgtggtctgccagctgcgcctgcgcaaagccatcaaagaaggtaaagcggcagatgtgtccttcaaactgccgggcgcgcctttcacctcctggctaacgctgctgttcctgttaagcgtgctggtgctgatggcgttcgactacccgaacggcacctacaccatcgcctctatccccttcctcgccgtgctgttagtggcgggctggttcggcgtgcgtaagcgcgtcaacgaaatccagagcaccgcgccggtacatccggaagacggtaaagacgggaagttaacggaagagttatcccgttaagacagtgtgccgggtggtggctgcgccttacccggcctacataaaccgtaggcccggcaagcaaagcgccgccgggcaaaaagacacaaaaaaggctccttacggagcctttctttttttcacatcacatcacagcgcaatacggatcacatcatccggctgcgtggcttctttctcgcgggtggaggcctgcttcacgctgacgtacagcgttttaccgtctgcggacaacgccaggctgttcgggtgcgtcggggtgtcgaaggttttcaccactttgtagcttttcgcatcgatcacgctcactttaccggcctgacggtgggtgacatagacttcattacgcgccggattaaacagcaccgccagcgattccggggcggcgatcttctcgatcacgttaccgttgcgggtgtcgatcaccactacttccggcgctttggaatcggtcaggaaggcgcgatgtccggcggtatccaggctcaggttaagatagaaatgctctttgccgtcgtcctgcacttttttgcggctgagaattttattggtcgcggtgtctatagtgatgaattcaccgtcgccgttagtggtgtacaggcgtttggcggcgctgtcgatagccagaccggtggcaaaagtgccggtgccgttaatggtggttttcagtgcgatattgtcgccatccaccacccagatcgcactctctttgccgacgccggtgatataaacgctgttggtgctttcgtccacgaccagctcacgcggctgcaacgggcgcacggtttcggaacgtttacgctcatccagcaccagacggcctttcacatcgccggttttggcgtcaatggcggtaacggcgctgctggtcgtgttgccaaaccacagggtctgcgtcctggtgttgatggccgcgccaaacggttttaaatcgttatggatcgcctgggtcacgttcagcgtgaccggatccagacgataaaccaccccgcccttgtctgttttacggctctgcgatgtcgcaagccacagcgcgttttcctgctggctgaacgccatttcataggcccctttccctaccggctggcgcagcatttcttccgctgcggtggcgttgaacgtgccggcaagcagcagagaacctaataacagtgaaccacgcaggcgcggtgagcttaaatgacgagtaaacatgacgactccctttgataacgaatgtatagctgcatcacatggcttccggtcagcgaagtcgcgcttcgcttgtttttctaagtgagaatagtaatcattaattgattaaaatggcactctttcttgccgaatccgccattcaggccataatttctcccggcgattattcacagtaagtgccgttaaagttttcaatttctttacattacccgtaacatgttggcgcatgttccatttggtacgttttatttttaaccggtttaaccatgaaaatcatttttgcacgcccggcggccctgccgtttttgttacttcccgcggtctttcaccctgccttcgcggcagcggaacagaccatgatcgtcaccgcgtccccgcaaaccgtctccgaactggatacgcctgccgccgtcagcgtggtccagggcgaggatatgcgtcaggcgacgccgcgcgtgaacctctcggaatcgctgaccagcgtgccgggcttacagatccagaaccgtcagaactactcccaggatttgcagctgtcgatccgcggttttggctcccgctccacctacggcgtgcgcggcattcgtatgtatgtggacggcattccggcgaccatgccggacggccagggccagacgtccaacatcgacatcaatagtattgaaagcgtcgatgtgctgcgcgggcccttttctgccctgtacggtaacgcgtccggcggcgtgatgaacgtcaccaccgaaactggtcgcgaacccgccaccattgaagcgagcagctattacggcagctttggcagctggcgttacggcctgaaagccacaggcgcggtcggcgatggcacgcagccgggcgacgtggattacaccgtttcctccagccgtttcgccacccacggctatcgcgatcacagcggcgcgcagaaaaatctcgccaacgccaaactgggcgttcgcattgatgacgttagtaagctaacgctgatccttaacagcgttgataccaaagcgaacgatcccggcggcctgagcaaaagcgaatggaaagataacccgcgccagtcgccccgtggcgatcagtacaacatgcgtaaaaccatcaagcagacccaggcgggcctgcgctatgaacgccagctcagcgagcaggacgatctgagcgtgatgatgtacgccggtgagcgcgaaactacccaataccagtctattccccgcgccccgcagcttaatccgacccacgcgggcggcgtgatcgacttaacccgtcattatcagggcgtcgacacccgctggacgcaccgtggcgaactgggcgtgccggttacttttaccaccggtctgaactacgaaaatatgagcgaagatcgtaaaggctacgagaacttcgtgatgtccggcagtacgccggtatacgggcagaaaggccagcagcgccgtaacgagcgcaacctgatgtggaacgtggatccttatctgcaaaccgcatggcagctgaccgacaagctttctctggacgcgggcgtgcgctacagctccgtatggtttgactccaacgatcactatgtcaccccgcgtaacggcgatgacagcggtgaagccagctatcacaaatggctgccggccggatcgctgaaatatgcggtgaccgatgcctggaatctgtacgtggcgggcggtcgtggctttgaaacgccgaccattaacgagctttcctatcgttccggcggccagagcggcctgaatttcgatctgcaaccgtccaccaacaccacctgggaagtgggcagtaaaacccgtgtgggtaacggcctgctgaccgcggcgctgttccagaccgataccgataacgagatcgtcaccgatgccagcagcggcggccgcaccacctataaaaacgccggtaaaacccgtcgtcagggcgcggagctgtcggttgatcagcagtttgccggtaactggcgcgcgaaaatggcctggacctatctgaatgccacctaccgcactaacgtctgtaatgacggcgactgcaacggcaaccgtatgccgggcatcgcgcgtaatatgggctttgcgtcactgggctggcagccggaaagcggctggtacgccggggcggatgtgcgttatatgagcgacatccaggccgatgacgaaaacaccgctaaagcgccgtcttataccgtggttggcctgaacagcggctacaaactcaattatggtaactggatgatggacgtgtttggtcgcgtggataatctgtttgaccgggaatatgtcggttcagtgatcgtcaacgaatctaacggtcgctactacgaacctgcgccaggccgaaattatggcgttggcttgtccgtggcctatagcttccagtaaaacgattccggcctgatcatcaggccggatttttttattagtgcatatcgttgtcatactgacgaagcagaattgtttcacccacctcgatagcatctattattgcctgtttactttccgcgcactgacctttttccagcgaggataataattcatcgtaagcgccgtgactgcgcattaaactttcggacgaaggatagagataattaaagcatgggccgaggcgcacccagagttgctcaatgatggctgtcagcgtgggcatttccgcataatcataaagacaaaaacggaacgtacggttggcctgtaaggtctgttcaatattgccgctggccagcgcttcctgataacttgccgccagctgttgcagctttttcattttatcggcatcgagattagcgcaggccacttccaccgccataccctcgacttttttgcgtatcgcattgatttccagatacctttcccgacgcacttccggcaccagaaacgcctgtgcgggggtggcatgcagcgcgcctgcggaaaccagccgtaaaagcgcctctctcaccggcgtaatactggtacccagttgatcggcaatttctttagtgatgagccgcgcgccaggctttaatgcgccaacaataagtgcgcttttcaggcttacttccacctgcatagtaaggctcatgcgttgcgctttgaccagatcaagcatattccgttcctgtccaatacttaacaatctcaagcgggctagtgtaattaaatgcacgaaatcgtagggatatattctctttatgcatgcctggtatggttcgtctctgaaaggttagtataaattttggttattcagagttaattaaagacgctaatggaaattttgcctggaatttgatggcggcattgaccgccatcaatgttgttatgaccgttcggcaaccttaatcaccagtttgccgaagtttttcccttccagcagaccgataaaggcatcgggggtgttttccagcccgtcggtgatgtgttcgcgatactggatcttgccctctttcacccaggggatcatctcgttgcggaactcgtcgaggcgatggccgtaatcctgattgatgatgaaaccctgcacgcgcagacgttttttcaggatggtgcccatcagcagggagagacggtccgggccgtccggcaggtcggtggcgttatagccgctgaccagaccacatacgggcacgcgcgccgcgctgttcagcagtggcagaacggcgtcgaagactttgccgccgacgttttcataatagatatcgatgccctcagaacaggctttcttcagctgttcggcgaaatcgtccgcccggtgatcgatacaggcatcaaagcccagtttctccactgcgtagcggcatttttcttctccgccagcgacgcccaccacgcggcagcctttcagcttaccaatttgcccgacggtggcgcccaccggcccggtggcggcggctaccaccagggtttcaccggattttggctgcccgatatccagcaggcccatataggcggtaaagcccggcatccccagaacacccagcgcccaggacggatgttccgtttcctgaagcttcaccagcccgctgccgtcggaaatctcaaactcctgccagccgctgtagcccagtaccagatcgccttcggcgaagtcagggctaaaggatttcaccacctggcttacggtaccgccgcacatcacctcatcaatctgtactggcggcgtgtaggacggcgcatcgctcatacggccacgcatatagggatcgagcgacaggtagagcgtgcgcagcagcacctggccttcccccggcgtggcgatgtcatcttcttccaggcggaagttttcttttaccggtgcgcctttcggacgggatgccagtacccagcgacgattacgttgtgaattttgactcatacggatttcctttcgaagtaaaccttaaacaagggtagaagcttaaagccaggtttgctttcacattacgagccagaatggtttaagcgcaccaccagatagcggcagatctctgcggaatcgttgataaatcggcagtcattgggcgggccgagctccagacagtcaccggcgtgcatctgatggcgggtatccccttcgacaaacgtcagctcgccctcttgcaaccagatcagctgacgcgccagcgcataggacgacgcgggcatgggaatgtcgctgcccggcggcagctccacctgcaccagatcaaggggcagatcggtacgtggcgaaacatggcggcgcaggtaatgggtttgcggatcgcgccacagcggttgatcggcaaaacgcagcagtttgccctcctgcatttccgcacgggcgatgagcgtcgacatgctgatgccgaaagcgcccgacagccgcgccagcagcgtggcggtggggctgctctcgcccttttcaatcttgtggatcatcgcccgcgacaccccggcccggttcgccagatcgcttaacgaccagcctctggcttcgcgctcaagacgaattcgcacactgatccgttgatttatgttgtctgtaatagtattcatatcgtaatactatagtgaacaactccagaggttcaaccatgaatattcgttacgcgcacaaagacgactgcgcggccattgctgaaatttttaaccatgcggtactgcacaccgctgccatctggaacgacgccacggtggatgtggataaccgcatcgcctggtttgaagcgcgctcgctggcggggtatccggtgctggtgagtgaagaaaacggcacagtcaccggctacgcctccttcggcgactggcgcgccttcgacggctttcgccatacggtcgagcattcggtctatgtgcacccggcgcaccagggcaaaggcatcggccaggcactgatgatccgcctgatcgaagaagcgaagcgcatcggcaaacatgtgatggtggcgggcattgagtcgcaaaaccacgcctccattcatctgcatgaaaagctcggctttaccatcaccgcgcagatgccgcaggtgggcaccaaatttggccgctggctggatctgacctttatgcagctccagctggataaccgtagcgaaccggacgcgctgccatgaatcagtcgctgacgctggcgtttctggtggcggcgggcattggtctggtggtgcagaacacgctgatggtgcgcattacccagagttcctcaaccattctgatcgccatgctgctgaattcgctggtgggcattgtgctgtttgtcagcattctgctgattaaaaatggcttcgcgggattcagtgaactggcggcgacggtgcgctggtggacgattattcccggcctgctgggatcctttttcgtttttgccagtatcagcggttatcagtatgtcggggcagccacgactattgccgtgctggtcgccagtcagttgattggcgggctggtgatggacgtgctgaaaagtcaggggatcccgctgcgggcgctgattggcccggtctgcggcgcggtgttgctggtagtcggcgcctggctcgtggccagacgccagttttagatcagagaataacgccgccctgggtcaggtgctcgcgcctggcctccagctcttccttgttatgacgatctttatgcgcgatagcatggcgcaggcgctgctgctgctggtaacgttcctcccggctcagctccgcgtcatcgctcagggcgatcagcaactcgttcatgtgcgcgatgacgttctcgtcaatggtggcatccacgcgcgcaataacctcatccagatgcgacataccctctccttacgatctagttaactttggctttggaaaaatcactgcccatcagactgacactataaccgctgacgttgctgcgcgtggcataaaaggttttgccgttcgccagcgcgatccacggcgcctgctgatagaacacctcctgcgcctgttcgtacagacgcgcgcgttcttccggcacgctggtcagcttcgctttttcaaccagatcgttatagcctttatcgcaccagcgggcggcgttagagccggttttgatgctgttgcagccgagcagcacatcggcaaagttatccggatcgccgttgtcagacatccagccaaagagcgcgctgtcgtgctcgcctttacgcatgccggagagatattcgccccactcataagagacgatttttgccttcacgcccacttttgcccagtcgctctggatcatctcagcgatgcgtttggagttcgggttataaggacgttgtaccggcattgaccacagcgtcacttctgtaccctctgccacccctgcctgtttcagcagcgctttggctttttccggatcgtactggtaatccttcagatctttattaaagccgagcatatttggcggcagcggcgatttcgccaccgtgccggagccgaggaacaccgcgtccacaatggcttttttatcggtggcgtagttcagcgcctgacgcaccagcacgttatcgaagggttttttctccgtgttaaacgccagataaccgacgttcagcgcatcgacggaatgcagcgttaaatccttattctttttgatctcgtcaaactgcaccggagcaggcgccggaatgatctggcactcattggtttgcagtttcgccagacgggtctgcacgttcggcgtgatggagaagataaggtgtttggtcggcacttcaccgtcccagtaattcgggttggcgacgtaacggatcaatgaatccactttatattgttgcagcgcataagggccggtaccgatgggccaggtatcgacatattccggcgtgccctttttcagcatcgcatcggcgtattcgctggacagaatggaagcgaaatccatgccccagtcagccaggaacgcggcgttcggttcgttgagaacaaactgaacgtgataatcatccagctttttcacgtctttgatcagcttatccagaccgacatcgttaaaatattcgtaattgccctgggaaacattgtgatacggatggtcggcatttttctggcgcagtaccgagaaaatgacatcgtcggcattaaaatcccgcgttggtttgaaatatttattgctgttaaatttcacgccctgacgcagcgtaaaagtataggttttgccgtccggggaaattttccactccgtcgccagcgacggcaccggggtattatttttggggtcgaaattcaccagccggttatacagcacctgtgagctggccacgaaggtcgggccggagctggcgatctgcgggttaaaagattccggagatgcttcagaacagtaaatcagcgtgtcgttagatgccgccagcgcggcgcttgccggtaagagtgtgctcagcgccagcgcgagcagcgttttccctgtattcattgttatgccttatggatttttatgacagacagtgatcacagcacagcaatataaaactggcaaataacgaatcactatcaggttattctaatgccgcgttttttgttgaatattcatccactgaatcgctgaaaatttgcgttaagtattttcgcaaaggtcaagccctgaagacgttctcaatacgacgagaattcaacgcttttagcctctcttctgtcgtttgtttacatgccggtttgcgtaaagtagacgtgtgaagaagtctatgggatgaaaacgtggcaaaaactctcttgcgcagcggcgatctggatgattttcaggcagttggcggcggcggtcaggccgtatttgattcggcactgcaaattcgtgaagcattacgtctgcgtaaacagcaggcgatggtagattgtctggcaatcccgcaggttaacgatgatggcgatcgcgttgactggtattcgccgattgacggacgcgccatctcgtggaaagccgctgatgaggacgcgcgttttcgcgctctgcgctatctggaaagcaccctcgacagcgccgccgcgctgagccgcaaaagcctgcaatcaaataaaaccgcgcaacagctgtttggctcgctgttggaaaaagccttgcagtttcccggcgttaaccacgttttcctggtggatggcaaaccggttatcaccttctggggctttgttaatctgaacgaaagcgcccgtgacgacgtgctggcctgtctgcgcgagcaggcgctgccggaaccggtaatttcgctggttgagccacccgagccggaagaagagcccgcgccggtggttaatttcagccaggcggacgaaccgctgatcgctccgccgcccgtggtgaaaaccgaagaggttgctgaagccgtttatgaaaaaccccagcctgcggcctccgttaccccagcgcctgcgccggaaccggctgccgcgcctgtggctaaaaaacgttcccctgcgctgtggctgctgcccgtcgcggcgctggtcgccgttgccgtcgccgcgcccatgctgctgaaacaacaggttacccctgaaacgccgctggccagcgccgccgcgcccgttaccccgcccgtgccggtgacgcctgcgccacagctcaccgcttccctgccgctgcatcaggcggatgtcgtcgccgtgaaaaccacggttgtcgaagagaagaaaaccgccccggcggtgatcgccgccatcccgaaagacgtgatggtgatggatgccattcaggtgaaaaccggtaatacccgcttcctgaatggtaactggcgcgtaacgccagagatcaaagatcacgccaccggcaaagcgccgaccctgcgctaccagatccagaacaacaaaggcacggcccgtctggtccaggctggcaatatcacctgccgcgccgatctgttctctggtctgcatcagaccggcgaactgatgatcaaaagccgcagcaatgcgcgttgcagcgatggctcccgctacccgatgccggaaatcacctgcaccgcgggcagcaatgatattgcgcaatgtaccgcacgctatgacggcaacaccgttgtgccggtaaccttcagaaaaacaggtgcctgattttatgctggtaaatctttgcgactacaaacagagcgtgacgctgattgccaacagcggcgtgcagtttcttgatttcgggctgacgccgctggtgtccacccacaatggccgtttcgtgcgtaaaaccgccaacggcccgctgctgcgtctggattacgatctggtgaacgagcgctttaccctgcccgccagcaacggcggcccggcggaagtggtcaagccggaaaacactatcggcctgctggcgtccctcgccctgcttgacggcgtctggctgccgatcccgtttttacgtttcaacccgccgcgtacctttgtggaaggcccggataactgggcgcgggtgcagatccgcaagctcagcgagccggacagcaacggtcacacccaccgcgtgacggtggccctcgacagccagatcaacgatctctcccctgccgcccttgcgcccattgaaaacgacattctgaacggtacgcgtttttcactggcgtggcgcgatgatgaagtggcggatttcctcgatcagacgtggatcgacggctggctgcgggaagtctttttgcaggccatccaggatgaaaaccgcagcgagcgcgacgtggcgcaggcgctgcgcggctttgaatatcaggcgcactggctgaacctgatgacgctgctcggcgagcagctcagcgtgcctgaagtgaagatcgttacccatacgctcagcaccccggcgatcccggtggatttaattctcgacgtgggcaacacccatacctgcggtgtgatcatcgaagatcatggcgatgccaacgatggcctgcgccagaccgccgaactccaggtgcgctctcttagcgaaccgcaatttttaaatgaaccgctgttcacaagccgccttgagttttccgaagcgcgctttggcaaacagcatttctcggtggaaagtggtcgtgaagatgcttttatctggccgtccatcgtgcgcgtgggtgacgaagcccgcaaactggcgacgggtcgtctgggcaccgaaggcaacagcggcatctccagcccgcgccgttacctgtgggatgaaaccccggtgttgcaggactggcgcttcagccagatgaacagcaaatcccagcgcgagccgctggcgaccgccttcccgttgatgaacctgatgaacgacgatggccagccgctctacacgctgccgctggacgaacgtctgccggtcttttcgccgcagtacagccgcagcacgctgatgacccatatgctgtgcgaactgctggcgcaggcgttaggacagattaacagcgtggcgacgcgtctgcgtctgggcttccccgcctcgccgcgtcagctgcgcaccattattcttaccctgccgtctgcgatgccgaaacaggagcgcgagatcttccgtcgccgcatgttcgaagccatcgcgctggtgtggaaagcgatgggctggcacccgcaggacgatgatttcgccagccgcaagcagcaggaaaaaagcgtcgtgccggtaccccgcattcagatggagtgggacgaagccagctgtggtcagctggtgtggctgtataacgaagccatttcccactttgccggacagacggaaacctttttcgcctccctcgcccgcccggatcgccccacagcgcctggcgaagcgccgggacgcgccttgcgggtggcgtccattgatatcggcggcggcactaccgatatggcgatcacccactatcagctggatgacggcaccggcagcaacgtcaaaatcacgccgcaactgctgttccgcgaaggcttcaaagtcgcaggcgatgacattctgctggatgtgatccagcgctgcgtgctgcccgcgctgcaaacccagctgcaaaaagcgggcattactgacgccgccgcgctgatggcgacactgttcggcgactccgggcgcattgacacccaggcggtactgcgccagcaaaccaccctgcaactctttatgccggtgggtcatgcgatcctggcggcctgggaatccagcgacgttaacgatccgctggccggtctgcacgccacctttggcgatctgatcaaacagccgccgacgcgcaacgtgcttaactatctgaaacaggccatcgatccggcgctgccacagggcgcagcggaattcgatattttcgccgtgccgttacaggtcaatttcagcgaactgcaaagcgcgatgctcgccgggcagttcaccctgaccgccccgctgcatgcggtgtgcgaggccatctcccactactgctgcgatgtactgctgatcaccgggcgtccgggctgtctgccgggcgtgcaggcgctgatccgtcatctgcaaccggtgccggtcaaccgcatggtgtggctggataaataccgcgtgcatgagtggtatccgttcagccagcaggggcgcatcggcaacccgaaatcaaccgccgccgtgggcgccatgctgtgcagcctggcgctggatctgcgtctgccacgctttaactttaaagcggcggacatcggcgcgtattccaccgtgcgctatctcggcgtgctggataacaccgttaatacgctgcgcgacgagaacgtctggtatcacgatatcgatctggacaagcccggcgcgaagctcgacgccagactgcatttcccgctgcgcggcaacgtcacgctcggcttccgtcagctggccaacgcccgctggcccgcgacgccgctgtatacgctcagcatcaattcgccggagctggcgaaagccattgccggagacggcgtgctgaatgtgcgcctgcaatttaccggcggcagcaaagcccaggggccggaagccttcaacctgagcgatgcctggctgacggacggcaccccggtggatgccgatgcgttgacgtttaaactgaatacgctggccgatcgccgtcacagcggcagccactactggatcgacagcgggagtgtgtacctgaaatgaaagcgcctttaaaaatttcccaggccgtgatgtcctgggtgcatgacacccgcgcccatgcgccactgctcgacgatgacgccgacgccctgctggcgcgccttaccgccgcgtcggcccaggaatccgtgctgatgcaggcggcagagaccacctgcacggtggcgctgtacggtcattcgcaggcatcgaaagcgcacctgctcgccgccctgtgcaacagcggcaatggccgggtgaatgttaaacccggcgacaaaaccctcgactactttacccatatcaatccgggccatgcgctgaccggtatggcgctgcgtttcacacagaccagcgcgacccctgacgagcgtttcccgctgcaactgggcattctgagcgaagcagaactggtgcaggtgtttatcgcccatgcgcagcatctgccggatctgcgcatggtggataaaagcgtcattgaagatcggctgacccgctggcgcgccctgcgccagccgcaacaggtgccggggatcaccgccgacgaggtgggcgcaattgcccgtttctggcgcgccactgtcccgtctgcccgccagcagctggacgacaggttatggtatgagtttattacgctgttgccgtcgctggatctcagcgcccgcgccagcgcatggtcgctgctgtggggcgagcatcaggagttaacacaacagtggctggcgctggcgcacatcctgcatcagaccggtaatgcccgcgcgctcgccgccccgctcagcctgttggtggataacttcgccctgccgacggagggttttctgaacccgcagccgacggacggcgacagcgcccacggcgaagtggtggtgcatccctggtcggaagatcggttacataacgccgtcagcatcccgcttgccaccctggcgctgctgacccgtgaactggtgctgccggtggaaaacggtgtgctggacggcgtggatattctcgatattccggtacctgccctgggcgcgcagccgtcgctgcaaaacagtaaatgccgctggctgcccgaccattatcgtcagcagttgcagccggacgtgctgatgatctgtaacgccacgccgcagcgcagcgaaaccgccactaccgcgcgcacgctgctcaactgggtgaaggaaacccagtccggccaggaaacggcgctgccggggctggtatgggcgattaccccgcaggatgcgcgtttcactaccgcgcagaatctggatgagaccgtgcaacagctgctcggcaaaccggggcaatactggggtacgttacaggcgctggatgccagcagtctgcaacgtctgatcgagtggctgtcgcaggccacggctgcttcacagcgcacggtgcgcctgaaagcgctgcgcgatcgccatctgcaattgctgcgcgatctgatgcaacactggaccgcgccgctgaaagagacgccggaaagccagcgcgcccgcgctgaagcggcgatccgcgaattacagggccaggcgagccgtcacggtgaactgctggacgctttactgccggagatgaagcatttcgacgcgctgtggaaggtgcagcagccgcgcgaagaaaaagtcagcgggctgtttaacgacgccatcgatctgtttgctgatgtcgccgcgcagccggaaaccgtcacggcggcgaaagacaccggccatcaggcccatgcgatgtggatcaatcacctgcgtcagtggagccgtaacgacgtcagcgccgaacgcttagggttgacccctgccgcgctgcgccaggtcgcggatacactgatcgtcaccagctatcggctggaactgccgcaaagtttacagcagatcatgcagcgcgataccgcctgcgccgcgcagctgcatgccgcgataggtaattttattgcctggcttggctatgcgtcgctgccggaagatcagcgtcctgccagccgggtgcagaaaggccagggtattttcagcgccagcgcccccgcagccagcgatgcccgcctgacgcgtcttggcgagcagccggttcatgccgccacgcgctatgtgtatgactggctggttgcgctgtatacccgcagcaatgaaaacatcggctatcagcatccgcttgatgtgccgttggcgatgcgtaagaaactgattaagctggtgtgatggtgattgccgggatttaacgccgggtggcgctatgcttacccggcctaccgatctggcgtaggcccggcaagcgcagcgccgccgggcaccggatgcccataatttcggtggacataccccgtaggcccggcaagcaacgcgccgccgggcactgcccctttccacaccacatccacatttcgctccccgccgaagcatccgtctttcatccccattacgctggctgaaattcaacgacggagaaaatccatgatcgcagttctttttgaggccgacgccctgccgcacgcgcaggatcgctatttccagctggcggctgaacttaagcccttgctgacacagacggcaggttttatttctatcgaacgtttccagagcctgagcacgccgggaaaaatcctttcgctttcctggtgggaagatgaagaggctgtggctggctggaagcacaatctgcgccatctcgccgcccagcaggaagggaaaacctcgatcttttccttctaccgaattcgcgtcgccaccgtgttccgcgactattcctctgataaaggagcccatgcccatgcatgatattcacgtgatcctcagcaatgcgcccggcgcgctggcttcgctaggttgcgagctgggcaaaaacggtgtcgggctggaaggcggcggtgtcttttccgtggcggacgtcagccacgcccattttctggtggaagacggtgaaaaggcgcgtgccgtgctgcttgccgccggttttgaagtcgtgaagatcagtcggccggtgatcagaaaactgccgcaaaaacgccccggcgagctgggagaaattgcagaggcgctggcccgccacggcatcaatattctggtacagtacagcgaccacagtaaccagctcatcctcctgacggacgatgacgcgcgggctgctgatcttacccgccaatggatgccgctgcatgagtctgctgaacactgaataccaggatgacccggatgagggtctggaaaaatccatgtcgctggttgccgccgcccttgccgatccgtcgcgggtcagcattttatgcgcgctgatggatggccgcgcctggaccgccacggaactcagcgccgtggcggacattgccgcctccacgaccagcgggcatctgactcgtcttttgaataacgggctggtgatgtgcctgacccaggggcggcaccgttattacagcctggccgggcatcacattgccgggctactggaaaacctgatgggcgtgtcgatgcaggcgcgcaccacgccggtgacccgcacgccccagcatctgcgttatgcccgcacctgttacgatcatctggcgggtgagctggcggtaaagatctatgaatttatgcagcatgagaagtggatcagcgctgacggcacggcgctgaccgccatcggcaaagatcggttgcagcgcctcggtgcggtgttaaatcctcatacgcgccgcaagccctgctgcccttgcctggactggagcgagagacgctgtcatctgggcggcgatgcaggcgcggcgctgatggcgttgttattgcaaaaagcctggatcagccgcacgccgggataccgcgaggtaagcgtgacgaccagcgggaaagttgccatgagccggttgtttgggctggcgctggggtgagccttgttgccgggtggcgctgcgcttacccggcctacaaaatattatcggtggacgtatcacgtaggcccggcaagcaacgcgccgccgggcaaaaactcactgccaccgggtctgccactcccataaccggttccatgcggtgtcgttgaggttgcgatccgccgccacgctggcacgatatggccgcgaggtggtcgccgccgatccccagggtgataaccggtcatagctggaatctatcgtactccaggcaatcagcacctgaccgttcgcggtattacccggcagatacccggtcttgcccgcgccctgatcccatgcccgtcccagcttcgctttaaagcttccctgataacccgcatcaccggtgaaacggctgttcagcaccagaaatccatatggctgatccggcagggtgtttggcgcaagcacgtaagcttcctgcgagcggcgcgtggataccgtgtggaactccacgccgtcaaacaccacgctggcgcggccaaacacgtaatccacatccccttcgatatagctgtctttcaccagtacgcggctgatgcggtcggtcaccgcgagattttcacggttactggtattgagatataccgtgtcctggcggccaatcagccgcacgttttccagctgtacgcggtcgccgtcggtgcgcagcgccacgccctgatgggtaccgccatctacagtatcgagcagcgaattcaccacgctgagctgcgccagctgaaaatcattactttgcgaccagaccacagccgcgcagttggtgccaatcagcgcgctggttttaccggcacattgcgcatagagataccaggcgggatcgccctcgcggaactgctgggcaggattgaccgtctggcgatagcgggcgggagaaaacggtgaatcgagcgccagttcaaggcgcacatcctggggctgctcacctgtgccgaacagggtgattggcggcgcgtcggcgggaatatacaccgcgccctgataaacgccgggctgcacgctgatatagatgcgcgagcgatcggtggcattacgaatggcggcgtttatcgcctgttgcaccgtttgccagggttcatttgggccaacgcgccagggcgtggaaacctgctcaggatggatggcttccggttgccacgggccgtccggggcggcaagcagaccgccgcgggcaaaataattttccggcgtatagggagccgcttcctgcgcagtcaatataccgcgcgtttgcgttcccggtacttttccgccgccgttggcacagccatgcaacaccagcggcatacataatgctgctgacagaccaaaaccgcgtttcgccatcatctcgcctcgtcattttaagaaatggaggattgatattaatggaacgctgttttaattaacgacccagggatcatgctttcgcgtcagcccgttgaatcgattagaaaagtgagatcagcagcgcgaccggaaaactcatcggccaggttgagccgaccaggaaagcgctgaggaagcgaatacgcttgcgatctttcgacaaaaaccaggtgatcagtgcgctgatggcggccatgacagcgtagaaagccagcattttttgatatagcgtcattgttgtgatcgattccagagacaaaaccgccgcaatatgcatcgtttattgatattaatcaagttttgttacaacaaaaggaaggggtaaattgattaagacactaaatgcgctttacgacagtacatcatcctgcaccctggcggcctgggcgcaggatcccggcacaggtgcgacacgcagcaagccgcgttatgcgaaagataaatacgcgctggcgacgggcatcaccccgccgttatcgcctgccatcgccaccctgttacagcagttgcatacgctggcggcaggggatccgctggcggatgtcatgccagccagtgcgctgcacttcacctttttagccgttaccgatgcgctttatgacaggccgcagccgccgcaggaactcgccagcctgaagtcggcatttatggatatagcgccgctgaccgtgaccatcagcgatctgcggctggtcgcccttcccgatcaactcctgctcgccggcacgccggatgccgtcagcctcgcgcggcggcaacattttgcggacgccctgctcgccagcccctggaaatcagcgttaacgcagcgttacggcaacaccccgctgccgccgcctttctggcacagcacgctggtgcgctatgaagcggcccgtctgcctgtgcgctttcgtaagtattttgaggaccagcgcgcctcacgttttggtggagtaagcgcgcccttgacgctggcgctggtgaactacaactggagtaaaaaacgagtcattgagacagggcatttataacagggataccagtaacgccatcggaaagctcatcggccacgtcagcccgaccagcacggcggcgagcaggcgaacccagactttgtctttggtgagaaaccaggtgatgacgccgctcactatcgccatcaccccataaaaaatcagtagcttcagatacagtgtcatggtgacggtcgctccctgcgtaaaggcagcaggcattattaacctaacctgctgccctgaaggagacgcctgtcacaaggtggttcaatgtttaatcatgatgtgccgcactacggtgtaatcttccagcccgaagactgacatatctttgccgtagccggacattttctgcccgccgtgcggcatttcgctgaccagcataaagtgcgtattcacccaggtgcagccgtattgcaggcgagcgctcaggcggtgcgcccggcccacgtcttgagtccataccgatgacgccagcccgtactgcgaatcgttggcccatgccagtacctgatcttcgtcgtcgaattctgtcatgctgaccaccggaccgaagacttcgcgctggacgatggcgtcctcctgcttcgccccggccagcagcgtcggctggtaatagtagcccgcgccctcgcgcttcgccccgccggtgatcactttgatatgcggcagcgctttggcttcttcgaccgccgccgccacgcgcgccaggtgtgcttcggaacttaatggccccagttcggtggagccgtcctccggcgcgcccattttcagactggcaatggccgcaccgagtttttccaccagcgccggataaatgcccttttgcgcatagatacgacaggcggcggtgcagtcctgtccggcattgtaatagccgaaagtgcgcacgccttccaccaccgcctccagatccgcatcgtcaaagacgatcaccggcgctttgccgcccagttccatgtgggtacgtttcaccgaagaagcggtatgagcgatgatatgctcgccggtggcaatggagccggtgagcgacaccatacgcactttttcatgaccggtcagcggatcgccgacggttttgccacggccaaacagcacgttcagcacgcccgccgggaaaatatcttttgccagttccgccagcttcagcgcggtcagcggcgtgatctccgaaggtttgatcaccacgcagttgcccgccgccagtgccggtgcgagtttccaggccgccatcatcagcggatagttccagggggcaatggacgccaccacgcccaccggatcgcggcggatcatagaggtgtgaccttccagatattcccccgccgccagaccattaagcgtgcgcgccgccccggcaaagaagcggaacacgtccaccaccgccgggatctcatcgtttaacgcgcagtgcagcggtttgccgcagttcagcgattcgagttttgccagcgcgtcggcgttgtcttctatgacctgcgccagtttcagcagcgcttcggcacgtactttcggcgtggtctgcccccattcgctaaaggcgcgatcggcggcgcgcacggcggcgtcgacctgggctgcggacgcttcggcgatctccagcaacacctccccggtggccgggttatacactgcctgggtttcgccttcgccgttgatcagctcgccattaattaacagttgatgttgcataatatggtcctttctctgtggtcagttatttcccggtgtcgtcctcgcgggtcagccaccaggcaccgaggatcggcagcatagttaccagcatcaccagcagcgccaccacgttagtcaccggcacgtcgcgcggtcggcctaactggttgagcaaccacaggggcagcgtacgttcatgcccggcggtgaaagtggtgacgataatttcgtcaaacgacagcgcgaacgccagcatgccccccgccagcagcgccgaacctaagttcggcagcaccacatagcggaaggtctgccagccggtcgcgcccaaatccatcgacgcttccaccaggctccatgaggtgcggcgaaagcgggcaatcacgttgttaaacaccaccaccacgcagaaagtcgcatggccgatgacgatggttaaaaaacccggctccagatcgacggttttaaaggccgtcagcagcgccagcccggtgatgatccccggcaatgcaatgggcagcagcaacagtaaagagatggcgtttttgccaaaaaacgtgctgcgccataacgctgctgcagcaagcgtgccaagtaccagggcaatcgccgtcgacagcgcggcgactttaagtgacaacgtcacggattcgagaatgtcgccccttgtggcggccacgctgaaccagcgcagcgtcagcccctgcgggggaaaactgaaggcggcgtcttcggtgttaaacgcatagatggcgatgatggcgagggggaaatgcaggaagatcaccccgccccaggccgcgactttgagcaaaaagggggcgcgatcagagtgcatcgaaagctcccagacgtttcacgaacgccagataaagggcaatcaatacaatgggcaccagcgtgaaggccgccgccatcggcatattgccaatcgccccctgctgggagtaaaccatgttgccaatgaaatatcctggcgggccgatcagttgcgggacgataaaatcccccagcgtcagcgagaaggtaaaaatcgatccggcggcaatgccgggaatagccagcggcagcaccacataacggaacgtctgcgccggacgcgcgcccagatccgccgacgcctgcaacagcgaggcgggtaaccgctccagcgccgcctgcaccggcaggatcatgaatggcagccagatatagagaaacaccagaaagcgcccgaacccggaggtggaaagcgtgctaccgcccacggcgggcagcgtcagaaaggccgccagcagcggttgcagccccagatggcttaaaaaccactgcgccacaccgtctttcgccagcagcagcgtccaggcgtaggctttgacgatgtaactcgcccacatcggcaacatcacggcgatatagaaaaacgctttcattttgccggtggtataacgcgccataaaccacgccatcgggaaggcaagaatggcgctggcaacggtgaccgccagcgccatggtgagcgtgcgcaggataatgtcatagttggcggggttgaacagcgccttcaggttcgccagcgttagatccggcgtcaccgacatggtgaaatcgtcgaaagtgtaaaacccctgccacagcagcgtaagcagcgatccgaaatagactacgccgaaccacatcagcggcggcaccagcagcaggaacagcccgaggccaggcctgcgccagaaaaagcccgacagccgccccgtttgtggcggcgcagaaagacgggagaagtttgtcgccattcagcccgccccctgcagtggtaccatcgccgcccgcgcccagcaggccagcaccctctgccccggctgtaatagttcgggcagctgcgcgtcggagagattcgcctggctgaccagtaatttttccccgcccggcaagcgcagctcaaagcgcgtcgccgccccctgatactgcactgcctgcaccacgccctgcacctggatctcgccggactcgttcagccggatatgctccggacgcagggagtacatccccgtcataccgcacagctgacgggcggtgtcggcggtaaaaacgttggcggtgccgacaaaaccggcgacaaagggcgtgcgcggtcgcagatagagctcgcgcgggctgtcgatttgctcgatgcggccattgttgaacaccgccacccggtcagacatcgacagcgcttccccctgatcgtgagtcacaaaaataaaggtgatgcccagatcctgttgcagctttttcagttcgaactgcatctgctcacgcagtttgagatcgagcgcgccgaggggttcatccagcagcaatacccgcggctcgttgaccagcgcgcgggcgattgtcacccgctgccgctggccgccggaaagctgcgacggtttacgggtgtgcacaaatcccagcgccactttttccagcgcctcgcgggcgcgggcatggcgctgttttttgtcgacgcctttcaccatcaggccgtaggcgacgttgtcgaggatcgacatatgcgggaagagcgcgtaatcctgaaacacagtattgacgtcgcgctgccagggcggcagcgtgctggcgtcctgcccgaaaatacgtatcgccccgcctgacagctgttcaaacccggcgatcagccgcaggcaggtggttttgccggagccggacggccccagcatcgagaaaaactccccgtcctgcacctcaaggctgacgccatccaccgcccgcacatccccatacagacgcgagacattctgaaactctacggcccgggccatgcttaacgtccacccataatggcgatgtaatcctgcgtccagcggctgtacggcacatatttaccgccgtccgccaccggcgttttccagaaggcgattttgtcaaagaagctgtagccgttggtgtcgcagcctttctcgcccagcagcgtgctggccttgcagccttccggcaccaccggcagcgagccaaaccaggccgccacatcgccctgcacttttggcgtcagcgaccagttcatccacttataggcgcagttcgggtgtttggcgtcggcgtgcagcatagtggtgtccgcccagccggtgacgccctctttcggaaagacggtggcgatgggctgattttcgcctttcagcgcgtttgcctgatacggccaggcgctggaggccaccacgccttcgtttttgaagtcgctcatctgcacagtggtgtcatgccagtagcgatggatcaactgatgctggtcgcgcagtaccttcagtacggcgtcgtactgctgttgggtgagctggtagggatcctcaatgccgagttccggctgggtggctttcacatagagcgcggcatcggcgatataaatcggcccgtcataggcctgtacgcgcccctggttgcttttgccgtccggcagttgctgtttgataaacagcaccgcccagctgtccggcggcgtggggaacgtggtggtgttgtacatcagcaggttcggcccccactgatacggcgtgccgtagactttaccgttgacgttaaaccagtcgcccttctccatacgcggatcgacgtttttccagttctctatcagcgcggtattgatcggctggacgcgttttcccatgatcagccgcagggaggcgtcgccggaggcggtaaccaggtcgtagccgcccttcgccatcaggctgaccatttcatcggaggtggcggcggttttgacgttaacggcgcagccggtctctttttcaaaggccgtcacccagtcgtagtccttatcggtttgcccgcgctcgatataaccgggccaggcgataatatcgagccgcccttcgccatcgccgatttttgtgggcggttcggcggcgtgggcgcaggcaagggtcatgcccagcgaacacagacagctgcgcgcaaatgttttgctcatacggatgtactcctgtcgcaataagaggtgcggcagccgtgccgttaaaaagtctcccttcataaaggtagacagcggcacgatccgtataaaagaaatttgctcaggttgtgaccggcgttaaattcagtaaataagccgccgcaaagagttgttatttcagcaattcacgaattaattgtccgaggatcttcaccgcctgttcctggcggtcgccccactcccaggaggtgttaaagcggaaaaacggcacccaggcgtcggaggtggaaaacatcttgcccggcgcgatgctgatgcggtgcgccagcgcctgctcgcttaattttcccgcatccagggttgcgggcagttcgatccataaaaaatagccgctgtcgttgtggtgaatcttcacctccggcggaagatggcgcagcagcgcctgccagctttgctgtttgcgggcggccagcgtgcgccgcaggcggcgcagatgggcgtcgtaacgctgggtggagaggtaatcgaccagcgccagctgcaccggcgaactggtggataaggtgctcatcagctgtagctgctggatacgccgcgcatgtttccccgccgccacccagccgatacgaaatcccgccaccagacatttggaaaacgacgagcagtgcagcgtcatgtcctgcgtgtcccaggctttggccggcaagggtttttcccgcccgtaatacagctcgctgtaaacatcatcctcaatgagcgtgacgttatgctgtgccagcagcgccaccagtctggcttttttgtcggcgctgagggtaaagccgagcgggttctggctgttagtcatcagccagcaggcttttaccggatagtcgttcagcgcctgggcgagcgcttccagatcgataccctctttcacgtccgtcgccactgacaacgccttcagccgcagccgctccagcgcctgcaatgcgccgtaaaaacaggggttttcgacgatcacccagtctcccggctgcgtgaccgcctgcaaactcaggttgagcgcttccagcgccccggcggtgatcacgatttcatccggcgatatggtcatgccctgctgggcgtaacggcgggcaatggcatgacgcagcgcggcattgcccggcggcaggttttcgatcacgctcatggcggtggcggttttgccaatcgccgaaagcgagcggttgagctgctgctgcgggaaaagatgtggatcgggaaacgccgagccaaacggcagcaccgaggcgtcacagcttgcctgtaacacgtcaaaaatgtaggtgttgatgtccaccgcctcatctcgcatcacctgcgcgggcggcgtcagtttctggctcaccggacgcggcgcgacgaaatagccggactgcgggcgggcgacgatgcgcccctggctttccagcatctgataggcatggccaacggtcataaagctcaggccgctgtgcgtcacctgctcgcgcaacgaaggtaaacggtcccctggctgccagacgccgagttcgatctggtcgataatttgttgcgcaaggcgctgatattttttcatttcacttacacaaaactaacctaaacttaccgtaccacgacagttgccctttcgctatatcagttcactcaaaatgacggctttttgcaaactgttatctaaaaatatcgggtatctgcgtctgcacgtttcgctcccggatcattaccattaacgctaacagcaggttatcagaggttgtctatgttcggtcttgatgcgtttcatctggcgaggatccagttcgctttcacggtttcattccacattatctttccggcgatcaccatcgggctggccagttaccttgcggtgctggaagggttgtggctgaaaaccaaaaatccggtgtggcgtgcgctgtaccatttctggtcgaaaatcttcgccgttaactttggtatgggggtggtttccggtctggtgatggcctatcagttcggcactaactggagcggcttttcgcagtttgccgggagtatcaccgggccgctgctgacctatgaagtgctgacagccttcttcctggaggcgggttttcttggcgtaatgctgttcggctggaataaagtcgggccggggctgcactttctggcgacctgcatggtggcgctgggtacgctgatgtccaccttctggatcctggcgtccaacagctggatgcacaccccgcagggctttgagatcgtcaacggtcaggtggtgccggtggactggttcgcggttattttcaacccttccttcccgtaccggctgctgcatatgacggtggcggcgtttctcagcagcgccctgtttgtgggggcgtccgcggcctggcatctgctgcgcggtaataacacccccgctattcgcaccatgttttccatggcgctgtggatgacgctgattgtcgcgcccattcaggcgatgatcggcgatatgcacgggctgaacacgctggagcatcaaccggccaagatcgctgccattgaaggccactgggaaaacagaccgggcgaagcgacgccgctgttgctgttcggcctgccggatatggaagaagagcgcacccgctacgggctggagatccccgcgctaggcagcctgatcctcacgcacagtctggataaacaggttccggcgttaaaagagtttccgaaagagaaccgccccaactccaccattgtgttctggtcgttccgcatcatggtggcgatgggcctgctgatgatgctgcttggcgtcgcagcgttgtggctgcgttataaacaccgcctttacgagtcgcggccgttcctgcattttgcgttatggatggggccttccggacttatcgccattctcgccggatgggtgacgacggaagtcggccgtcagccctgggtggtgtatggcctgcaacgcactatcgacgcggtttccgcccacggcgatttgcagatgagtatcagcctgctgaccttcttcgtggtctatacctcggtcttcggcgtcggttacagctacatggtgcgcctgatcaaactggggccgcagccacctgacgaacatcccacagatggccggcctgcccgcccgctgtcggccaccagggaggagtttaaataatgggtatcgatctgtcggtaatctggtttgtgatcatcgtcttctccacgctgatgtatatcgtgatggacggctttgatctgggcatcggcattctgtttccgctggtacaggatgaagacgagcgcgatgtgatggtcaacacggtcgccccggtatgggatggcaacgaaacctggctggtgctgggcggtgcgggtctgttcggtgcgttcccgctggcctatgcggtcattattgacgcgctgaccatccccctgacgctgatgctgattgggctgattttccgcggcgtggcctttgagttccgcttcaaagccaccccggaacaccggccgttctgggataagtcattcctgtgcggttcgatcctcgccaccttcacccaggggatagtggtgggtgcggtgctgaacggtttcccggtgacgggccgtacgttcagcggcggtgcgctggactggctgacgccctttaacctgttctgcggttttgggctggtcgtggcctacgccctgctcggcgcaagctggctggtgatgaaaagcggcggtgaattacaggtgaaaatgcgtcgctcgtcgaaacagctgctgctggcgctgctggtggtgacggcggtgatcagtctgtggacgccgctggcgcatcaggcgattgccgatcgctggttcagtatgccaaatatcttcttcctgatgccggtgccggtgctggtggtgctgctgagcctgtggcaatggcgcagcctgagtaacgtcgagcaccattcgctgccctttgtgctgacgctggggttgattttcctgggcttcagcgggctgggcatcagcatctggccgcacattatcccgccgtccatcacgctctgggaggcggccgcgccgccgcaaagccagggctttatgctggtcggcgcgctgctgattattccggtgatcctggtctataccttctggagctactacgtgttccgcggcaaagttaaacccggcgagggctatcactgatgcagaaacctttatggaaacggctgatgtggctggtgatcatctggggcgccagcgtgctggcgctcggcgcggtgagtatggggttccggctgctgatgagcgcggcggggtttaagtcacattgatgggcggttattgcccggcgcaatcatgcagccacaccatacgtaggccgggtaaggcgcagccgccacccggcacattcacgcaaccacaccataccccaggccgggtaaggcgtagccgccacccggcaataacgtcaaactcctttgcgtttcggcaaggtcttcatcagatcttcaggactcaccgacgccaccacgctgcccggatgcggcattttaaggatacggtttttgatcttacccactacgtgcatctcacacggacggcagtcaaatttcagggttagcacttcatcgccatgcaccagctgcatcggcgtcgctttccagctcttgatcgaaccttttgcctgtttcgggcagagattaaacgcaaaacgcaggcagtgtttggtgatcatcaccggcacgtcgcccttctcttcgtgcgcctcgtaagcggcatcgatcagctgtacgccgtagcgatgataaaacgcccgcgctttggcgttatagacgttggcgaggaatgacagatgcgtttccgggtacaccggcgcaggtaccgccaccggtttacggctgccgcgctcatagttagccagacgggcgtcgtccagcagttcaatggtttcacggcgcagctggttgagcagactgttcggtacaaagagcgcacccggcaggtttacctgaatatcgcgcgcgtagtaacgggtctggcctaattttgccaggccatcctgcaactggtttaacgctttttcggcgttattggcctcatcgaactgaccgtccagcgtatgggtgacgctgatgccgtcttcacaggtgacggtgaggatcagctgttcctgccagccgcccagctcgatatccaccgcgatacggcgttcgctggaggttttggtcagcgcctgctgccagttatggtcgaggttgcggttcagcgccgtatgcggcttcaccttaaacagatcggcgggcatctcgttcgggaagacgcgataacggttttcggcggttttctccaccgtgttggcacgaaaacctacgatttcgcgcttgatcatcacgttaagcccgtcgccgttcgccaggggttcagtgacttccacatccaggtgatctttacccacccgcagcacttcgcccaccggcaggccgataaacttcggcgaatcaaaggccccaatgtcagccttacgggcattcacaaaataatcggtgctgccacggtggaacgtcttatcagtggacggaacaaagaagtgctcggtacgcccggcagaagagcgcgccaggtcgccccgatcttcaatgatggcatcgagcatctgccggtaatgggcggtgatgttcttcacgtagctcatgtctttatagcgtccttcgattttgaaggagcgtacaccggcgtcgatcagctgcccgaggttggcggtctggtcgttgtctttcatcgacagcaggtgtttttcataggacaccacgcgcccctgatcgtctttcagggtgtacggcagacggcaggcctgcgagcagtcgccgcggttggcgctgcgcccggtctgggcatgagaaatgtagcactggccggagtacgccacgcacagcgcgccatgaatgaaaaattcaatggtggcgtcggtggcctgatggatggctttgatctgctggaggtcaagttcacgtgccagcacaatctgtgagaagccgacatccgagaggaatttggctttttcaacgctgcgaatatcgcactgggtgctggcgtgcagttcaatcggcggaatatccagttccagcacgcccatgtcctggacgatcagcgcatccacgccggtctggtagagatcggtgatcagccgctgcgccggttccagctcatcatcatggagaatggtgttcagcgtcacaaacaccttcgcgccatagcgatgggcaaaaggcaccagtttcgcaatgtcctgcaagctgttgctggcattgtggcgggcaccaaagccggggccgccgatgtacaccgcatccgcgccgtgaagaatggcttcgcgggcgatgtcggtatcacgggccgggcttaataattcaagatgatgggattgcaggcgcatacggtcgtcgttatccaggatggtcaaaatggccgctattgtagtgagaatagcccacagaccaaaacactttccacgccttaaccgcggcttttttctttggggtaatggatcagtgaatgaaagtgcacggtctgcgcggtgctgttgcgataggcatgcgctttatccgccgcaaaacgtacgccgctgttggcgctaatgctctgccactggccgtcgagacacatctccagcacgcctgaaatcaccaccacatgttcaatcacaccgcattcgtggggcgtggattcgctcagcgcgccgggggccagcgtgatggaaaacagatcaaagtgcagttgcgcatcccaggggaacaagggcgtgataaccatcgcctgctggtcgggatcgtaggcctggggcaccatcgtatcgggcgcggcaataaaggtcgaaaacggcacgttcaggccggtggcgattttccacagcgtcgccaccgtcgggctggactcgttgcgctcaatctggccgagcatcgccttggatacgccggtttcttccgccagccgtgacaaactccagccccgcgcctgacgcaggcttttcagcgtcccggccagatactgtgtcagatccatcattttctcctggttgcattacccgtcgcttgtacgttatagcgcacagtgatagtttgtgcggacgctataacgcacaaggatcattatgcgtccgttctctttcccactccccgcgctgctcgtgggttttgttgcggtgctggtcggttacgccagctcggcggccattatctggcaggccgcttctgccgccggtgccagcgaggcgcagatcgccggctggatgaccgccctcggcctcgcgatgggcgtcagtacgctggcgctcaccctatggtaccgcgttccgctgctcaccgcatggtccacgcccggcgcggcgctgctggcgaccagcctgcacggggtaagcattaacgaagcggtaggcgtttttattttcgccaatgcgctgatcctgctgtgcggcctcaccggcttatttgcacggctgatgaaaattattccccattcgctggctgccgccatgctgggcggcatcttactgcgttttggcctgcaagccttcaggaatattgagggacactttttattgtgcggcagtatgctactggcgtggatgctgggcaaggcgttcgcgccccgctacgccatcgtcggcacgctgctggcggggattgtcgccgcatgggcttcaggtgacgttgtcacttatggactgcattttaacccggtcatgccggaatttatcgccccgcagttcagcctgaccacccttatcagcatcggcattccttttttcctcgtcaccatggcatcgcaaaacgcgcctggcgtggcgacctttcaggcggcgggctatcaggttcccgtttcgccgctgatgatttttaccggcgggttaacggtactgctgtcgggtttcggcgcgttttcggtgtgcattggcgcgatcagcgcggcggtgtgtctcagcccggatgcgcatccggacgccagtaaacgctggctggctgcaatggctgccggagggttttatctgctggcggggatttttggcggttccattaccgcgctgatgacggcgctgccggtgagctggatccagacgctggcggggctggcgctgctcggcaccttcagcggcagcctgtatcaggcgctggcgcatccccgtgagcgtgacgcggccattgtcacctttctgatcaccgccagcggcattacgctgctcggcatcggctccgccttctggggattgattatcggcggcgcatgctacgccctgctgtcacgcgcggcgcgcgcgtagctgcgaaggcgttataccggtgacgcttttaaagcggttgctgaaatggctggcggagttaaagccgcaggccagcgcaatatcggtcagggagctgtcgctgtagcgcaccatctgctcggcctgcgccatgcggcgctgcatcacatactggtgcggcgccagccccatcgactggcggaacatgcgcgcgaaatggaattcgcttaatgccgcttcggcggccagatccgccagcgtcagcggttgcgcgaggctggcgtcaatataggccaggacgttgcgtaataccgacggcgacagcccgccggtgacggtcggcagccgccagcgcacgttgctgtagtgctgcaccagatgggttaacagtaaggttgaggcggtgctcagcgtcagctgattcgcctgctgctgccagtcgcagccgagcagaaaatgacggtacagcgcggtgatctgcgcgtcttcgccaaacatctgttcgttcagggttaaggatgcgggacggcgatcccagatttgctcgctgaccgtacgcagatgcgcatcggtacagtagagatgcacaaaggagaggtcgtcgcgaatatcccagctggattcgctgtcggtcggcatcaggcagaaacgatcagggccgccgccattcttccagccgccggaggttttgtgatagctctcgtaaccgtcggcgatgtacaggctcagcgtgtggtgatcgcaatactgggtgatgttatcgcgcgtgttagaccaggcggccagctgcataccggtattaagcgccaccgaatcatgcagcaccgcattgtgattgcgcagattttcaaacgcccgataagtttccgccataacgccgcttaacaaatgattaaccagatccgcagtttacccgccttccccgcatattgtcccgccgcccgataaaaaagcgcaagaatttgcaagttgaccgcaatacggtgcaagccgcgggcgaaatgccacgccagaatcagcagcaggtcaaccgagaagagataaaacatgaacgcattattgtattgcctggtagtggtgatctggggcaccacctggatcgccatctttttacaacagggcagcgtcccggcaccggtttctatattctggcgctttgcgctggcgaccctggtcatcatgacgacgcttattgtgtggcggcgtttgcggccgctggcgcgacgcgatcacttgttttgcctgttgcagggcggctgcgtgttcggctttaacttctggtgtttttataccgcggcggcatggatcaataccgggctggagtcggtgatcttctccatggcggtgctgtttaacgccatcaacagctttttgtttttcggtaaccggccacctgcccgcttttacctggcagcgctgctgggactgtgcggtattgtggccctgttctggcacgatctggtcgccaccgatatgagcagtacgctgctgatgggtatcggcttgtcggcgctcggcaccctggggttttcgatgggcaatatgatcagtctgcgccatcagcgtaacgggctggaaaccatgaccaccaacgcctgggcgatgctctacggcacgctgattatgggcgggattgcgctggtgcgcggcgacgattttaccccagactggacgctctcttacctcggcgcgctggtctacctggcgctgtttggctcggtaatcggcttcggcgcgtacttcacgctggtcggacgcatcggccccagcaaagcggcatacagcaccctgctgtttccgctggtcgccctgaccatctccaccctgtatgagggttatgtctggcatctgaatgcagtgtgcggactggcgctgatcctggtgggcaatctggtgatgttcgcccgcccggaaaagtggtttaccggcaggggctggcgggtgaaacaggcataaaactgcgccaccggtcggtggcgcgcggttttactttttgttgagatcgaacatggtggcgtcggtcgccatgtcgtcaaccacctgttttaaggtttcgacggtcatcggcgtgctttcattgttgagatctttcccttcgcccttacgcaccactttcagcaccggtttattggtggcggcgtcaatcagttcgccttcaaaatagagatgcgtgtccatggtacggtgcccggtggcggcctgcgtcccggcgaccagcagcgcgacgggcaccacttcatagaactgtagcccttctttgctggaattcaccccggtgatcgccccgcggaaaatcaggctgtgcgcgccgggcgacgtcaccagcggtttacgctgtccgatggcaggtttcagtttgctgttggtgtagttcagcagaccatccagcgtttgctgcccgatttgcgaggtcggttttgccaccggatagtaagtcaccggatgataaataatgctgtcgtactggttgggatcaaaattgggatccacccaacgcaaaacaggtttacccgatgcggaggtggtttgctgcaagccagaataatctttcaaaaacccggaatagttatcaggctccgccactttcgacgcacagcctgccagggtgagcaggcctgtaagcactgcaactttaaataaagtatgagtacgcataataagatctcagttagtgcacatatgcacaggtggttatagcaaaaccattgtgtcgctgttgtgactaaaagaggcgtggcgcacatttcaggcaaataaaaaacccggcgtcaggccgggtaatttatgctcaggcggctttacgcgccagcagcgtggcgaagcgcagtttaatgcggttgccattcgcgtcggtgcggtgtaattcccccggattttcattgtatttcacgatctcccagccgtcgtaatagttgcgcagttcaccttctttaaaggcaaacgggaagccgacattgcacggaaaatcttcggtatccatggcggcgacaatcaggttgtagccccccggcacggtgcagcgctgcatattggcaatcagccccggaatagtctgcggctcaaggaacatcatcaccacggtggacaaaataaaatcgtagtcgccatcgaaggtcagcgcgttcagatcctgaatagcaatctcaaggttatccagcccttccgccgctttgatgcgttgcagattagcaatgctgttggggtttttatcccaggccgttacgttaaagccttttgccgccagccagacgctgttgcgcccgttgccacagcccagatccagggttttacccggtgggatcatcgccccggcttccagcacttcggaatgggtacgggtcaggccgtatttctcagtaaaatagttttcatcgcgagtggtcattattcatccttagcgttaattaattgtgccgggtcgacgcggatcagcagtttgccctgaaataacagcatcagggttttgatccccagtagcactatgatcaggttacagaacacaaacagcggcagcgccagcgtgtgaaagaatcccgcgcccgcgctgtgccccagatgtaatccggttgtggccagcgccgacacgccgaacgaaaagctccagaaggtggcgttaaacggctgcgacagataccaggggatcagccgcagcataaacagcagttgcagcagaccatagccaaacagcattttggcgaaggtgtccgcctcgccgccgttgacgctaaaccaggcgctacaggcgaccagcgcgggcgcaagctggatgccgagggacgtgcgcatggcgacgggcagctccccggcgctgcgcagccggtgaaggatcgccggttcaaggctgagccaggagaagacgccggcccctaaaaacaccagcccggcgtcatgaaaaccgagcgcgccgcaggccatggcgctgataaagttattcgccaccgtcggcagatacagccccggcgtggtggcgtcctgcggatgacggccacgccagaggcctgcggattgccaggcggcataggttagctgcaccgtcaccccgacgataaacagtcccagcgccagcgcgcgccaccagggcaccatgccgatggccaccagcatggtggtcgccggaaagaggctcacaaagctgctctgcaccggatgacgcatctcccgcaaaacgctgtacggatagcgcgccagtcgccacagaaatgccagcgtcagcaacgcccagatacaggtcgccagcgcgaccagcccgtcgccaatgacgtggctgaccggccagatagtgctggcataacgccaggcgaagcccatgccgataatccccagcaccatcccgaaataaccggcgggcaaatgcagcacttttttgctaacaattcggttacacattttgttgaatttttaaatgatatttgaaatacattttatggaaattcgcgccagatagccagtgacgtaaattttgctacgctcagtgaaggcttctgcggaataaccaagatgaataaatatcgtctcagcgatgagtgccgcacgttcagctatcaggacggcgtggaaaagcgcagcatcagtctgcgccagattatagcctttaccgaatttaacgatgtgacggccgggacgcccggcggctggatcgatgatgaaagcgtgctttctcagcacggcgactgctggatctacgatgaaaacagcctcgcttttgacggctgccagatccgcgataacgcccgtattaccggcgcgtgcattctgcgtcataacgcagagatcagcgataacgcctgggtggacgccgcggaaatcagccatggggcgaggctgtgcggtacggtgctggttcaggcgtcaagggtgcgcggcgactgtgacatcgccgatgaagcgcgggtgcttaacggcagcgacgtcattgccgcccgcggtctgacgcccgaccagcaccagcgattgcgtatcttccagcgcgctaccgtcagtcgctcccgcgtggtgcatcaggcgcaaatctacggtgacgccatcgtcaacgatgcttttatcgagcaccgcgctgaggtgtttgatttcgccctgctggaaggcaatgaagaaaataacgtctgggtgtgcgactgcgccaaagtttacggccatgcgcgggtggtggcaggcagtgaggaagacgccattccgacgctgcgctacagcgcgcaggtggcggaacatgcggtagtggaaggcaactgtgtgctcaaacatcacgtgctggtcggcggtcacgcatggctgcacggcggcccgatcctgctggataacaaagtcattattcagggcgaggcgaaaatcagcggcaatgtcctgatcgagcagcaggtggagatcagcggtaccgtcaatatctcaggccaggcggacggtggcattcacctgcgcggaccaaaggtgctgaacggcgcggagcatatcacccgcacgccgcttatcggctcactgtgacgccgaatcgataatacgcgcgtaaatatactgatcgtcaaagcggccgttaaggaattcggcctctttcagacagccttcgcgcgtaaagccattgcgcagcgctacctgattgctggcggcgttgtccacccggcatttgatcacaaaacggcgcacttccccgcgcgcggcgtaaaacgccataaatgcctgtaacgcctgcgacagcaaccctttcccctgatgatcttcatccagccagtagccgatataggccgttttattagacggctctacagagttgaacgacagcacgccgacgatgcgttcgttgaacttcagcaggaacattttcgcgtagccgcgctggtgcagcatgatgttgctctgcgcgtttttcagcgagtcgtcttccgaaccgacatattgcggccagtttaagaactgttgcagccaggttttgtttttcagcaccagttggtgcagctcggggacgtcctgctcgttgatggcgcagagcgtgagggtgtcgctgacgggaataaggtcgtcctgagtcatgggaactccttgaggcgggaaaaatgccgggtggcgctgacgcttacccggcctacggtttacaggcgctgagcagaaacgtaggcccggcaagcctgcgccgccgggcacaataccggcaccgccgggtggcgctgatgcttacccggcctgcaagttacaaatattaacgcattacgcggtcatcgacgtaattacgcttgtcgggcgcgggcgggaaatactggtacagccaggtttcgctgatggcatcgccctgacagcgcaggaacatgcgcatatccaccggatcggtggaatcattagtgggataccagtcgaactggatgcgatagccgtcgatcggctcaacgtagaggatctccacctgtttcgcttcgccgttcgacagggtgatcaccggctcaatgcccttcggtgctgacgctttaatatcgccgccgacaaaatccaccgcgaagcgacgcgcccatacctgcggataatgctcgcccggcgcccagccttccgggaaaccgcccatgccggtacgggtcgccagcacgcgcgccatcggcgtatgcaccggcggttgcgcgctccagtagagacggtactggaaggcgagatcttcacctgctttgatcggccgctccggctgccagaagcagacgatgttatccagggtttcgccggtggtcgggatctccatcagcgccacagaccctttgccccacttgttgcgcggctccacccacaggctcgggcgtttgttataccagcccatgatgtcctgatagtgggagaaatcgcggtccagttgcagcagcccgaagcccttcgggttgtcgtcctgaaaggcgttgaactgtaatttctgcgggttattcagcgggcggcagatccattcgccgttgccgcgccacatcgccagacggtcggagtcgtggatctgcgggtgaatggtgtcgcacatgcggcgttcgttgttgccgcagctgaacatgctggtcatcggcgagatgccgagctgtttgatgtctttacgcgcgtacagatggttatccacctccatgatcacctggcttttctcgcagtggatcacgaatttgtaggcaccggtgaggctcgggctgtccagcagcgcatacacggtgaaggtggtgtcggtgggtttcgcggtttcaaaccagaaggaggtgaaatccgggaactcttccggcgtgtcggtaaaggtgtcaatcgccaccccgcgcgcggataagccgtactggtaggtgctgtccaccgcgcggaaatagctcgcgccgaggaaggaaacaatatcccggcgcgccagctccggcgctttaaaggcgcggaaaccggcaaagcccagatcgctctgcccttccagctgtttcgtatctacacccgcgtcgtggtagttgaacagctccggacggaaatggatctcgcgcgcttcggaggtggcgggatccagcgagaacatgcgcacgcggcggcggaagcccataccgacgtggaagaactgaatatccagctggcgatccgggatgttgttccacaatgagtgctgcgcatcgtactggatgctgttgtaagcctgcggcgtcagtgtggccagcgtatccggcagcggcttaggtttaccggcccaggcgttctgcgccaggtcatgggccatggattgcagcacggaaaaatcgaagcgacggctttgaccatcggcaatgccaggttccgcagcaaatgccgcacgggggaagagagaggcgaatcccgttgttccgcacgcagcggccagggccatagagcctttaataaatcgtctgcggttcatgcctgagaaaacatccttctggtcgggtgaatgcgttccgccactggcgaaacagcggcatcaaaaagaacgctcactctagacaaaaaacatagagaatccaatgcctggttggtgatcgtctgcgcaaagttgcaatatcgccctgtcgatgggagcgcactgattcctgcgtaaagaagtgtatgaaatgtcaacagaatgtatgactaacacgccgattttttaggggtaatcatccgctgtttatacttcagcggcgcacagcccattacatcattgaaacacttaataaaataggtgacatggttaaaaccactttgcgtggcgatgtctgccacagaaagagtagagtgttccagtaattcacaggcatgtttgatgcggcgaatgataatatattcctgaatggtgccgccggtttccttacgaaatgtcctggacgcataactccctgagacattcaggctggccgccatattttcgaggctgattttatgcgcataattcacctcgatataattcatgattttcgatgaaagtaccccgctgttccctgccctgacataaacgccgctggagagaaaacccagaatatttaacagcagcagcgccatgagttcggttttactgcccgcttcatgataactttcccagaaggtttgcagcattcctgcaaatttatccgccgcgcctgaaagatcgtaaatcgatacccgcgctccggcgtcggctatctgtaaaaataattgatgccgctgggaaaaagggcgcagatagccgctcatcatcgccgcatcgacatgaataatagtgcggcgataacggttagtatcggaattctccaccataaccttgtggattttaccctgcggaaaaacaaaaagccgccctgctctggcggtgaatttctgattgtccaccaccacaatacccaccccgctttcgatgtaaagcagctccaggcactgatgccagtggtaatagttcacgctcctgccgctgcttcttttgaattccgctgagaagtcatcaaggctgatgcgatctaacagggcctgatcggtcataggctaaggtcaagatagttaaatttcgcttcagcatagttaaaaatattcgctgaaaatagccgtattatcctgtctgcttccctccatgttttcttttgtgatcttgctaacgcttcgcagtgctgatcccccctattttcgtcgtcatcgaatacagagtgaaactttgtttcagttacgcaagcgagcaaaagaatatgttcttttcagacaataaatcgactcagatacaaacacgccgcgaaactaaatcgtgttttaacaccttatttgctgccgtctggcagcagcgcaatgatgattacgcgggtattttaaccggtaatcgcattcctctttacggcgaaaaaaccgcggcgatggaaaccttcagccgcctgctgtggggaatatttcccctgttagcgcagggagaagttaagcacgacatcaccgcggaaattattcgtcgtatggccgagggtaccgacccctcgcacccgcattattggggtgacgtgggggactttgaccagttgagcgttgaaatggcggtgtttggcgcaggcctggcgctggcaggtaaacaactgcgggatcagatgcgcgatgaggagtggcaacggctgatcgactggctgcggcaattacgccatgcaaaaattccggcgaataactggtcgttttttcccgtcatgatcgaaatgggtttttgcctgtgcggtgagtcctggtcgatggacattattcagcagcacttttcccgcctggacagcttttactgtggcgatggctggtacagcgacggccttaatcgaccccgcgattattataatgcgatggcgctgcatttttacggcctgatctattcccgtctgatgggcgattatgatccgcagcgctgcgccctgctgcgtgaacgcgccgatcgcttcgcccgcgattttatctgtttttttaatcacgacggcgcggccatcgcttttggccgcagtatgacctatcgctttgcacaggccgctttctggagcgccgccgcgtttgccgggttaagcacttttccgcctggcgtgctgaaaggcctggtgttacgtcatctcaacgactggctgcaacgggacattctcgacgcgcgcggcgtgctcaccgtcggatatggctacgccagcgatctcattgccgaagaatacaacgcgcccggctcgccgtactgggcctgtaagctgtttctggtgctggctcttaatgacgatcaccccttctggtccagcgatgcgcagccgttgcctgcgcgcgaaccgcgccgcgccttaccccatgccggacaaatcattattgacgacgccgttgccggacatcattacctgcttaatggcggccagtggccagggaaaaattacgccaacagcgaaagcaaatacagcaaatttgcctgctcgtcgctgctgggatttaacctggaacgcagccgttacggtatcgaactcaacgcctgcgattccatgctgctgctctcggagcacgacgggtattaccgcgggcgtcgcaccagcgaactgaaaacctgcacggaaaacgaactgcattttgtctggtcgccgtggccggatgtcactatccatagctggctgctgccgctcgcgtcaggccatctgcgtctgcatgtggtcaataccgcgcgatcgctgcacagcgtggaaggcggctttccggtgccgatcaccggcgatccgcagcgttcgtttgatgcctgcgccggaacctgcgtcagcccgcaacacggttttttctcgcgcatggtggatctgtcaccggcgctggtgcgcccctgtagcctgatcgtcagcccgcctgccagcaatattctttacccctgctgtagtgccgttccggttctgcaacaggatctcgcgcccggcgagcatattttgtgttgttttgtgcacgccgggaccaccccgcctgatgaggttgcgctgccggaaattatccgtcagccgcagcatattcaggtggtgcttcacccccatgtttatgacatccccttgccctgtaccgtcactgtggagtaggaaatgaacaccacccatcgtattgattatataaagatcagcgcctttatttttttgtattttgttatctggactatgagcttcagcttatattccatctggcttggtcagcatgccgatttaaccagcgcggaaatcggcgcggtattcgcggtgaacggtgcattcgccgtggtaatgaaaccggtttatggttttattaccgataaactgggaatgaaaaaatatctgctttattttgtggcgatcatgtcgtcgctgctgatgccgtttttcgtctatgtttatcacccgttactgagcagccatttttcgctcggcgtggtggcgggcgcgctctatcttagccttgcgtggtacgccgggatcgccgcctctgaatcctattgcgatcgctttggccgcttaaaaggctttgaatttggccgcatcagaatgtggggatcctgtggcgcagcggttaccgcttcgtttgcggggatcttatttaatattttgccgaccattaactttaccatcagcagcatcacctcgcttatcatgctggcgctgctggtgagcattaaaattccggcctccgataatcaggaaaacgccgtggtgccggagaagaaaatcagcctgccggacgtgcgacgcctgctgaaagatggcaagttctggcgcttctgtttttatgttgccggtattttctggatcatgcatatcgccgaacaacagttcccgcgctactttatttccttctttcatggcgataattccggcacctcctggtacggctacctcagtaccgtgcaggctatcgtcgagtttatttcaatgctcaccatgccctgggtggtgaataaacttggcgcacgcaaagcgctaatatttgccggtctggttatcggcctgcggctggtcgtttccggtttcgccaccggtccgttaatgatcgcctttattaaaccattatatggtctggaaaacgccctgctgttaatcgcggtgttcaaatatatcgccaatcacttcgataaaaaggtcaatgccaccatgtacctgattggctaccagtgcaccatgtatgtcggcaccatatttgtctcggcgccagtgggttatctgtatgaccatattggtttcggcaatacctatttcattatgggcggcatcgtgatcctctttgccctgctctccatctttgtgctctctgataacgatgagcggctggcgcttgccagtaatactaaaccttccgtctcgtaaggacttactgccacatgaatatgcatcaaaacagcctgaaagataaaccgctgaatagcgatctcaatgcgatacgggtcagcatgacccaaaagctgaagtatcaactgacaggttttgcaggacgctatcccgcggcgtgcagtattaacagcgcttacccgacaacgcccaataccgactggacgacgggtttctggagcggtatgacctggctggcgtggcagatgacggaagatgattttttcctccgccagctgcaacaacaattacccggttatgcagaacgcctggataatcaacatgatattgaaacgcacgatctggggttcttattcagcctgtcctgcgtaaacgcctggcgcagcaccggggatgaaaatgcccgcacccaggcgctgcgggcggcggatttactgattgcccgctatcaccctcatgcgcagattattcaggcatggggcgatttagcggatccgcaccagcagggccgcatgattatcgattgtctgatgaatttaccgctgctgtactgggcttcagagcaaaccggcgaccgccgctatgcgcagatcgcccgtcagcacgcctgccaggcgcagaaatatctgctgcgggaagacagctccacctatcacaccttttatatggatgtggaaacaggcgaaccgctaaaaggcaccacgcatcagggttatgccgatcattcgtgctgggcgcgcggccaggcgtgggcgatctatggttttaccctcagctggcactacaccggagaaaaacaattccttgaggctgcgaccgcaacggcacgttattttttgcggcatctgcctggcgatgccatctgttactgggatttgagcctcagcgcacccggaaccgcgcgggatagttcagcggcggccattgcagtttgtggtttactggcgctggcggattcgctgtccgtgcttgatcccgaacgcgggaacttcatacagagtgcgctgacgatcatgaatgaactgtgcgtgaattattacgatccggcattaacggacggcggttatttaaagcatgcggtttacaatatgaataaatcgcgcggcgttgatgaatattgtctgtggggcgattattttttctttgaggcaatttcgcgcctgcattcgccgttagcaaaatactggtaatcatatttatctaaaaaaatatcagctttgctgagaatatcttatctctgtcaaaaggtttgttatgaataaaaatatactgcttctggctattgcgctgcccgcctttagccatgccggcggctatcttgaagtacgcgaagcctgggaaagcgcgtcggaagaacaccagtttaaactgggtgcgggctataattttgataacggcgcggggctactgttccagacggtttataatacgggtgagctcaatcagcttaagcacagcttcgatgaaatagagggctggtacccgctgtggaaaattaccgataaactcacgctcagtcccggcggtattattaactcgactaatgccggttccaccacctcgccttatgtgcaactgggttacagcattaatccggatctggccgccgcgtttaaataccgctttaaccatatgaactaccggacccgcagcctggatcgggaaatggaatataatgataatcatcagctggtaatggtggtgaattataaaatcagtgaggtgctgagttatgaatttgaaccggatctctatatcaatacgcagaactacaaccgtaaaaacggcaaagatcatagctgggagctgaaccataaattcagctggaaaatgacccgcaactggcgtccgtttgtgcagctgtcctggctggatcgggataccggtaatcatgcggagcgttaccgcatccgtcttgggatgcgctattacttctgaggtgctgcaatcccccgccacaggcttacgggcgggggatcagggcgttatttcccgctgacgctaacgtcaatgcccgggaaatatttcgcggcaagacgggtgatggtgccgtcggcgcgcactttatcaatggccgcgtccagctgttttttcgtcgcctcatcgcctttacgcagcccaaaaccaataccgctgcccagaatggtgtcgtccgataccggcttgccgataaagccaaagcctttgccctgcggcttgctgaggaaaccggcctgtccggcagcggacatcaccagcgaggcatcgatgcggccattgagcagatccgcccacgccagattttgatctttataagaaaccacggtcacgccctgtttttcccagtgctctttggcgtaggtttcctgaatggagccctgcaatacacctactgatttacctttcagtccctccggcgtggcttccataccgctgtccgctttacccaccagctgcgacgggatacggtagatcggctgggtaaaatcaatactctgacggcgctgttcagtaatgttcatcgccgagttaatggcgtcatattttttcgccaccagtcccgggatcagggcatcgaaagaggtttccacccagctgcatttcagcgccgccgctttgcagatggcattgccgaggtcaatatcaaacccttccagttcgccgctggcgttgcgactttcaaagggcggatattccgcttccagcccgtaacgcagctcggcggccgcaaaggacgacagcgagcagagcatacccattcccagacagagtgctttcagtttcatcaatgacgctccttagcgtggcttaacccgacacagggcctgcgcccctgcccgtaatgttgcctcgtctttcgcaaaagagaggcggatcagtttgttatccgtgccatcggtataaaacgccgacagcggaatggtggcaacgccgcattcgacgatcagccgtttcaccagctcgctgtcgctttcgtcgctgaacgcgctgtaatccgccagcaggaagaacgacccggcgcccggcaggacgcgaaacggcgagtcttccagcagcgattgcagcatatcgcgcttacgctgataaaatgccgccagcgaaagccaggtttgcggatcgttcatatgttcggcaaaggcgtactgcatcggcgtatcggcagagaacatcataaactgatgcactttgacgatctcatccatcagcgcggcgggagcgatacagtaaccaacgcgccagccggtgacgtgataggttttgccgaacgaggagataatcacgctgcgctccgccagctgcgggtgcgtcgccatgccgtgatgctgctccccgtcaaagaccacgtgttcgtacacttcatccgacaggatcacaatatcggtattgcgcgtcaggcgcaccagttgctcaatatcgtgacgggaaaagacctgtccgctgggattatggggcgtgttgacgatgatcatccgcgtgcgcggcgtgatagcggcgctgacctcttcccagtcgacggcaaactccggcaccgtcagcttgattgccactggcgttgcgccctgtaaacgcacaatgggcgcgtagctgtcgaaggatggctcaaagtagatcacttcatcgcccggatgcaccagcccgctgatggccgagtacagtccttcgctggcgctggcggtaatcagcacttcgtcatccacgtcataccgggtaccatatagatcctgcaccttttcaacgatgcgctctttcagcggacgcaggccggtcatggcggcgtactgattatgtccggcctccatggcacgggtgacgcccgcgatcagcccggcatcacacataaaattgggcgcgccctgagaaaggttaatggcgttatgttcagcggagagctgaccaatgacggtaaaaatggtggtgcccacatcgggaagttttgagcgggtctgcaccggcgtacgcaaagtcattttcgttcctttctcagcaaaattgcataaccattcaaaccaaaagtcgattgaggcgacaaccgaattgttgtcataatagccatgacaaaaatgcatacccggagacaccatgctgcgtcgttccctgccccttaacgctattgacgcctttcttgtgaccgcccggcatctgaatctgacccacgccgcaaaagagctgtgcctgacccagggcgcggtgagccgcaaaatcgccgcgctggagcagtggtttggctttccgctgttcgaacgtcacgccagaggcttgcgcctgacgccccagggcagcgccctgctgccggagttacaggcggcgtttgaacatctggcgtcggtggccgagcaggcgcgccagcagcagacggtggtgcggctgaaagcgcccacctgcgccatgcgctggctggtgccacggttattaaggctggagcgggaaaacccggatttgcaggtgtcgctgaccaccaccagcgatcacacggtcaatttcaaaaccgaaccttatgacgcggccatcgtgtttggcacacagctgagcgcgggcgatctgttgtttgaagaagcactgacgccggtgatcggcgcgcaaggtgatgagcacagcgcgccggagcagatgacctttctgcacccgacgcgggataaaaccgactggacattgtggctggcgggccagacgcagatcgccccggtcatgaaaaaaaatcaacacttcgacaccatggatctggcgatcagcgcggcgatccagggctttggcatcgccatcgccgatgaaactttggtggccgaagatctgcgtgccgggcgactgcgccgcccgttcagccacagcgtgaaaaccggcgcctgttaccggctggtactgcgggagtcgccggataaagccgccgggctggccatcttccgcgatattctgctggcggctaatccatgctgattaaagcagtcctttctgtttaaaggtaatgcgggtggcctcgttcagatccaacgctttcagcgcgtccgccgacacccacatcacttcctcaaattcttcattaaaggtgatgtcgcggttggcggttatgcagtcgaagatcaggtagatcatgtaaatctcttcagtggtgccatccgggtaggttttggttcgcacatcatcccaaaacgtccagggctgaatatccgtaatatcgagacgctctcctaactcttccctgatttcacgcctgagcgcgatttccatcgtttccccaggctccatgccgccgcccggtaatgcccattgtccgggaaaaacaccacgatcggcggccatcttacacagcagatactctccgttattctggatcaccggacaaacaatcactcgctggcgcattttatctccttaatatcaatgccttctgaaacattttatcagaagccccttcccattaatgggaccagacgccaatcttacgcaatgcccttttgatcgctaatccagactaacgtgctggtgcatcacccgtttaaacagctccatccgcgcccgcataaagcggttgaccagcttaaacccggcatacttattcagaccgatacgtaacaggcggtctttacctcgtacgctggcctgccagcgcaccgggccgtgcagcgcagtgcagctgaggctggcgtgacgggcgaaattaacccagtaatccgccacttgtccggcgactttcagatcgctttctgtgacatagtcgcaggacggtgaaatctcgccgagggtgtcgaacacatagggcacatcgttgccatgccaggccccgtggggataggtttcatgctcggcctccgccacataatcaaaccagtagcgccagcagggctggccgatgcgctgctgcgcctgcatcaccacaaatcccatggtggtgaatgccatatcgcggcacacctggcggcccagctcggtatcgcctttaacgccgggatagagcaacttaataagcccgagaccgaagcggcgctgacggcgcagcttctggatctcccccgccagatcgacgccgaataccgacatgacgctcgcctcgtcgctgttggagccgatcattaccggcatcggatgctggcgggcgttgaaaaagcattcaatcatcggctgcggcagcacggcatcgccgacaatcggcacaggcgcaacattgtgcggcgcggccagcggccacagatcttccgccggaatggcgcgcagctgttccggcgtggcgtccggcagccccagatgctccgccagcgctttgcctttcgccagcgccgtacgccgcggcgtatcgggcagcgcatagccgctctgaataatggctttatggaacagatcttttgccagcggcgacaccatcagcgataacgcgctgcgcgctccggccgattcgccaaacagcgtgacgttttccgcatcgccgccgaaggcgtgaatattctctttcacccagcgcagcgcggcgatctgatcgagcaatgcaaagttatacacccgctcgcccgcttcctcttccagcgccggatgcgcaaagaagcccagatgcccgaggcggtaattaagggtgacaaccaccacatcgcgtcgtgccagcccgctgccgttatagggcggcagaccgcccgcgcctatggtgaagcctccgccgtgcagccagaccatgaccggcagcggttcacgacgcaccgctggggaccagatattgagatacagacagtcttccgagaactcgcccggatcgccgccgcccagcgcgcggcagtattcactgctctgccagctggagggcgaataggtgtcggcgacgcgtggggttgaccaggcggtcaacggctgcggcgcacgccagcggcggtcacccaccggcggcgcagcataagggatgccccgccagacgtgcagtccgttttcctcgaggccaataaccgttccctggcgggtttccgccagcggggtggagggattttccataagcgcattcctcttgctgttcagtccatcagcgtagcgggtttacagcagaccgcaacgctgtttactgcgatcctccgccgcctgatagagactgaactcatccagcaccgcgcagccgagcgcctgctcgaaggcttcgcggctggcgttaccctggcggcgctgccgggtttcattgcccagattagactggaaaatccctgccgcgctgaccggcagaaagtcttcataaatgatgggctgcgcggtgacccagccgcgttcaatcagcggctgcggatcgtcgccggggcggatagcctggcggtgcgcctcgccggtcggcgtcaggcggtagcggaaataggccagcccctggcggcgcagcagcaactcactgtccggaaaggctttaaacaccgcctggagatgcaactggtgattgaggttgtctttgccggtgcccgcctcgctcagcagacgatcataaagcgcgcggcctttcggcgtcagcgccacgccgcgctgttcgatttcgccaaagcgtgccgtatgcgtcccctgctcctccccggcaaaccgcaccggctcttccagcgctttgaaactggtctgacgcagcagcagcggcacttcacgacgcggcgggccttcaatcagaactttgggttcgataccatattcaggcatcagcgactgcacatgatcgatatccagtgtgcgcggcgttaaatggttgatatgacaacccggaaagcacaccacatccgcaatcagccggtgctcactgtgcagcgcatgataggtggcgtgatcaacggtggcatgctggtgccagcgaaaggtttccagcgcctcgcgcacaaattcgcgggcttcggcggcggtgaactctccctgctgttcatgccgttcgatgagcgccaggcagcgcggggtaaagatattccgggcggcgaggatcgctgccgaacgctcgcgcagatcgggattttcgatcagatcgaggcgcaggagcgaggtaaagacgcgaaagggatttttcagcaacgccgcgtcgtcaatgggacgaaaagccgtggaatgtaccggcacgccagcctgcgagagatcgtaatagctcaccggatacatacccataatggcaaacatacgccgcaacgtcgccagctctgacgctctgccgacgcggatcgcgccgtgccgttcgacattcagacgcgccagctcatcggcattcgccagctgttcatgcaggcgcggattctgctccagtaccgccaggtttacatcggccaccagttccagcagcgtgccgtattgcggaacttcttgctgatacatcgtcgacatggcctgcgaaaagtcttcccgaatgtcatctgccgtgatgttgcttgccatattgtcatgcctctggttgatatatctggagtgtagagaaggcagccgggccgcgcgggaagaatttagaaagtgtgatcctgaccagcccccgcctcgtccgcgagtccgcttgcataacaaaacattatgttcagcctcctccccattgctgaccgccagacggcgtgcgtacccgctttgcgcaataagcagttgtaagtcaaatagattaaatgttaataatattttgctagcaggttatcaatattcaacaacttctcttgtcagcgggtacgctctgtttttaacattacttatggaaaaaaatggtctgttcagtcagcgcatccgtctgcgccatctacatacatttgtcgccgtcgctcaacagggtaccctggggcgtgcggctgaaacccttaacctgagtcagccggcgttatcaaaaacgctcaatgaactggagcaactgaccggcacccggctgttcgatcgcggacgcatgggcgcgcagctgacgctggtcggcgaacaatttctcagccacgcggtgcgcgtactggaagcggtgaactccgccgggcaatccctgacccgtaaagaaggcgtgaaaacggacgtggtgcgcatcggcgcgctgcctacagccgcgctgggcattctgccgacggtgatcggggaatttcatccgcatctgccggacattaccattcaggtcggcaccatgaataacccgatgttgctggcgggcttaaaaaccggcgagctggacatcggcatcgggcgcatgtccgatccggagctgatgagcgggctgaactacgaactgctgttccttgaatccctgaaactggtggtgcgtccgcgtcatccgctgttgcaggataccgtgaccttaagccgcgtgctttcctggccggtggtggtcgcgccggagggtaccgcgccgcgtcagcatactgaagcgctgctcgccacccagggttgcacgctgcccaccggctgcatcgaaacgctatccgcctctctctcgcgtcagttaacgatagaatatgactacgtgtggtttgtgccatccggcgcggtgaaagacgatcttcgccagggcgcgctggttgccctgccggtgccgacgcacggcgcgggcgaacccattggtatcattacccgcattgacgccccgctttctgccggtgcgcaaacgctgctcagcgccattcgcaaatcgatgccggagtaaatccggcgttcttcctgttgcgcaatttatgaatttttcgttaattgtgtgataataaagttgttgattaagggttgctgttacgcacattacactcattcatcagcaacccgctgtcaggaagaaccgatgaaattcaaaaccgccataaaaccctaccacgctgctgccggtggtctgggctctctggaagcgaccacccgcttcgtgattgacagcaaaaatgccctcagcaatatgcgcaacctgctgcgtatgaacaaagcccgcggttttgactgtcccggctgcgcctggggcgatgacaataaaagtaccttcagtttctgcgaaaacggtgccaaagccgtgacctgggaggcgacgcgccgtgaagtggacgcccagttttttgcgcaacatagtgtcagcgccctgaacgcgcagagcgactattttctggaataccagggccgcctgaccgaaccgctgagctataacccgcagagcgatcgctatgagccgataagctgggcagatgcatatgcattaattgcgcaacatctgcatgccatggttcatcccaatcagctggaactttacacctccggacgcgccagcaatgaggcgtcttacctctatcagctgtttggccgtatgctcggcaccaataattttcctgactgttccaatatgtgtcacgaagccagcggcgcagggttaaaacgcagcatcggcgtgggcaaagggaccattcatctggatgattttgcccacgcgaacgccattttcgtcttcgggcaaaaccccggcaccaatcatccgcgtatgctgcacagcctgcgccacgccgccgatcacggtgcgcaaatcgtcaccttcaataccctgcgcgagcgcgggctggaacgctttgcggatccgcaaaaaccgctggagctggtgacgccaaaagcaggcaccatcagctccgcctactatcagccgaacctcggcggggatatggcggcggtacgcggtatggcgaaagcgctgctggagacgcaacgccagcgtcttaccgacggccagccgggcatttttgacgaaacctttattaatcagcatacccacggcattgatgcctggtttgcgcaaatcgatgccacgtcctgggacgccattacgcaacagtcaggccttacggaacagcagctgcgtgacgccgccgccgtgtggcagcacgccgagcgggtgatctgcacctgggcgatgggcatcacccagcataaacactcgctggacacggtgcgggagattgccaacctgcaattgctgggcggccatctcggcaagcccggcgcgggactctgcccggtacgcgggcacagtaacgtgcagggtaaccgcaccatggggatcgacgagaagccgcccgctgcgctgctcgacagtctggggcgtcactttgattttgagccgccgcgcgagccgggtcatcatacggttgaagccatcgaagccatgttgcgggacgaggtgaaagtgctgatcgccctcggcggcaacctggcggctgcggcgccggacacgccccgcgttcacgacgcgctgcgccgctgcgggctgacggtttatatcagcaccaagcttaaccgcagtcatctgatgccgggtaaagcctcgctgatcctgccaacgctgggccgcacggaagaagatatgcaggccagcggccgccagtttgtcaccgtggaagactctttcagcatggtgcacgcctctgaaggtatcggcaaaccgctcagcgcgctgcaacgttcggaaacggcgattgtggcgaacatcgcccacgctacgctcggggatgagaagctgaactggctggcgctggcggatgattattcgctgatccgcgatcacatcgccgccaccctgccgggctttgaaaactttaacgcccgctgcgatgaacccggcggtttctggctgggcaatgccgccgccgcgctgaatttcactacgccgtctggcaaagcggaattcagcgccgcgccgctgcccgcctccatctgcccggatgtggagtccccttttgtgctgcaaacactgcgttcgcacgaccagtacaacaccaccatttacgggctggacgatcgttaccgcggcgtgtacggccaacgtgatgtgctctttatgcatccggacgatatcgccgcgctggggctaagcgatggcgatcgggtggacattaccaccgcctcccgcgacggcatcctgcgtcaggtggagaatttccgcctggtttcttatgacattccgcgcggtaatctggcggcctattacccggaaaccaatccgctggtgccgctgaccagttttggtgacggcaccggcacgccgacctcgaaatcgatcccggtgtcggtgacgccggcgcagacgcgaccatcgttgcgtattgcctgatcttcctgccttgcccggcggcgcgcgcttgccgggcctacgttatttgttctccccccttcgttcccaaataatgctgattttatttttaacaattgcgtaaaacaatttaacagttttatcatgttgccagttcaccagatggttcattaacttattatctggtgggtaaagaccccatctttacgctaaatttaaagttttatttatccgtctggttcgcaataaccagcggattggtgtgttcaggagaacttatggcaacaagcaacaggccgcgcgggatggttcgtatcctgcagtggttacttgccgggctgatgatccttatcggtctggcgataggtattcccggtattaagctcgtctcccttggcggcagcgcttactttctggtgatgggcgtggtgatgctcattgccgccgtgttgattatccgcacgcgcagcagcgggatcctgctgtatgcgctggcatttatcgcctccattatctgggcgattagcgatgcaggctgggaattctggccgctgttttcacggctcttcaccttcggcgtgctggcgtttctggccgctattctctggcctttcctgcgcgccacgcagacggcgcagccgatcaataaaaaaccggcctttggcgtggcggcggtgctggcgctggtgctgctggtcagcgcgggctggatgtttaaaccgcaaacgctggtcagtgcaaatgaagatgtcccggtgcagcctgttgcccccggtcagcagcagaaagactggaagcactggggtaacaccacccacggcgaccgcttcgccgcgctggatcaaatcaacaagcataatgttaacgacctgaaagtggcctgggttgcccataccggcgatattccgcagagcaacggctccggcgcggaagatcaaaacacgccgctacagattggcgacacgctgttcgtctgtacgccttacagtaaagtgctggcgctggacgtggacaccggtaaagaaaaatggcgttacgacagtaaagccaccgcgcctaactggcagcgctgccgtggtttaggctattacgaagagacgcaggcgcagagcgcaccggcgcaaagcccgcaggtcgcggcctgcccgcgtcgtctgttcctgccgaccaccgatgcgcgtctggtggcgatcaacgccgataacggccaactttgtgatgattttggcgatcatggcgtggtggatctgagcatcggcatgggcgagatcaaaccaggctattaccagcaaacctccacgccactggtggcaggggatgtggtggtcgtcggtgggcgcgtggcggataacttctccaccggtgaaccgccgggcgtagtgcgcgcgtatgatgtgcacagcgggaaactggcctgggcctgggatccgggcaatccggcgctgaccggcctgccgccggaaggccagacctatacgcgcggtacgccgaacgtctggtcggcgatgtcctatgacgcgaaactgaacctgatctatctgccgaccggcaacgccaccccggacttctgggcgggtcagcgtacggaactggacgataagtacagctcgtcaatcgtggcggtagacgccgccaccggtcaggtgcgctggcattatcagaccacccaccacgatctgtgggactttgacctgccgtcacagccgctgctgtacgatctgccggacggtaaaggcggctccaccccggtgctggtgcagaccagcaaacagggcatgatctttatgctcaaccgtgaaaccggcgagccggtggcgaaagtggaagagcgtccggtgcctgcggggaacgttgagggtgaacgttactccccgacgcagccctattccgttggcatgccgatgatcggcaatcagacgttgaccgaatccgatatgtggggcgccacgcctgtcgatctgctgctgtgccgtatcgaatttaaggcgatgcgtcatcagggcgtctttaccccgccgggtctggatcgctcgctgcaattccccggctcgctgggcggcatgaactggggcagcgtgtccgtcgatcccaacaatagcctgatgtttgtcaacgacatgcgtctgggactggcgaactacatggtgccgcgcgctaatgtggcgaaaaacgccagcgggattgaaatggggattgtgccgatggacggtacgccgttcggcgcgatgcgcgaacgtttcctgtcgccgctgggcattccgtgtcagaaaccgccgttcggtactatgtcagcggtggatctgaagtccggcaagctggtgtggcaggttccggtgggtaccgtgcaggataccggtccgctgggtattcgtatgcacctgccgatcccgattggtatgccgacgctgggcgcttcgctggccacgcaatctggcctgctgttcttcgcggggacgcaggatttttatctgcgcgcctttgatacggcgaccgggaaagaaatctggaaggatcgtctgccggttggcagccagtccggcccgatgacttatgtgtcaccgaaaaccggtaagcagtacatcgtgattaatgcgggcggcgctcgtcagtcgccggatcgcggtgattatattattgcctacgcattgccgtaaatcgttgcccctcatcctaaccctcccctcagggagagggccggggtgaggggaaattcaacctgtcagaaggtttcccagttatcgttattcgccatcgccgggcgcgttgtcgccagcggggctttgggagccgctttctcagtacgaaccggtgcggccttttgcagacggaatgcgcctaccgcctgagtcagacgcgcggcctgctcttccagcgaggcagcagcggccgaggcttcttccaccagcgaggcgttctgctgggtgacgttatccatttcagtgatcgcctggcttacctgctcgatccctttgctctgctcatccgaagcggcagcaatttccagcataatatcggtcacacgtttaaccgcgtccacaatatcgcccatggtgtcaccggcggcgaccacttcgtttgaaccacgttcaatcagggatacggattcactgatcaacccctcgatctctttagcggcgttcgcactgcggcttgccagggtgcgcacttcgcttgccactaccgcaaaaccacgcccctgctcacccgcacgggcagcttcaacggcggcgttaagcgccagaatattggtctggaaggcgatactgttgatcaccgcggtaatttcagaaattttcttcgagctgctggagatattgcccatggttttcaccacgccggagacaatctgcccgcccttgctggctttaccggaagcgtcaccggccagtttactggcgtgatgcgcgttgtcggcattctgtttcacggtggcggtgagctgctccatgctggcagccgtctgctcgatggccgcagcctgctgttccgtgcgcgaggagagatcggtgttgcccatggagatctcgctggtgccgcgataaatctcttctgccccctcccgcacggtgcccacggtctgcaccagcgagtgctgcattttttgcagatcgcgggtcagcaagccaatctcgctgcgaccggttggttcgtcggccagcgtcagatcgcctgcggcaatgtgctcaatgcgatttgcggcgcgttgcagcggctggatcaccgtacggcgcagcaccacaaaggtaatgagtgtcaggatcagcgcgatgacaaaggccgcgcccataaacatcaggccgagctgcgtacgctggtgcgccagatcgctcagcgccgcggcgcgttcggtacggatcttgatcgccttcatgagcacgtcgttataatcgctgtccagctgacgggcgtgttcgttttcgtggttgataatggcttcaaacatgccgtttttggcatatttcagcatcggttgcaggccattgatataggcgttgtagcgggtggtgagttcgccgtccagcgcttcgtcggcggaggtttttacgccgcgattctgatagacggcaaagccttcctgcgactgcttaatgcgcttttccgcttcctggatgttggctttcatatcatccatttccgcaatgcggctggccgcgccggcatggatcatattgatacgcgctgtgcgtaagtggttggagctgttcgataatcccatgcgtatctgaatttcttcagtgacgtcgcgctgatcgccatcagcctgaatcagaaaatatcccgccagccctgcactcaatgcaaacagcaccaggatgccgctgagaattgaagaaaacagaggaactaaccgtatgtgatgtaaaaaacctacggtttgcggtttgtgcatcgctgctgtgttgtccatgctatcgactctcttataggaaggtgcgtcatacacgcctgtaaaatagtcatcggcaatccgggaatttcccttatgcctaaaagcgctagctggctcacagattcaaacaataccccctaaagaaatcctgaaggggtaaattgccggcggcagaccgccggctgtggcattagttatcgccgaaatggataacggtacggatagatttaccttcgtgcatcaggtcaaaggcttcattgatctgatccagaggtaaacggtgggtgatgaaaggatcgagctggattttgccgctcatcgcgtcttccaccatgcccggcaactgggtacggcctttgacgccgccaaaggcggagccgcgccatacgcgcccggtgaccagctggaacggacgggttttgatttcctggcccgcaccggccacgccgatgatcacgctctcgccccagcccttatggcagcactccagcgcagcacgcattacgtcgacgttaccgatacattcgaagctgaaatcgacgccgccgtcggtcatttcaacaatgacttcctgaaccggcttatcgtaatctttcgggttaacgaaatcggtcgcgcccatttcacgcgccagcttgaatttctccggattagtatccaccgccagaatgcgcccggctttcgcctggaccgcgccctggatcaccgccagaccaataccgcccagaccgaacaccgcaacggtatcgccctcttttactttagcggtgttatgtaccgcgccgataccggtggtcacgccgcagccaagcagacaaactttatccagcggggcttccgggttcactttcgccagggaaatttccgccactacggtgtattcgctgaacgtactggtgcccatgtagtgatagatcggctcgccgttgtaagagaaacgggtggtgccgtccggcatcaggcctttgccctgagtggcgcgtactgcctgacagaggttggttttgccggatttacagaacttacattcacgacattcagcggtgtaaagcgggatcacatgatcgcccggttgcaggctggtgacgccttcacccacttccaccactacgccgccgccttcatgaccgagcaccgccgggaatacgccttccggatcgtcccccgacagggtaaacgcatccgtgtgacacacgccggtatgagtgattttaaccagcacttcgccctttttcggcggcgcaacgtcaatctcaacaattttcaggggctggcctggcccgaatgctactgcagcacgtgatttcatagtgtctctccccttctgttctttgaacggtaatgattattttagataagagcgcaaaagatgaccgacttcggccatccgggctgcacgttgatccggtgaagtgtcaccgctgaccagctcatctttgaggtgaatttcgaccatctcgcccatcaggccattagccgcaccgcgaacggcggcgatttgctgcaaaatggcaatacatggttcgcctgcgtccagcgcacgctccagcgcctcaacctgcccgcgaatgcgacgcacgcgggttaatacgcgttttttgtcttcgggtgaatgcggcatacattctccttcttatactgtaggggggtatagtaaacagttaagggtgttcatgtaaacaagaaatctgaatgaaaaaacccgccgaagcgggttttagtcagtatcaatttgcgctattgcggttttacccgattgccggaggcatcgatcactgtttcgccgtcttctttcgtgaaagcgcctttctgaggcgccggaagaatatccagcaccacctcagaggggcggcacagccgggtacccaggggggttacgacgatgggacggttgattagcagaggatgctggagcataaatccgattaactcctcatcgctaaaactggcatccgcaagaccaagctgctcataaggctcgacgttcttgcgtatcagctcccgtacagaaattcccatatcgttaatgagttttaccagctcatcgtgcgacgggggggtatcaagataataaatgatgtcaggctcatggccgctgttacggatcatctccagcgtattgcgcgacgtgccgcaagctggattgtgatagagggaaatgttgctcatagtgttatctcattacaatgtgaaagagagacgcaacgccagcgcggccagagtgacaaacagcactggcagggtcatgatgataccggtgcggaagtagtagccccaggtgatggtcatatttttctgtgccagaacatgcagccacagcagcgtcgccagactgccgatcggggtgatttttggccctaaatcgcagccaatcacattggcataaatcatcgcctctttaatcacaccgctcgccgcgctgccatcaatcgacagcgcgccgatcagcaccgttggcatattattcatgatcgacgacagaaaagcagtcaggaaacccgtgccaaatgtggctgcccataagcccctcactgccagtatattcagcacgcccgacaaatattcggtgagtcccgcatttcgcagaccataaaccaccagatacatgcccagagaaaatatgacgatctgccagggcgcaccgcgcagcacttttacggtatctatagaatgtcctcttttcgccacgacaaagaggactaccgcccccatcgccgcaatcgcgctgaccgggatacccagtggctccagaacgaagaaacccaccagaagcagcagcaaaacaatccagcccgccctgaaggtcgcgggatctttaatagcgctgtcgggtgttttcagcagcgaaacgtcataggttgccggaatatccttgcggaaaaataagtgcagcatcaccagggtggcggcaatggccgccatatccacaggcaccatcaccgaggcgtattgcgtaaagcccagcctgaagaaatcagccgagacgatattaaccagattcgagacaatcaaaggcaagctggccgtgtcggcgataaaccccgcggccatgacaaaggccagggtggtgcctttgctgaatcccagcgcaagcagcatggctatcactattggcgtgagaatgagcgcggcaccgtcgttagcgaatagtgccgccaccgacgcgcccagcaagacgatccaggtaaacaatagccgcccccgtccgttgccccagcgggacacatgcagcgctgcccactcaaagaatccggattcatcaagcaacagactgataataatgacggcgataaatgccgctgtcgcgttccagacgatatcccagacgacgggaatatcatcgagctggatgacgccggttgccagcgccagcaccgcgccgatactagcgctccagccgatcctgaggcctctgggttgccagatgaccagtatcagcgtcagtaagaaaatacttcctgccagtaacatttaagactccattacatatgcataagtgaatgtgttttactgtttcagcaggaggtacaggcgaatttttgtagccattcacgcacatcctcccgcaggcattgccatgacgtggtaatggtctcggcggcccaggctggcatgtgaggtgataaacgatagtggatccacttaccctccctgcggtcaatgaccagccctgcctcgcgtaatatcgccatatgccgtgaaattttgggctgtgactcagaggtggcggcacaaatatcgcagacgcacagctccccggcctccctgagaagcatgatgatggagagccgtgtttcatctgagaggatcttgaacaactgaacgggaaccagcattacttgctccgatgccattagaatacacatatgttaaatcatatctgttagatttgaaataaacacatccccgcggacaagaaaagttgacggcgcttctgagcaaccgctacatcatccttataatgaaaaaacccgccgaagcgggttttaaatgcggatgcaatgagctgactaaacgccagaggtgtggcggggatcgctccccgccgtggctcttaacgtgtttcaacttcgtaggctaaatacgcggtaagctctgtgcttcctcttttgatatgcagctcgcatagcgtgccgcgcaccatccagacgaaaaccagaatggtgatacaaatcaccatcagacaatacacatagctcctgcgcatacaacctcctgattgatttctcacaattaagaggctaatcttctgttgtctaggcattggattggcctcattcgatttatagtcgagtggggcttttctcttctgcccggtgaactcaaagcagaaagcctcaagcacccgtcagccatactacgcagcagaatttaataaatcaaatcagtaatataaccattcatttgataaatagatctgcgcttaacactcccagcccagactttttcgtatcgcctgccgatacggcgtttcgaattcagtgggaaccctgcgcagataatcctgcgcatgttgccgcttttccccttccagcgtagccaggtagtccagcacttctttcacgcagggtacgcggccttcaagaccatgaatgcgtggcggcagcgccgtccagatcaccgcgtccagctgtttttcccttgcccattcagctaatggacctgcggacgtactgttaaacaccatcacgccgacgccatcactacgggagagcgggatttgctcgcgttcacgtagcgctgaaaccgcatcatgcagcgtttcggcattcagcatcgcccagaaaacatgggtcagcggcgcattcatgcacaccgcggtggccagttcgccgccatccccgacgcgggaaaattcgatgggtagtgctggtccatctttgaaccactcgctggccagcggcaatgcctctggcttccagattagcgatccccagccaagacatgcaattttcacgatcccatcccttcttatttttgtcgctacgctcaggtagttaagcttaggaggtgcatgagaaagtgccactcggttaccgcttcagcggcagccccgccgtttccttcgcgcgcatcaccgtcaggaaggtgatcagcgccgcgcccattacatagaacgccggggagaatggattaccggtagaggtaattaaccacaccgagaaccacggggtgatgccgccgaaaaaggccacggcaaagttataggcgatggagagcccgccgtagcgaatgcgggtcgggaagagttcggccatggccgcgctgcatgcgccgtcgaaggcagcgataaacgcgcccagcatcagcattgccagcacagccgacagcatattgccgttcgccatcaccatcatggccggatagctgaacaggatgaagccgccgcagcccgccagcatcagcggtttacgcccatatttatccgacagcagccccataaaaggcaccagtatggcgatgccaaacagcccgatagtggtgatggcgtaagcgtcgagttttgaaaaatgcatctgcgtggacagatagctcggcataaaggtctgcaacgtccagtgccctaccgccttgatcaccacaaagcccacgcaaaacagcagcgcgccccaggcggtttttaccgccgtacgcagcggcgcggcttcttttttaccgagctttgccatcgccagaaattccggcgagtcttcgagatgcttacgcagataaagcccgacccagcccagcggtccggcgatcaaaaacgggatccgccagccccagtcgttcatcgccccttcgcccaacagcgcggtcagcaggaacaccagcccggaacccgcgacaaaggccataaagccgaagttgtcgatccagcaggtaaagtagccgcgccgggcatcgggcgcatattccgccagaaaggtggtggcaccagagctttcgcccccggcggcgaagccctgcaccagacgggtgatcaccagcagcacagtggcggtaataccaatctgatgataagtgggcagtaaccccatcacaaaggtggcgcccgaggtgagcaaaatcaccgtggcgaggattttttgtctgccgacgcgatcgcccagcgaaccgaaatagagcccgcccagcggacgcataatgaatcccgcgccgaataccgcaaaagaagaaagcagcgccacggcgggatcgccggcctggaaaaactgcaagccgataattgccgcgagcgtaccgtacagcccaaaatcaaaccactcgacaaaatggccgacgccggtggcaagtaagactttgcgtaattttcgtgccgccacgctggtttccccggctggtgcacggtcaagcgactgctgaacaggctgagtcataccctctcctaatcacagtgtttctataatagatatactatctatacgctgtgccggagtttcgcccactacagccgttttaaaatgtgatgcataacgaacaaaaacggtgaaaaacccgtcaggatcacatttattaccgtgctgaatatataaagccccgccagtgcggggcctgtcgttgccggatcagcggcgtttttttggtaacatacgcagcagcgtattatctttccacacatagtgatgcatcagcgccgccgcggcgtgcaggccgataacataatagccgagggtcgccagcgtgacgtgataatccttgagcatatccaccagatcgaaatccgcttcggcggcgtgtggcatcactatgccgaaagcgatccagttgttgccgcggaaccacatcatcagcaggccgatgactggcagcgcgataaacagcaggtagatcaccagatgtcccagatgcgccatgccggtcagcatcgctctgggctttggcacaatagccggtgacggcgttttcaggcgcagcagcaaacgggtcaccatcagcaccagaatcgagatgccacaggaaacatggacgatattaaagtaaggtcggtaactgcgcggcgcgaagccgcgaaattccatggcgcaatacgcagtgacgaccaataaaaaaaccagccagtgaatggcaatctgccatcctgaataggtgctgcgcatgagactttcctgaaataaaacagtaagaaggcaaacataccgggctttttgcaaaaattcattaatttttcggttctgaatctgacgtgtaaaccataaaggagactggcttgaaaaccctcagtaatgcgtacctgttacaacttatggaagaggcgtcaagccgcgccacgaccttttccgtctggccgcagggtgaagcccccggcgcacagcaaagcccggtggcgtttcgcaccgaagagcagcataccgggccgtcggcttttgaccgttccgttaccggcgtgcgtgcgccgaccattacggtctatgctccggataaccctaacggcatcggtatcctggtgacgccgggcggctcctatcgccgcgtggtgctggataaggaaggcagcgcgctggccccgttctttaatgcgcgcggatacacgctgtttgtgatgacctatcgcctgccgggggacggccacgcggaaggcgcggatgcgccgctggcagacgtgcaacgggcgatgcgcctgctgcgcgcccgtgcggcagagtggcatctggatgcggataaactcggcgtgatgggcttttcagcgggcggacatgccgccgccagccttggcatccgctatgacgaagcggtgtacgcgccggtggatgacgtcgatgcgttaaacgcccgcccggcctttatggcgctggtctatccggtgatcaccatgcatgcggatattgatcatcccggctcgcgttttgagctgatcggcgatgcgccgacggaggcgcaaattacgcactactccccggaagatcgcgtcggtgtgaatacgccgccgacgtttttgctgcatgcggtggacgatccggcggtaaaagtggaaaacagcgtggtgatgttcagcgccctgcggcggctggggatcccggtggagatgcatctgtttgaacagggccagcacggctttggcatacgcgatgcgcagggactgccggttgccgtgtggccggaattaatgatggcgtggatcgcgtcgaaattcccctcatctgccggatgaggggcagcgatcagctctgcaaatacaccatctgggtttgcagatattcattcaggccgtggcgcccgtcggcgccgccaatgcccgatttacgccagcccgcgtggaaaccctgcatcgcctcgaagttttcgcggttgatgtaggtttcgccaaacttcaggccgcgcaccgctttcatcgccacgttcaggttggcggtatagatcgaagacgtcagcccgtattcgctgtcattggccatcgccagcgcctcgtcaagggtatcaaaggacaccaccggcaacaccggaccgaaggtctcttcgtgcatgatgctcatttcctgacgcacgtccaccaacagcgtcggcgggtaaaaatagccgttgccctccaccgctttgccgccgagcacgacggtggcgccctgctcaaccgcgcgcgcgactttttcttccacgcgggtcagtgccgcggcgttgatcaatggccccattgcgatatcgttacgctgcgccggatcgccaaactgcaccgctttcatcgcctcgcccagtttgttaacaaagcggtcgtaaatacctttttgcacatagacgcgctcggcgcagttacatacctgcccggcgttgatgatgcgtgaatcgacaatggctttcaccgccagctccagatccgcatcgtccatcactatcgccggggccttgccgcccagctccaggcacactttggtgatgtttttcgccgctgccgccatgatcttctcgcccgcgccgacgctgccggtcatgctgaccatcgccactttcgggttgcccgccagctcctgtcccacagtttctccgcgcccgagcaccaggttaaagacgccgcgcggcagaccgatctcatcgacaatttttgcaaaggcgatggcgttgtttggcgtgaattcgctgggtttaatcacaatggtgttgccggtgatcagcgccggggccagtttgcgggcgataaggaagaacgggaagttccacggcagaataccggtggtgacgcccagcgcgcgtttaaagacgaaaatattttcgccaggacggtcgctttgcaggatctcaccttcatagcgccgcgcccactctgccatgtaatcaatgtaatccgcggtaaaggccacttcgacgtccgccagctgctgaattttgccgccttcagcgacgataagctgactgatttcgctggcgcgctcgcggatcccggcggaaattttgcgtaaccagcccgcacgttcaatagcaggcagcgcttcccaggcgggctgcgcgcgctctgcggcatcaatcgccttacgggcgtcctccgccgtaccgtccgggatgcgcgataacagcgcttctgtggacgggttgaccacgtcaatccacgcgtccccctgccaggtgacaaactgtccatcgatatacatagggtgttgtacgggtgctgtcatgacctgctcctgtaataacattgtttttaacaagtaaattcgttgttaaaaatctacaagtgcagcgggctattcccatcttaataggctgattttgtgagataactcataaaagcacggcggatatgcaacaaatgtattacatcagagagaggacgaatgcccgtttgcgctgtgaatatcgcaaacgggcagcacgttatcgtaatgcccgatcccgcagggcggcgttcagggtgtcatccgtctgtaaggtgcgccaggcggtttccacgctggcgggaaaatcgacgtgggcgataaagttgcgcccccgcgggccgtacccctgctcgtcatcccgcagacgcggaacctcgccgaggatcagcgacagatagcgatccgccgcccacaggccgtcttcgcgcggcgtaaagctcagcccgcgctgtccgttacgcaactgcggcgtcacgcccggccagctcaggaaacgaatgtccggcgactgctctgcgctgacgcgggcgaaggtcgccatggtgcgccgctgcatggtcggatcctgcaccaccagcaccctgcgcgccgtcggtagctttgcgcgcagcaattcgcaggacagtcgcgcgttttcaccgcagtttgtggacttatcttccgcaagaatacgttcagcgggaatgcgccagaactgccgtgcaatatcgccaatgatggccgcctctgaacgtccggtggtgcggatgacgttataacgcggatggcgggcgatagcggcatacaaaaacggcgtggaatgaccaataccgccgctgatcaacaagggcgctctggcgcgggcggcgagctggcaggccgcgtctatggtcgggatcacggcgttccctgccagaataatagcgtcggcctgcaccggatgcggcttgccggcaaaatcattttgcgccagccactgcccgagcgtattgaccgccgccagcgtggtttccggcaaagtgggaaagcgggtaatgatcatgcaaatctccttttacgtaccatcctgtagagtacgatcgctcacagatttaaatagcggatctctcctaatccttaggtaacttaccgaattttatcgcaatattttcatcagatgtttatacctttaacggtttcaaattctgtcatgctgttgccagttgtatgtgacaacgtcacgtaaaatattcactataaatattgaattaccgtaattaattgacttgaattatcattcgcgggcactataaaatccttagccgcctaattattcattgtcgttatctggaatcccaatgcgtttgcccaaaagcgatccgtaccagccaagagagtgggcaccgcatgaaaagcccatgcttttagggtcgccatcgaccccctttcacagcacgcccaggcgcatcgcctatggcattgtcgggctactggtgtgcctgaccggcgcgcttggcaacgccatggtaaccgccaacctgcaaaatttgcagggctcgtttgccgcctggtctaacgaaatcgcctggctgccgaccgtctatgtgatgaccaacgtctccattaacctgctgctggttaaattccgtcagcagttcggcctgcgcgcttttaccgaaggttttctggtgctgtacgtgctggtgaccttttttcacctgttcgtcaacgatctcaactctgccctgatggtgcgcgccgcgcacggtatggtggcggcggccttgagttcgttgggcatttattatcagattcaggcctggcctgcgaaacatcggttaaaagcgctcactatcggcattaccggttcgtcgctggctatccccatcgcccgcctgttctccactgaactgctgcaaatcgacgaatggcgcgggctttacctgtttgaactcgggctggcactgatctcgcttgccggagtgatcctcctcaagctgccgccgggggatcgaaaaaaggtgttcgagaaaaaagatttcatcacctttatgctgtttgccccgggtatggcgctgctgtgtgcggtgctgtcgctggggagaattgactggtggtttgaagcgccgtggatcggctgggcgctggccggctcgctggtgctgatcgtcagcgccattgtctttgagcacaaccgcagcaacccgttgctcaatacccgctggttatccagcggcagtattgtgcgcctcgggctgattatggtgctcattcgtattgtgctggcggaacagaacaccggcgccatcggctggctgcaatatgtcgggttgcaaaatgaacaaatgacgcacctggcgtggtctattcttgccgggattgtctgcggcatcgtcaccagttgcctgaccatcaaaccgcaacggctggcctggccgattgtcacctcgctggtgttgatgatcatcgctgctctgctcgacagtcagtcaaacagcctgacacgcccggaccagttactggtcagccagtttctgctcggctttggcagcgcctttttcctcgcccctgccatgcttgccgccatcggcggcgtggtggcggaaccgcgcaacctggtgagtttttccgtgctcttcgggataagccagaacctcggcggcctgctcggttcggcgatccttggcacctttcaggtgtggcgggaaaaatatcactccagtgtgctcgccgaacaactcaccacgcttaatccgctggtgaacgatcggatccagctctacagtcagatgtaccgcagccagatcgacgacagcaccctgctgaacgtgcaggcgatcaatcagttacagaccgccagcgcgttgcaggcgaatattctggcctataacgatacctatctgctcacggcgaccatcgcggcctgcaccctgctgtggatcctgtggcggttactgcgattgcgcattacggctcatctggccctgaagcgggccatgcagcaaaaagcataaaaatagcggaacaatgaaatgaaacagaaattacgacaggagtggttatgagtcagcaggacgccgccaaagagcaggccaacacgcgcagcaatttgcgtgtggtttctatttttgccgctgcagcgataggtattgtgggcgtactggtgatcctctacgcctggcaacttcccccttttacccgtcacacccagtttacggataacgcctacgtacgcgggcagacgacctttatcagcccgcaggtcaacggctatatcaccgacgttaaggtgcaggatttcgccatcgtgaaacggggcgatctgctgatgcagattgacgaccgcatctatacccagcgcgtacatcaggcgcaggcccagctggcgatgaaaattgccgcgctgaacaataatctgcaacaacgcaaaagcgccgaggcggtgatcaagcgtaatgaagcagcgctgcaaaatgcccgcgcccagagcctgaaaagccaggcggatctgaagcgcgtgaaagagctggcctctgatggttcgctctccgtacgtgagcgcgatgccgcccttgccagcgcagcgcagggcagcgccgatatcgatcaggcacgcgccacccttgagatgtcgcgccaggatctgcaaacggtgatcgtcaatcgcgcctcgctggaagcggatgtggaaaatgcccgcgccgcgcttgaactggcgcagatcgacctgcaaaacacgcgcatcgtcgcgccgcgcgacggacagctcgggcagattgcagtgcgtctgggagcctacgttaccgccgggacgcacctgacctcgctggtgccgccgcagcactggattatcgccaacgtgaaagagacgcagctggcgtcgatccgtctgggccagccggtgcacatcaccgttgacgcccttaacgacgaggccttcagcggacgggtgcagagcatttccccggctaccggcgttgaattcagcgccgtcacgccggataacgccactggcaactttgtgaagatcgcccagcgtattccggtgcgcattgagatcgacggtaaaccggaacagctacagcgcctgcgtccggggatgtcggtgcaggtgaatattgatacccgggaggcagaataatgaccttccgtcctgtctggctggcgctgacattagcgctggcgggctgtcagtctgttgacgttgcccctgcccgtcattcattaaccattcccgcggaatggcgcaccgccgtgggtccgcaaagcccggtcgagggcgtatggtggcgtaatttccatgacagtcaaatgaaccgttatgtggaacaggcgctgcgccagaacaacgatattctgatcgcccgcgagcggatcaatgaatatcaggcgcgcatttatgccgcggaaggcgatctgttcccgacgctggatgctaaccttggcggcacgcgggcgcgttcccagtctgccgccaccggccagccggtacacagtacgctctacaaaggcggactgacggcgaattacgacgtggatctgtggggggcgaaccgcagcgccacggaagcggcgcgggcatcgctggcggcgcagaaagccgcggcggcggcggccgatctgactgtcgcatcgcaggtggcctccggctatatcacgctgctgtcgctggatgaacagctgcgcgttacgcagtcgacgctggcggcgcgggaagaagcttataacctcgctaaacggcagtttgaaacgggctacagctcgcggctggagctgatgcagtcggactcggaacgtcgcgccacccgcgcgcagatcccgcagttgcagcaccagattagcgagcaggaaaacgccctcagcctgctggctggcggcaatcccggcccggtgccgcgcggagcctttgaccggttaacgccgttgccggtgcctgcgcagttgccctctacgctcttaaatcgtcgcccggatattgtgcaggcacagcaggcattgatcgctgccgatgcctcgctggcggcgtcacaggcccggctgttgccgtcgatcagtctgacggcgggcggcacctggcaggcggataccctgccaggattgctggataatcctctgcgcttgtggaacgtcggcggcagtattcttgcgccactgcttaaccgtcaggcgctgaacgcgcaggtagatgtgtcgatgtcccagcgcaatcaggcgctgtacagctatgaaaatacggtgcgcaatgcgttcaaagaggtgaacgacagcctggatgctattgcgcgcttgcaggaacagttagtcgagttgcaggagcaggcgacggtggcggaagaggcgctgcggatcgcccataaccgttaccggaatggctatgcttcgtatcttgatgagctggatgcgcaacgcacgctctattcggcgcagaccagcgtggtgcaggtgaagaataatttgctgctggcacaggtggatttgtaccgggcgcttggcggcgggtggaccggagtgcggtgagggttttgccctgggtggcgtgaactgcccggtggcgctgcgcttaccgggcctacgggctggtgaggtgactgcccggtggcgctggcgcttaccgggcctacaaacggcgtgtacaccgctttagtaggccgggcaagacgcagtcgccgcccggcgaggcattacggctggatctgctccatcgcctgcaaaatacgcttatcggaaatcgggtacggcgtgccgagctgctgggcgaaatagctgacgcgcagctcttcgatcatccagcggatctctttcacatcgtcatcctcacggcgggcgggcggcagcttgttcagccactgctgccaggcctgctgtacgctctccactttcagcatctgcgcgcgatcccggtgcggatcgaccgccagcttctccagccgtttttcaatggcattcagataacgcagcgtgtcccccagacgtttaaaaccgttgccggtgacaaaaccgcgatacaccagattgttcatctgcgctttgatgtccgacagccccagcgccatggtcatatccacccgccctttcaggcgcttgttgatattgaacacggcggtcaggatctgctctacctgcttcgcaatctccaccacggtgtcgttaagttcagcgcgcactttttcgtgcagctgcgcataaccctcttccgtccacaccgggccgcccgcctcatggatcagcttatcgacgccgcaggaaatacagtcatcaatcagatccagcactttgccgtacgggttaaagtacaggcccagcttggctttgttgggcagcttctcatgcagatatttgatcggcgacggaatattgagcagtaacagacggcgcagaccgcgccacatctgctgttgctgctccagcgggttatcgaacagtttgatcgccacgctgtcgcgctcatccaccagcgcaggccatgccttcactttgtagttgccgcgtttttgctcgtagctttccggtagctgaccaaaactccagatatgcagtccgctctgttcgataccgtcgtcggccaccgccgacagggtttcctgcactttgcctttcagcgcctctttcagcgccgtcaggttgcggccttcctggagtttcttatttttatcatccaccacgcggaagctgatcttcaggtgatccggcacctgatcccactgccaggcgtcgcgatcaacggtcacgccggtcatgcggcgcagctcgcgctccagcgcatccagcagcggcagcgccagcggcgtcacacgccccaaaaaggcttcggcatagttcggcgcaggcacaaagttgcggcgtaccggcttcggcagggatttgatcagcgcgataatcagctcgcggcgcagtcccgggatctgccactcaaaaccgctgtcttccacctggtttaacagcggcagcggaatgtgcaccgttacgccatcggcatccgcgccaggctcaaactgatagctcaggcgcagtttcaggttgccctgatgccagaagtttggatagtcgagcttactgactttttccgcgccctctttgatcagcatgttcttttcaaagttcagcagatccggcgtttcgcggctggctttcttccaccagctgtcgaaatggcgtgcggagatcacctcatggctgatgcgctgatcgtaaaactcaaacagggtttcatcatccaccagaatgtcgcggcggcgcgatttatgctccagctcttcgatttccgcgcgcagcttcaggttgtcgcggaaaaacgcgtggcgcgtctgccagtcgccttccaccagcgcatgacggataaacagctcgcggctcaacgccgggtcaatctggctgtagttcaccttgcgcgcgctgacgatgggcagcccataaagcgtgactttttccgtcgccattaccgcgccctgcgcccgctcccagtgcggttcgctgtaggagcgtttgatcagatgctgcgccaccggttcgacccattccggatcaatacgcgcggcgatgcgtccccacaggcggctggtttccaccagctcggcgaccatcgtccacttcggcggctttttgaataaaccggaaccggggaagatggcgaaacgggcgttacgtgcgccggtaaattcctgcttatcggcgtctttcatgccgatatgcgataacaacccggtcagcatggcgatatgaatttcgcggtattccgccggttcgctgttcaccggaatgcccagctctttcaccacctggcgcagctgggtgtaaatatcctgccattcccgtacccgcagatagttaaggaactcggtgcggcacaggcggcggaaactgttcgaggacagcgctttttgctgctcgccgaggtagttccacagattcacaaaggcgaggaaatcggactctttgtcgtggaaacggcggtgtttttcatccgacgcctgctgcctgtccatcggacgttcgcgcggatcctgaatcgacagggccgaggtgatgatcatcgcttcccgcacgcagccgagcttttgcgcttccagcaccatgcgcgccagacgcggatccaccggcagctgcgaaagctggcggccctgtggcgtcagcttatacgccgtttgctgctcatcggtggtgatcgcccccagctcttccagcaggcgcacaccgtcctgaatgttgcgtttgtccggcgcttccacaaacgggaacgcggcgatgtcccccagccccagcgcggtcatctgtaaaatgaccgacgcgaggttagtacgcagaatttcgggatcggtaaattccggacgcgacaggaaatcatcttccgaataaagacgaatacaaataccttccgaaacgcggccgcagcggcctttacgctggttcgccgacgcctgcgagatcggttcaatcggcaggcgctgcactttggtacggaagctgtagcggctgatacgcgccgtgccgggatcgatgacatacttgatgcccggcacggtaagcgaggtttccgccacgtttgtcgccagcacgatgcgccgcccgctgtgagactggaacacgcggttttgttcgctgttcgacagtcgtgcatacagcggcagcacttcagtatgcggcagactgagcttgttgagcgcatcggcggtgtcgcggatctcccgctcaccgctcaggaaaatcagaatgtcgccggcgctttcacggcccagctcgtccacggcgtcgaaaattgcctgaagctgatcgcgctcggtatcgtccgcctcttccacaatcgggcgatagcgcacttccaccggaaaggtgcggcccgagacttcaatgatcggggcattatcaaagtggcgggaaaagcgttccggatcgatggtcgccgaggtgatgatcactttcagatccgggcgttttggcagcagctctttgaaatagccgagcagaaaatcgatgttcaggctgcgctcgtgcgcttcatcgatgatgatggtgtcgtactgcatcaacaggcggtcctgctggatctccgccagcagaatgccgtcggtcatcagcttgaccatggtgttgtcgctgacgtgatcgctgaaacgcactttataaccaatgcaaccgcccggctcgcttttcagctcctcggcgatacggctggccacggtccgcgccgccagtcggcgtggctgcgtgtggccgataaccccggtcacgccgcgccccagctccatgcagattttcggcagctgagtggttttaccggagccggtctccccggcgacaatcaccacctggtgatcgcggatggcttccagaatgtcctgcttcttctggctgaccggcagattatccggataggtgatgtcagggcgcgcggccatgcgctggcgcactttaccggcagcctgttcaatttcctgcgccatggtctggtaaatggcctgttgcgcctctggatttttaacctttctcgccccgtgcagacggcgcgcgaagcgttgtctgtcgcgcagcattaaggtttcaagctgctggttaagggcggagaaagtaaaattttgttgttctgtcataaggttatcgggcagcacactgccggtaaaatgtctctgtttcgtttactgtagattatcacatcgccgctttctttggcttattcaaaaaattcgaacattggtatcgatatattgcgctattcatggcggcggataatgaatagagtgacggtaattattgaggctatacctcaacatacatgcataaaaggaatcacccatgagtaaagtattagtgcttaaatccagtattctggcagggtactctcagtctggtcagctttccgactattttgttgaacagtggagcgaaaagcatccggctgatgaaattaccgtacgtgatctggcggctaacccggttccggttctcgatggcgagctggttggcgcgctgcgtccgtccgatgccccgctgacgccgcgtcagcaggaagccctgaagctgtccgatgaacttattgctgaactgcaggcccatgacgttatcgtcatcaacgccccgatgtacaactttaacatcccgacgcagctgaaaaactactttgacctgattgcccgtgctggcgtgaccttccgttataccgagaaaggaccggaaggtctggtgaccggtaaacgtgcggtggtggtgtccagccgtggcggcatccataaagataccccgactgacctgatcgctccgtatctgaaagtgttcctgggctttatcggtatcaccgatgtgaacttcgtgtttgcagaaggcattgcttacggtccggaagtggcgaccaaagcgcagtccgacgcgaaagcggccatcgacagcgttgtgacagcgtaacgtttttgctaatttgcgcccggcggcgcttcgcttgcgcgggcctacactttttgtaggcccggtaagcgccagcgccaccgggcaaaaacacttacccgccgatactttccagcgtagccagcacctcttctgacaactccagctctgccgccgccatattttcacgcaaatgcgtaaccgacgaggttccgggaattaacaggatattcggcgaacggcgcagcagccaggccagcgccacctgcatcggcgtggcattcaggctcgccgccacctctgacagcgtggatgactgcaacggcgtaaagccccccagcgggaagaacggtacgtaggcgataccgtcgcgggccagcgcgtcgatcagcgcgtcatcttcacgatgggcaatgttgtagagattctgcacgcagaccacgtccaccattgcacgcgcttcggcgacctgggtcgcggtcacattgctcagaccaatatgtttcaccagcccctgcttttgcagatccgccagcacctgcacatgttccgccagcgaaccttccgccgggccgtgtccgtcgccgagcatcgaacgcaggttaaccacgtccagcgcttcaacgcccagattacgcaggttgtcgtgtaccgcctgtttcagctcatccgcagaaaacgccggtagccaggctgccgtttcatcgcggcacgcgccgattttggtgacgatcaccagatcatccggataaggatgcagcgcctcgcggatgatacggttggtgatatgcggaccataaaaatcgctggtatcaatatggttaacgcccagcgcaatggcttcgcgcagaaccgccagcgccgcgtcatgatctttcggcgggccatatacgccgggaccggcaagttgcatcgcgccgtagcccagacggttgacggtcatcccgccgaaggtaaaagtgtttgctgttgtgtgcgtcatcatgatccttcctgcatgagttatagtaaatcgctgcgcgtcttcagcagcgtttcgacgtctttatccgctttaatatgaatatcgtggtcgatctttacgttcatattgatggtgattggcgtggacggtgccgccacttcgattcgcggcgtgcagcctgtcagcaacatcaggggcgcacacagagcgattaacgagaatttcattgttttacctcacattccttgccaggcgcgcagcggttatccggcactgtcgcatgttgctcaagccatgactgtaaattatcgccgtaacgtaaactgcgccataacgtgaagacattttcttcatggttatagttcaggttgaccgcattgcttttgccatcaacgtaactgatgcctttcagggcggcgcgcatcttcattacgccgtgattgtccaggtcgatatgcgtccaggattgcgaaatctccatatagcgtagccagctgatggccgccccggccgccatattatccttcaccagcgcgtcggcggtgtctttatcaagacgcagcgtcagcgcgcccggattgcttaaccagccatctttcacgatccattgatcgttattcagccacagcggcagcgcgccgttgagcgcgccggacatggcgaactgtttggtattaaccgcactgataatttcgctggcagaaatatgctccagccgcagcagcgcggcgtcgtgctgcggtatacgcagctggcggagggtgattttcccgccgagcatatccacgctgacgtcgctcaggcgcagcgggttatcttcgctccacgggtatgcgccctgcaaatccgcagtgaagtttttcgccgtcacctggttgatgatttcgccaatgcgcagccggaccggcccgcgcgtccccagttgccaggtcccctcgctgaagcggaacggcagcacaaaatcgacgcctttcagctcgttatccggcatccaggcgctgccgcctttcagcacaccgtgtcccccggcttcgaacccctgatccgcagcggcagaaaaggcgatctgcgcgtacatttcgccatcgcgcagggccattttccagtccggcggtaccagcggctgaaagactttcaacgcctggcgcggccaccacgcctgcccgcgcagccgttcgccgtcccagcgcccgttaacccgtaccgggccaatctcctgtgcgtggagatcgcctttaaactgaaagatcgtcggctcgcgtccactgatgctgaatttcagcgttgagggtggtaacacgctgccgccgctgaaggtggtctgcgcggcgtcgagcgacagcgcgccgctaaactgcggatgctgttcatcgcgctgccagcgtatgggcgcgtcaagtaccagccggggtttatccatatgcatggtgccgtactgcaactggtcgaagccggtggacagatcggtcagcaggatcaggctatcacgccactccccttttccggcgacatcccagcgcgcctgcatcggcgtgaagcggccatcaccccagtaacgccactgccagagaccgtgatccggcaggaagtcgtgcgcctggccgtcaaggtgcagagtaaaatcccccatctggttttcatgggcgcgcaaaatggcctgtaagcgaccatcaatgccgcgctgggtgactttcacccctgccagcggccagcgcacttcatcaatattcagggaatcaataagcgtgccgcgggagcgcagcagcgcgccggggctgaacgccagcagcggatcggtgaggctgccgctcagatgcgccggtaacacggcgtataaaatcaaatcgttctgcttggcttcgccggtcagttgcaggggcagatcgctgttttccagactcagccgccccggcccgatattcagtacggcgttgcctttgcctgcatcgccccgggtcagcacgttcatccggccgctgacttctgcgccttccagccccgcctgccagtttttgatgcgtatgccgacgcgcccgcttaacggcatgccctgataaggccagttccagcgtccgtcgctgatggtaagctgctgctgcgtcacctgccagggaagatcaagcagcggatcggcggtatcccgcgccatgacgatcagttggccttcgttgtcgcgccactcgatttccgcatccacaggatcggcgctttgcggcaggtgcagggtggcggcggcatggccgttaaccggcagaccgtccggcaccagcggcagggtgaactcccccgccaggctcagcggcggctggttttccacgagtttgaccgcgaatttttccaccgtcagcgcctgtccggaaagctgcgcctgcacggtgacgcgctcgccctcataactgagctgctggcgcgctggcgtcagcgcaagggcgattttcccttcccactgctgccagggcgtgaccgtcagtttatcgatattaacccaggtataaggcagcatggactgccactgcgccagggtgcgcggcgcggcgggcgatgctgtcgtctgcgggagttttttcagacaggcggcgttaagcaccagcgagtcgacattcagctgccagcggctcgggtgcgtcagttcggcatgcgtgagtttcgccagcgggcagtcgtccaccaggtaaagcaaatcagggattttcagaccatgacgcgtcagacgggggctttcttcaaaggcgatgcgtgtccccaccggcagccagatcccggccagccccggcacccactgcgccagcgtcatcagcagcgtaagcggcaaaagtatgaacagtaagagcagcgcgagcgcgactttatatttacccttcatgggcagttaatatcctgatttggcatcaattttctgtctgtccgtggcgttattgtggcatgcttacatatattggtgaagtgaatgcctctgataagagtagatgttctagaattaatcattatgctggattgatattacaatcactggagaaagtcttatgaaactcgctgtatatagcacaaagcagtacgataaaaagtatttgcagcatgttaacgagaattataactatgaacttgaatttttcgactttctgctgactgataaaaccgcgaaaacggcccatggctgcgatggcgtctgtatttttgtcaacgacgacggcagccgtccggtactggaagaactgaaaaaacagggtctgaagtttattgcgctgcgctgtgcgggctttaacaacgttgatcttgaggctgccaaagcgttagggctgaaagtggtgcgcgtcccggcctattccccggaagcggtggcggaacatgccgtgggtatgatgatggccctgaaccgtcgtattcaccgcgcctatcagcgtacccgtgatgctaacttctcgctggagggcctgaccggcttcaccatgtacggtaaaaccgcaggcgtgatcggcaccggtaagattggcgtggcggcgctgcgtattctgaaaggtttcggtatgcgcctgctggcgtttgatccttatccgagcgccgcggcgctggagctgggcgtggagtatgtggatctgcccacgctgtttgcccagtcggacgtgatctccctgcattgcccgctcaccgaggataactaccacctgctgaaccgttcgtcgtttgagcagatgaaagacggcgtgatgatcatcaacaccagccgtggcggcctggtggactcgcaggcggccatcgaagcgctgaaaacccagaaaatcggcgcgctgggtatggacgtgtatgagaacgaacgcgatctgttctttgaagataagtctaacgatgtgatccaggatgacgttttccgtcgcctgtccgcctgtcataacgtgctgttcaccggccatcaggcgttccttaccgccgaagccctgatcagcatttcggaaaccacgctggagaacctgcgccagctggaaaaaggcgaaaactgcccgaacgccctggtgtaagagcccttcgctcccctctcttcaggggagcgctttcagattttcctgcaagacacctcttatacgcctgttaaaatcagcgctcaatcacggagaatatccagggagttttatgaaatattttattgcgttaaccgcagccacgttgctgctggctggctgtgcccgtgatggcaaagtctctgtcacgccggatgagctgatgcaccaccgttttgtgctgcaaacggttaacggcactgccatcaatcctggcagtaatccgccggaaatcagctttggcgagaaaatgcacctttccggtgtgatgtgtaaccgtttcaccggtcaggggaaagtgtccgacggcgcgctgtcggcgaaaaatctggcgatgacgcgcatgatgtgtgccgatccgcagcgtaatcagctggatcagactttcagcgccatgatgaatgaaggggcacaggccgacctcaccggcaaccagctgacgctggccaccgcagagcagacgttaatctttaaactggccgacctggggcagtaatcagtacgcgccgcacgtgcctgacgcgagcgattgttcgctacaacgtttaccgttgggcagtgcgcacatgccggtggccgagccatcaagctgacgtgcgacggacagcgatccgccaatcatcgcgcagctggcttcaccggaactggtcatggcggctttcagacctggcgcgacgtgcgccgccgtggcctgctgaactggctcgctgctgcaagccgataataataatgccgcgcaccctacccacaatcctgctcgcatgttttctcccccgtcgatttagcaaaacctatgcataataggcagcccggcggctgacgtcgagagccagactgcgctttttctgtccggccatgagaatttccccattttgcggtatggctcccaattggtcaggacgtaaaaaaacccgccgcagcgggtccttttcttaatcaatgatgaagcatttcatcgacgacctgctcgttagtcagctgatacggataataggtcggccagttatccatctctttcagcagagcgtcctgcgaggtattgccggtgaaaatgtggtaatgcgcggatttgcgcgggccgatggtgtgatcgctgaactgcacgaacttcggcgctttactgttggcatccttacattcgaacaggtagcgcacgcccttcttgcccgaggtataggtgaggattttgtagcccgcgtaatcgtacttacaggcgttaaccacgtcgccggtgtggaattccatcacgccgttttcaatgccgatagtgtccactttcgtggcgtagcctttgcggtaataggctttgtactcgtcagcggttttgctcttgtcctgttccgctttcttcttgaataccggatccagttcgccgctttccagcaacggataaacggattgccatacgccgtcccagtcgctcaggctacgatcttttacgtcgctgtcctggaatacgccgttcgcggctttttgttccatttcggtcagcggttttccgtgagaatgatgaccatgcgccagcgcctgcccgctcagtaaaagcgccccgagcgccattgccactgttccatattgctttatcaaaacgctaccctcattaagatttagaaacatggatgttatgatataacatttatattttcaagcccgaccattaaacatcaattcattgaccggggttatgaggagtacacaaaagcgaaaatggcttcagaggggatttgctaaaatagaagcataattacagggcacgccggtgttatgcgtgtcccttttattgcgcaatgtaagggtgtcctatgatcacaactgacggtaatggcgcagtcgcctcagtggcgttccgcaccagcgaagttatcgccatctaccctattacccccagctcgaccatggccgagcaggctgacgcctgggcgggcaacgggctgaaaaacgtctggggcgatgtcccgcgtgtggtggagatgcagtcggaagccggggcgattgccgcggtgcacggcgcgctgcaaaccggggcgctttccacctctttcacctcgtcacagggcctgctgctgatgatccccacgctgtataagctggccgggcagttaacgccttttgtgctgcacgtggcggcgcgcaccgtggcgacccatgcgctgtcgatctttggcgatcactctgacgtcatggctgtgcgccagaccggctgcgccatgctgtgcgccagcagcgtgcaggaagcgcaggatttcgcgctgatttcccatatcgcgacgctgaaaagccgggtgccatttattcatttctttgatggtttccgcacctcccacgaaatcaacaaaatcgccccgatcgccgacgagaccatccgcgccctgctgccgcaggaggagatcgccgcccaccgtgcccgcgccctgaatccggagcatccggtgatccgcggcacctcggcgaaccccgatacctatttccagtcccgcgaggcgactaacccctggtacaacgccgtttacgatcgcgttgagcaggcgatggatgattttgccgccgccacgggtcgcgcttataagccgtttgaatattacggtcacccgcaggctgaacgcgtgattattctgatgggctcggcgatcggtacctgtgaagaggtggtggatgaattactcacccgcggcgaaaaagtcggcgtgctgaaagtgcggctgttccgcccgttctcggcgcgacatttgctggcggcgttgccggaaagcgcgcgcactattgccgtgctggatcgcaccaaagagccgggcgcccatgcggaaccgctctatctcgacgtgatgaccgcgctggcggaagccttcagtaatggcgaacgcgacgccctgccgcgcgtcatcggcgggcgctacggcctctcctccaaagaatttggcccggagtgcgtgctggcggtatttaatgaattgcagtcggcaaagccgaaaccgcgctttaccgtcggcatttacgatgacgtcaccaacctgtcgttaccgctgccggagaataccctgccgtcaaaagccaaactggaggcgctgttctacggcctcggcagcgacggcagcgtgtcggccaccaaaaacaatattaagatcatcggtaactcgacgccgtggtacgcccagggctatttcgtgtacgactccaaaaaagccggtggcctgacggtgtcgcacctgcgcgtcagcgagcagcccattaactccgcttatctgatttcgcaggcggactttgtcggctgtcaccagttgcagtttatcgacaagtaccagatggcggagcgcctgaagccgggcggtattttcctgctcaacacgccttacgcgccggatgaggtgtggacgcgactgccgcaggatgtgcaggcggtgctgaaccagaaaaaagcgcggctgtgggtggtcaatgcggcgaaaatcgcccgcgaatgcggcctcggcgcgcgtatcaataccgtgatgcagatggcgtttttccatctgaccaacattctgccgggcgacaacgcgctggcagcgttacagggcgccatcgccaaaagctacagcagcaaaggcacggagctggtggagcgtaactggcaggcgctggcgctggcgcgcgagtcgttgtcagaagtgccgctgcagtcggtgaatgccgccagcccgcaccggccgccagtggtgtcggatgccgcgccggatttcgtgaaaaccgtgaccgctgccatgctcgccggtctgggggatgcgctgcccgtctctgccctgccgccggacggcacctggccggtgggcaccacccgctgggaaaaacgcaatatcgccgaagaaatccccatctggaaaccggagatctgcacccagtgtaaccactgcgtcgccgcctgcccgcactctgccattcgcgccaaagtggtgcagccggaggcgatggaaaacgcgcctgccagcctgcaatcgctggacgtcaaatcccgcgatatgcgcggccagaaatacgtgttgcaggtcgcgccggaagactgcaccggctgtaatctgtgcgttgaagtgtgcccggctaaagatcgccagaacccggagatcaaggccatcaatatgatgtcgcgcctggagcatgtggaagaagaaaaagtgcattacgacttcttcctcgatctgccggaaatcgaccgcacgtctcttgagcgtattgatattcgtacctcgcagctgatctcgccgctgtttgaatattccggcgcctgctctggctgcggcgaaacgccctatatcaaactgctgacgcagctgtatggcgaccggatgctgatcgccaatgccaccggctgttcgtccatttatggcgggaacctgccgtccacgccctacaccaccgaccgccatggccgtggtccggcatgggccaactcactgtttgaagataacgccgagttcgggcttggcttccgtctgacggtggatcagcatcgtcagcgcgtgatgcgtctgctggacacctttgccgatcgtattcctgccgaccttaacgatgcgctgcacgcccccgccacgccggaagttcgccgtgaacaggtcgccgccctgcgtcagcagttggccggtaccgacggcgcggaggagctgctgaccgacgccgacgcgctggtggagaaatccatctggcttatcggcggtgacggctgggcctatgacatcggctttggcggactggatcacgtgctgagcctgacggaaaacgtcaatattctggtgctggatacgcagtgttattccaataccggcggccaggcctcgaaagccacaccgctgggcgcggtcaccaagtttggcgaacacggtaaacgtaaagcgcgtaaagatctgggcgtcagcatgatgatgtacgggcatgtgtatgtcgcgcagatctcgctgggggcgcagcttaaccagacggtgaaagccattcaggaggcggaggcctatccggggccgtcgctgatcatcgcctacagcccgtgcgaagagcacggttacgatctggcgttaagccacgatcagatgcgccagctcacctcaaccggcttctggccgctgtaccgcttcgatccgcgtcgcgccgacgaaggtaaagtgccgctggcgctggactcccgtccgccgtctgaggcgctggcggatacgctgatgaaagagcagcgtttccgtcgcctgaacgcccagcagccggaagtggcggaacagttatggaaggacgccgccgccgatctgcaaaagcgctatgacttcctggcgcagctggccggtaaagcggaaaaacacccggcggaataagccgtcatccgggccgaatgctggcccggtactttctaaagcccggtgcccatcgggcttttaagccccctgaaaggccgttatttcatcacccgatatgctgtaaaaaatgataatcttgatgaatgccgagctgttaaggacaccaccgtgcgccatcatcccgtaaaatcatcgcgaattgcctccatcgggtacgaagaaagcacccgtacgctggaagtgcggtttcataataaaaacgtttaccagtatcgcggcgtcccctcgcgcattttcagcgtctttctgacggtcgtctcgaaaggccgcttttatgatggcgtggtgaaaggaaaatatccggagcaccgcatcgcctgatcttttatcccaccggcaccatcagaaaatcagaaaaccgcgtggtgtagcgcggcgacagcatttcacgtttcatctgccactcctgacggatcccctgcccggcgaaatagagcgtcccccgtccttttttgcggttcagttcatcaagcgtcgccatcagcgcctcgctgccgggccgcggggcatggtcatcaaacagattaagctgggcgacgccctggctgaagaaatcccccagcatgacgcccgctttctgatagtggaatccctctttccagatgagtttcagacagcgcgtggcggcgtcaataatatcccggctgtcctgagtgggcgtcagcaggctgatggaggcgcttttgccatagtaaggctcgtttaacgcaaagggcgaggtcttcacgaaggccgaaataaaccggcagtactggcgttccgcccgcagtttttccgccgcgcgaaaggcatggctgcaaatggcctgacgcatgtgctcatagtccgtcacccgctcgccgaagctgcggctacagatgatctcctgtttggtcggggtcaactcctcgaacgccaggcaggattcgccgcgcagctcgcgcacggttctttccagcaccacgctgaaatgtttacggataaagttaatgtcggcatcggccagctgaatggctttgctgatccccattgcctccagccttctggcgatgcgccgcccgatgccccacacctcgcccacatccagccgcgccatcagcttgcgctgccgctccaggttcgacagatccaccacgccgttaaactgcggccagcgtttggcggcatagttagccagcttcgccagcgtcttggtttgcgcgatgccaacgccaaccttcaggcgggtatcccgcgcgatggtctggcggatctcctggccgaacgccgtcagatcgcgacaattgcgcacgccggttaaatcgcaaaaggcttcgtcgatggagtacatttccacgcgcggacagagatattccagcgtgtccattacccttttgctcatgtcggcgtagagctcatagttactgctgaaacaggtgatgttatgggcgcgaaacagatcccgctgtttgaaaaaaggcgcgcccattaccacgccgtattttttcgcctcggcgctgcgggcaatcacgcagccgtcattattgctgagcaccactaccggcttaccccacaaatcaggccggaatatggtttcgcaactggcataaaatgagttgacatccaccagagcaaacataatcagcgtgtcgcttttacgataaaggtgaccacgccgaatacttccagcgcatcttcgctcaggatgggaataggtcgataggcgcggttgagcggattaagttgcaggacgggacgaagctggagttgtttgacggtaaattcgccgtcgacggcggcaataataatatcgccatgatcggcttttagcgaggcatccaccaccagcagatcgccgtcgctaattcccccttcaatcattgaatcgcccgcagcgcggacaaaataagtggctgagggatgctgaattagccattcattcatatcgagcgttttttcaacataatcctgcgcgggagaaggaaaaccgcactggacaagatcgccgaacaaagggagcgcgtaaaccacgcgcagttcagcagggtgatagcacttcatggtgagtcaccttatttgtttttactgtgtatttatacagtagatttatatattacgctgatcaagtccctgcctgagccgaaaagtctcatagaattggctttataagataaatttcattattaattaatgatttagatatatgtgtaaatttttcacgatgacgtgtgactgcgtagttcttgaacgagacggcgtattccggcgaaaggagtaatcagacgaatttattgctacaatcgtgcccggcggatctgacccaacaccagggtggatgccataaaatgccatcatccgaactgagccactattacatgtcgcaaaatcaagaagttaacaaaaaagaacagtataacctgaacaaactccagaagcgtctgcgccgcaatgtgggtgaagccattgcggacttcaacatgattgaagaaggcgatcgcattatggtgtgtctgtcaggcggtaaagacagctacaccatgctggagatcctgcgcaatctgcagcagagcgcgccggtcaatttctcgctggtggcggttaacctcgatcagaaacagcctggcttcccgggtcatattcttcctgaatatctcgaacagctcggcgtcgaatataaaatcgttgaggaaaatacctacggcatcgtaaaagagaagatcccggaaggtaaaaccacctgttcactctgttcgcgtctgcgtcgtggcattctttaccgtaccgccaccgagctgggcgccacgaaaatcgccctcggccatcatcgcgatgacattttgcaaacgctgtttttgaatatgttctatggcggcaaaatgaaaggcatgccgccgaagctgatgagcgacgacggcaagcatattgtgatccgtccgctggcctactgccgcgagaaagacattgagcgttttgccgaagcgaaaggctacccgattattccgtgcaacctgtgcggttcgcagccgaacctgcaacgtcaggtgattggcgacatgctgcgcgactgggataaacgctatccgggccgtctggaaaccatgttcagcgccatgcagaacgtggtgccatcgcacctgaacgacgttaacctgtttgattttaaaggtattacgcagggggctgaagtggtggatggcggcgatctggccttcgatcgtgaatccattccgctgcaaccggtaggctggcagccggaagacgaagacgctcaactcgatgagctgcgccttaacgttgttgaagtgaaatgatgttgcgcctctctggtcatatggccagagaggcattaaggcttatttcagtaaacgtacgcggcaggtcttgcctttaattttgccgctctggaactgcttccacgcctgacgcgccacgccctgacgcaccgccacataaacatgtgccggatgaatggtaatcttaccgatatctgcgccatccatgcccatatctccggtcatcgcccccagcacatccccggcgcgcattttggcttttttaccgccatcaatgcacagcgtcgccatttccgcttccagcggcacaactttcacgtttgctggcgggttcagccagttcagcttcagttgcagcatttcagacaggatattggcgcgctgggcttcttccggggcgcagaggctgatcgccagaccgctgttaccggctcgcgccgtacggccaatacggtgcacgtgcacttccggatcccacgccagctcgtagttcaccaccagttcaagggacttgatgtccagcccgcgggccgccacgtcggtcgccaccaggatgcgggcgctgccgttggcaaagcgcaccagcgtctggtcgcggtcgcgctgctccagatcgccatgcagcgccagcgcgtcctgccctgcttcgttcagcgcatcgcatacttcctgacaatcttttttggtgttgcagaataccacgcaggacgccgggcggtgctcgctcagcagcttttgcaacaggctgattttgccgttgcgggaaacttcaaaaaattgctgctcaacggcaggcagatcgtcgacggtatcaatttcgatagtttccggatcgcgctgcacgcgtccgctgatggcggcgatagcctccggccaggtggcggaaaacagcagcgtctggcgcgaggcgggcgcaaagcgaatcaccgcgtcaatggcatcactgaatcccatatccagcatgcgatccgcttcatccatcaccagcgtttgcaggtgatcgagcgccacggtgttcttttgcaggtgatccagtaaacgccccggcgtggcgacgataatatgcggcgcatgttgcagcgaatcgcgctgcgcgccgaatggctggccgccgcacaacgtcaggatcttaatgttcggcataaaacgcgccaggcggcgcagttcgctggcaacctgatccgccagttcacgggtcgggcataaaatcagcgactgcgtctgaaactggctggcgtcaatgtgctgcaacagccctaagccaaaagccgccgttttcccgctcccggtttttgcctgcacgcggacatctttcccggcaaggatcgcgggcaacgccgctgcctggacaggtgtcatggtcagatagcccagttcgttcaggttctcgatctgggcggcgggtagagcattcagggtagaaaaagcggtcacagtatattctcgcgataaaaggccaggttcagcaggcgcgtatcctctcagatctgcccgctcaacgcgacaatttaatcggcacctcgtccggcggcggatcgggtaaaggctgtggatggggaatgggatcgggcaccggaaccgggtcaacggggatcgggtcggtgggcagcgtatcaacaggattaaacagattgagacgggacatagttacctccgcgtgaatgaagcacaccttaagggtagaagctcacggaaaagaggcaaaaaaaagccgactctttaaagccggcgtcgtacgaatcaattgtgctatgcagtaattcaaaaaaaggaagtaagacaatatggagcgcaacgcccatcgcttgacgttgcattcacctgcgggagagatagtgccctgaatgaaccggcgttttattgatttcgctcaactaagatggccttttcatgtttgcattttgttaaaaaggttaaaatttacaaccatttactgcgatgtaaccaccaggtaactccgccgatcaataccaccaacatcaggcagaagatcgcaaagccgagatgccagccgccgccgggaatgccgccgaggttaacgccgaacagcccggtcaggaaggtactgggtaaaaacaccattgccatcagcgacatggtgtagctgcgtcgtgacaatgactcctgcatcacctgggtgatctcatcggtcatcacgcccgtacgggcgatacaggcgtcgatttcatccagcccgcgtcccagccggtcagaaatatcctgcatacggcggcgctgatcgtcattcatccacggaaaacgctcgctggcgagacgggcatacacatcccgctgcggcgccatatagcgccgcattacgatcagctgtttgcgcagcagagccagaaaaccccgcgggggaatttgctgatcgagcaggttatcttccagatcgatgattttgtcatgcagcacttcgataaattcgctggcatgatcggtcagggcatcgcagacatccaccagccagccgccgacgtccgtcggcccggtgccttcctggagatcgtgcaccacgtcatccagcgccagcactttacgctgccgtgtcgagacaatcagccgctcatccatatataaacgcatcgccaccagctgatccgggcgctcatcggtgctgccgttaatgcagcgcagcgtgatcagcgtcccctcgcctaagcggctgacgcgcggccgcaggctgtcgcccgccagcgcatcgcgcacgttgttgggaagcaaaggcgtggtcgcaagccaggccgcgctctcctgattggtatagttgaggtgcagccagcatggatgcttgtcgtcaataacgtcttcatcgctcagcgtcgtcacgccgcctttaccatccagcagccacgcatagactgcatccgggacgttaacgtccgatcccttaattgcctccacggcccctccgcattcagcactgtaatgaaaacagtctagctgtctgccgggcttaagcaatcagaaaaggtgccagtgcgctgaattttatggagaaatgccgcgcctgcctgcgccactggctgcggcgcgttttccagccggaaactgcgcgttctgccctggagttcaagcacctggcttttcagcacatccgccgagccggacagctcatccaccatagtgacattgctttgggtgagtttttccagctctgacagcgcctggctgatttgcgcgatacctttttcctgttgcagcgttgaaaccgaaatctcatccataagctggctcacctgcccggccccggcgacgatctcctgcatgtttttacctgcttcttcgaccacctgcgcgccctggctgacgttttgcgtcgtcaccgcgatcagcgatttgatgcttttggcggcttcggcgctgcggtgcgcaagggttctgacctctcccgctaccaccgagaaacctttaccatgatcccccgcacgggcggcttccaccgcggcgttaagggccagaatattggtctggaacgcgatgccgtcgatcatggcgataatgtcggtcatctgctgcgcacagtcggtaatggactgcatattgttcgagacttgatccattagctcaccgccccggcgcgcgctgccggtggcttcgctggcgtactgcgtggcgcgccgggtgttttccgcgttatttctggtgctggccgccatttgctccatgctggaagcggtctggatcagcgcggcggactgctcttcgcttttcaccgccagctccgcgctgcgggagtgcagctgcccggaaagatccatggccgcctgcgaggaggcgcggatttcccgcaccagcgtggcgatgttactggaaagatgattgatgcccgggatcaaccgccccgcacagttgttaccgaaaatcgggatggtaatagataagttaccggcgatgacttcatcgatgctttttttaacggtattgatcggcgagactaaataaaacgtcatatatgcccataataaaccgagcgttatcagcgataaaatagccagcagagtaattaaggtgccgtcttttgagacggccatcactattatttccatgacaacaaatgtactcagcaggaataacatgatgaaggttcgaacactaatatgtttaagcataaacaggcctgctaatacgtcagggagggattcagtagttttatagcatctggaataccctttttcactctcatttttaaggcgcatcatgttcgccgttaatagcggaaagttttacccaagggataatttttcactacttaaaatattttcataagtggataacactgcatctgtagcataaacgtgtttgacgccgcagcgcggttgtctcagggataagcatgaagaaatatttagcgtcctttcacactccgcccctgaaatttaatgtagccacacttaaatgcgaagaaataatgtgcaacgcaaaagctaatgcgcctttttaataattcggtgataaaggctgacgccagccaaaaattccggcgcgcataatctgttatttgaccgctttgttacagcgcctcctcccgccgggacagggtaaaatcgcttaataaacaaacagctttttagcgcctggtttgctaacatagcgccccttttacctgctatcgacgaccaaccggcatgtccaaaaaaagaatcgggcttcgttcgctattgatcatcctctctgtgggcagcgtcacgctgacctccctgcttctgctcagcacgctgtggctcatacagaaagaaaatattgaggacagcctgctgcgcagcaatatcgcctatgcgcgcaaactggcggacaccaccgacggctacttttccacagcgcagcgcgaactggcctacagcgcacagcaaatcaaaacgctgcgcgatgaggataatctgcatcgcgaagcggaacggttacgcctgcaatccggattttttaactcggtggtgatcgtcacctcccaggcggtggtggctgccgcctcgcctgaaagtctggggctggtcgggcaaaagctcacctctgacgccaccaggcgcgccatcgcccttaaacaaccctttatttccagtccgtttatgtcagctgccggaaattatgtggtgtttatctcccagccgctttatgccgctgacggacattatctcggctttgtcggcggctctatctatctgaaaaagccgagtatgctgagcaatattatcagccagcatttttatgaagatgattctcaggtgagtattgtcagtaacgatggcaaagttatttataaccacgatccgtccctcgtcggtggccatatcgcggttaatcctgatcttaaagataaattaatccacgaacagagcggtaaatatttactgactcatcagggacaggaatatctgctcggctatgccagcctgaaggcgaccggctggaatgtttttatttacggtacctcagataatgtgcagcgtattctggcgctgacggcggaaaacgccacctggatcctgctgacgctgatcagtctgatgatcacgctggtggcctggctctcctcgcgtatctccgcgccgctggaaaaactggcggaactgacgcgctcagaggacagcacccgcacgctgaaagcgctgccggggatccaggcctggtatgcggaggcggcgaatctgcgggaagcggtgtatcaccacgtgctgatgatggtcaaccgggtcagcgcgctgaacgacgaggcgatgaccgacccgctcactggcctgtataaccgtcggggtttcagagagatgacccgccgctaccggcacagcgatcaccactgcctgctggcgctggatatcgatcactttaaggtgatcaacgacgagcacggccatgacgccggggatgcggtgctgataagcctggcggtattgctgaaagccgtctgccgcgagagcgacattattaatcgcttcggcggtgaggagtttgtgatcttcctgccggacacctcgttgagcgaggccatcgcgctggcggagcgtatccgtaaaacggtggaaaacaccgatttcccgtacacgcacaagatgcggctttgcggcggcgtggtcagtttgcaggatgaaggtaacgatatggaagcggcgctgcggcgggcggatgtggcgctttataatgccaaagccagcggccgcaaccgcgtgatgttcagcaaaggcgatgagatttaccctcaccaggcgggataacgggctggcaagccagcccgcgtctgtcagtgctgcaaaatatacatcgtgcgggtgtaagccacgtcttccggattgttaatcggatagcctttcagccagggtttgatcagtcgtccgttactgtactggtagataggcgcaatcggcgctttttcggcaatgattttttccgcttcgttataatcggcattacgcgcttccgcagtggtttcctgcgcggcctgattcagtactttatcgtaagccggatcgttaaagcgcgaaatattgccgctatggctggaagccagcagcgacaggaaagttgacggctcgttgtaatcccccacccatgacgcgcggatcacatcaaaattgccggtgttgcggctgtcgatgtaggttttccactcctggttttgcagcttcacatccacgcccagatttttcttccacatcgacgccaccgcaatggcgattttctggtgcgtttccgaggtgttatacagcaaggtcagatccagcgggcgctgcgggccgtaacctgccgcctgcaacagggttttcgcctgcgcgttccgctcttcctggctcatggaagcaaaaggcgatggcgaagctttaaacccggccgtcacgtccggcgtgaaatgccacgcgggtttctcgccggtgcccagcactttgtccgccatcagctggcggtcgatggtcaggcttaacgccagacgcacacgcggatcggcggtcgggcctttctgggtgttaaaggcgtaataataggtgcccagctgcggcggcgtgtagacctggcccggaatgtctttcatcagcttctgatagaggtttttcgggaaggattcggtgatatcaatatcgtccgccagatagcgtttggtggcggcgctctcctggttgatcggcacaaaagtgacctgctggatcaccgtacgggcattgtcccagtaattgacgttcggcaccgccaccagtttttcgttcaccacgcgatcttttaatacataagcgccgttaccgatgagcttgccgggcttcgtccactccgcgccctgctccacattcgctttctgtaccggataaaacgcgaagctggcggtcagattggcaaaccagggcagcggtttatcaagctgaacgcgcagcgtgtgggggtcaacggcagtgacgccgagcttgtccggcgtggctttgccgtcaatgatgttttgcgcattgctgacgcccgccagcgccgcaaaccaggcgaatggcgaagtggttttcggatcgaccagccgctgccagctgtagacaaaatcctgcgcggtcaccggcgtgccgtccgaccattttgcatcgtcgcgcagagtaaaggtccagacgcggttatcgttgctctgccatttggtggcgacgccgggcaccagctcgcccttctcattctgattcaccagcccttcgaacagatcgcggatcacctggatttccggcaggccaacggctttagccggatccagtgatgcaggctcgtctttaatgtggcgcaccagcacctgctttttcgccagcactgcgcccgctggcacctcggcggcaacagaaagcgacgaaaagctgcacatcaacagcgcacaacaggttagcgaaacggaatgtttcatgagatcccctcaaaagtaggtgccggccggcgaaagatgaggtaattatttgttttaacaactgggaaagcaaacatatcccttcagaaaataacgatttgaaaaggatcgtgttttgcttaacacttttaaccatcacccgacagagtaaggatgtctatgtccgtttcccttccgcgcgccgaacgaggggcttttcccccgctgacggaacattatggcatctccgggcttggggcgccgctgatctggtttcccgcgccgcaggcctcgtcggacagcgggctgatcattgccggtacccatggcgatgaaaatgccgccgtggttacgctgtcatgcgcgctgcggacgttaagcccgcagtttcgtcaccatcatgtggtgctggcggtgaacccggacggctgccagctcggtttacgcgccaatgcgaacggcgtcgatctgaaccgcaactttccggcggccaactggcgggccggggacacggtgtatcgctggaacagcgccgccgaggcgcgggatgtggtattacagaccggcacgacgcccggctccgaaccggaaacgcaggcgctgtgccagttgatccaccgtattcatccggcatgggtggtgacctttcacgatccgctggcctgtattgaagatcccgcgcaaagcgagctgggggcgtggctggcgcaggcgttcgccctgccgcacgtcaccagcgtcggctatgaaacgcccggctcttttggcagctggtgcgccgacattggcctgaactgcatcaccgccgagtttccgcccatctcaaacgatgaggcgagcgaaatctatttgcaggcgatgatggatctgctgcgctggacgcctcagaggtgaagctgaccggtggagaagcgcagccccggctccacgtccaccgccagccaggtcgggccatccagatcggcgaaacgcacttttcccgccagcggcagcgccgcgctgatggcccgcgaggtgcagagcatacagccgagcatcaatcccagcccctgcgctgaagcggcgtccgccagcgccagcgcctcggtcaggccgccggttttatccagcttgatgttgatcatctcatagcggccctgcaaattttgcaggcagctgcgcgtgtggcagctttcatcggcgcagatgggcagcggatggataaaattcgccagcatggcgtcatcgctggcgggcagcggctgctccagcatcgctacgcccagatctgccagcaactggcagcgtgccgccagcccttcgctgtgccaggactcattggcatcgacaatcagggtggcgtcgggcaccgccgagcgtaccgccaccagccgttcgctgataaacgtatcatcgagtttcaccttcagcagacgcgcgcccttttcccacagcgccgccgcgctggccgccatctgctgcggcgtgccgatcaccaccgtttgcgcggtggtcaccgtgcccgtcagcggcacgtgcaggagatccatcagattctgtcctgcgcgacgcgcctccagatcccacagggcgctgtccacggcattacgcgccgcgccaggcggcaggagcgattgcagatcctgacgcgtcagcccgccttccagctgcggcactacggtcatgatttgcgcgatcaccgaggcatcgctttcaccatagcgcggatagggcgtacattcgcccactgcccgcacaccattctcttccagttcaaccaccaccacccgcgcttcattgcggctgccacgcgagatcacaaagggcgtatgcagcggccagttctcttcataaaccttgacggttctcattccgttactcctcaggcgcgatgtggacagtatagtgatgaaaataggtttgccgagttcctgaataatcccgtaaactagccgcgacgttaactatatgtaaacaggaagctatttatgtcacaactcgttcattttcagggcaatccggtcgctgttgccggcaccattccccaggctggcagcaaagcgccggcattcacgctggtggcaaaagatttaacggatgtcacgctgggccagttcgcgggcaaacgcaaagtactgaatgtcttcccgagcattgataccggcgtctgcgccgcgtccgtgcgcaaattcaaccagctcgccaccgagatgaaagacaccgttgtgctgtgcatctctgcggatctgccgttcgcccattcccgtttttgcggcgcggaaggtctgagcaacgtcatcaccctttccaccctgcgtaatgcagagttcctggaaaactacggtatcggcatcaccgaaggcgcactgaaaggcctggcggcccgtgcagttgtggtgatcgacgagaacgacaccgtgctgttcagcgagctggtgaacgaaatcaccaacgaaccgaattacgacgccgcgctggctgcgctgaaagcgtaatttcaggttagttcgcccggcggcgcaggcttgccgggcttatccattacacccggcactcatttcccgcttactcctcgcccttcttctggcttaagccgtattcccgcagcttattggcaatcgccgtatgggatacgccaaggcgtttcgccagtttgcgcgtgctcggatagctccggtagagctgcgtcagcactgaacgctcaaagcggctggtgatgtcatccagcgagccttccatcgcctcttcgcccacggccaggctaccggcgtcataatcgggcagcaaaatatcctgcgaccgtaattcatagccttccagttgcgtcagcgcgcgataaatggcgtttttaagctgacgaacgttgcccggccagccatagcgcatcagcactgtattcagctcagcggacagtttcgggcgcggcacgccctgctcatcggcaaaacgcgccacgaaaagttcggtcaacggcatgatatcctgcggacgatcgcgcagcggcggcagattgagcgtcagcacgttcagacgataatagagatcttcccggaacaaccctttctgcaccagttccacgaggtttttctgcgtcgcgcaaattacccgcacatccacatgcacctcatgatcttccccgacgcggcggaacgtgccgtcgttaaggaagcgcagcagtttgacctgcatgcgcggcgacatttcgccgatctcatccagcagcaccgagccgccgtttgcctgctcgaagaagccttttttgccttccggcgcgtgaccaaagagttcgctttccaccgcatcctccggaatggaggcgcagtttaaggccagataaggcttagcagcgcgcgggctggcaagatgacaggcgtgcgccagcaaatctttgccggtaccggtatcgccgacgatcagcagcggcgcggtaagcatcgccagtttgcgggcctgatccaccacctgacgcattttcgggctgacggcgacgatctggctgaaggcgctgacgtcctgggtggtcatattttgcagctggcggcccatacggatggtcgaacgcagcatcaccaccgcgccggtcagcaccggcgtccccgcttcgccttccagatgcaccggggtgatttccatcaggaaattttgcccgttgatcaccacatgttcgttgtgggacgcctgcggattcccctccagccagcgctggaagttaaaaccagggataagttgcatcgcggtatggttgcgcagctttgcctgctcaagcgcgaacagctggcaactggccgggttcgccagctccactttgcatttcatatcgaccgagagcactggctccggcagcgcttccagtaaggcgctgagcgccagatgttcacgctccgacggcatccacagtacggtgcgcacgtcggtgacgcccgcgatacggcggatctccgccatcaggctgctgaaggtggtgaactccagttcagcaaaattaaggtagatgcgaccgatagggtcgatttcgataccgcgcagatctatgccgcgtaataccagcagatcgagcagctcgcgggccagaccaaggcggtcttcacaaaacacttccagacgcatgagggcttcaccctgaatagttaacgtatgatgaaatgataagccacttattggctggcaggaagctgtctgtcaacaaatattgacagcctgacggaaaaacaggcactcaggcgtaaagttataggttcagggcatgttctgcgtcagctcacgggccagcgcgaggaaggccgccagccccgccgagggatgacgccgtccaggataatagagacacaatccgggaaacggcggcgtccactcctccagcaggcgcaccagccgtccggcgcgcaggtcatcaataatgtcctgttccagaaagaagccgatgccgacatcctgcaataccgccgcccgcaccagcgaggcctcgtccagcgttagcggcccgcgcacctccggcagcacgacctcgccctgcttttccagatgccagcgatacagagatccatcgggtaaacgtacccgaatacaggagtgcgccagtaaatccatgggtttgaggggacggggatgtcgggccagataggcgggggacgccaccaccgcaaagcgctgcggttgccccagcgagacggcaatcatatcagcggggatcaaatcggcgacgcgcacgccaatatcaaagccttccgccacaatgtcgacgagtttgccttcggtgaccagatccacatgcatctccggaaagcggcgcaaaaactccagcacaatgttgttgagcagcgtacgggcggcaaagggcggcgcgttaatgcgcaacacgcccgtcggggtttcccgccgggagcgcaccgcgtccagcgcgtcatgcacgccctgcaatgacggtcccatgcgctcaataaaaagatgcccggcatcggtcagcgccacgctgcgggtagtgcgattaaacagccgcacaccaagagtggcctcgaattttgccaccatatgactcagtgccgtggtggatacgcccagttcaatagccgccgcccggaatgttccccggcgggcaatagccatcactgcgtccagatctgacagtgcaatacgtgacattatcccgctcctttcatcacggcatcccggtttgtcccgattgtttaaattataaagccttcttaaagtgaacggacacactacaggagaaaaacgtatgcatgattttctggcactgactgacaaacgcgtcctgatcacctctggcactaaaggcgcaggcgcggctaccgtagcgctgtttcgcgagctgggcgcgcaggtgatgacctgcgcccgccatcatccggacgaccaggcgagcgatctgtttgtcgccgccgatctcaccaccgaagcgggctgcgcccggctggcagaggcggtgcagcaacggctggggggcgtggacgtcatcgtgcatatgctgggcggctcctcatcgccagccggagggtttgcagcgcttgacgacgcgcaatggcagcgggagctggcgctcaatcttttccctgccgtccggctggatcgtctgctggcgccgggcatggtgagtcagggcagcggtgtgatcgttcatgtttcgtctattcagcgcacattgccattaccggaggccaccaccgcttacgccgctgcgaaagctgcgctgtctgtctacagcaaaagtttgtccaaagagatatcgccgaaaggcgtgcgggtagtgagcgtgtcgccggggtggattgaaaccgaagctgctgtacgtctggcggaacggctggcaatgcaggcaggaactgattatgacggcggtaaaaaaatcattatggatgcgctggggggtattccgctgggacgtccgacgcggccgggggaagtcgcgagcctgattgcgttcctggcctccgatcgcgccgccgccattaacggcaccgagtacgttattgacggcggcaccatcccgacggcgtaaatcaggccgccgttttccccttttgcagcgtctctttcatctggctgattaactggcggcggaaatcgccaaggcgcggtttgtcatcgtcgatccacggtagcgggcggcacagttccatcgctttaatacccagacgcgccgtgagtaaccccgcgccgatcccctgcgcggcacgggcggaaagccgcgccgccagatcctgcgacacccagtccatgccaacttcccgcaccagttcactggccccggcgaaggcgatattcaacagcaccaggcggaacaggcgcagacggctgtaataccccagctcaatgccgtacagccgtgcgatgcggttgatcagccggatattgcgccaggcgataaacgccatgtccaccagcgccagcgggctgacggcgatcatcagggtggattccgccgccgagcggctgatctcccgccgcgcctgggcatcaagcaccggctgcaccagatgggcatacagggtgacgatctcgcgatcgctctgggtttcatgaatggcggcgtaccagcgctggagcgccggatgggatttatcaatgcccgcctgctgcgccagtttttcgcagaaagcccggcccctgcccgcgccgtggctgtgcagcagatcgcgcgcttcatcccgctcctgcgcccgctcgcgcagccgccacagccgatgccattcagtggccaccgatccgacgccggcaccgataatcagcgcgccggcggcacagccgccgagcgacacccagtcctgcgtctgccaggcatgcattgtccactgtacgccctggccgaccacgcttgcgccgaacagcgccagaccggccattaccattttacgccacaggctgcggcgcggacgcagcgccgcgtcgatcaccgcttccggtttgtcatccacgagtagcgtgtcatcggtgacggctggggcgaaattatcggcttccggcccggcaaacgtctgcgcggttttgaacgtctcagcctgctctgattccagcggaccggcaaagtcgatgcgcggttttaaaggttcattcatcgcagtttatctcctattaaaaactccagcgccgcatccagacggatatgcggcagcggtttgtccacatccatgacctgcgggcgaaacgcctcaaactgaaagccctgcttttcccagaacgcctgtcccggcagccgcgccgggacttcgccgggatagaccgtcagcggcgcgccatcgcttaaccggttgccgcgcagggcgggaattttctcgcccttgacgtcaatcagcccgctttgcgtcgcctgtacggcggcaagccccatgcagtccatgctgatgccttcaaaggcggcgttttgccaggcgtcctggatcagctgctgcaacagcgacaccatattggcgtgctggtcgagggtcacatggtcggctttggtggcggcgaacaggagtttgtcgatcaccggcgagaacagacggcggaacagcgtgcgctgtccgtaatgaaaactctgcattaactgcgtgagcgcgaggcgcatatcgttaaacgcctgcggcccgctgttcagcggttgcagacagtcgaccagcacgatttgccggtcaaagcgcaggaagtaatttttataaaatcctttaaccactttttcgcagtagtagttgaagcgctcgcgcagcataccggcgttggtgcttttatccgcctgcgccagtttcgcttcgccgctggcgtccacgtccggccacggaaagaattgcagcgcgggggcacccgccatatcgccgggcagcacaaaacgtcccggctgaataaaatgcagcccttgctgtttgcactggtgcagatagtcggtccaggcggcggcgatttccgccaggcggttttcatcggcgggcgccagcggatcgagaccgtcgcacagttgccgccagcgggcagaccactcttttctgtgaccctgtaacaaaccggtcatttgtcgcgaccaggtcaggtaatcctgcgccagcatcggcagatccagcagccattcccccggataatcgacgatttccagatacagcgtggacgtgtctttaaaatggcgcagcagggagtcattagaacgatagcgcagcgcaaggcgcatctcactgacaccgcgcgtcggcgtcggccagtccggcggcgtgccgtaaagctgggagatgccttcatcataggtgaagcgctgaatgccaaaatcccgctgcggcacccgtttcacgccaagcagccgttcttcacgcacggcgctgagcagcggcagacgcgcgccgttgtgaacatttaacagctgattgaccatagcggttataaaagcggttttcccgctgcggctaagaccggtaaccgccagccgcaaatggcgatccacgccgcgatttaccagagcactgaattctttttttattctgttcataagcatccaggttgcatgagggatccagaacgtacagatcagaaggtttcactacatgagaggcagtatgccattaaaaacgggggaattgagaggtcgggatgaaaggcttcaccccgacaaaagccgtcaacgaacgggtttaacaggtttgttgttaaaacgggcggaaactttgcgcgccatgcgtgacagcaaaggttccagcaccagcgccaacaacatttttgccggacgacgggcaacggatttcaccgcccaccctgccacaccggccggaccgtaacgcagcgctgtcaacagcaccagttttccggcgattttcagaccgggtttcattttttgtcctgcctgttgccaattacgcgccatcagaaacctcattcgttaaacagttaattatagctggcgaaaacggctgcgcagggagaaggtgtcagaggtgacatagcgctccatgtcgcgcagacgcttctcgcccgcggccagctcggcatcgaccgcatccagcaattcgccgctggtgggcaccgcctcgccgtcggccagattatccggcatcgggtcaagcatgaatgtcatgatgatgtaggccaccaccacaaagaaaaacagcccgaaaaacatcgccagcacggtgatcaggcgaaccagtttgaccggcacgtcgaagtagtgcgccacgccggcgcagacccctttcaccatgccctgctgcggcatacgccagagctttttattcagatctaatccagccatcagcgatccctccagttcggatgttcagcatccaggatagattccagcgcctggatacgttcgcgcatacgttgtgcgtcggcattcaactgcgccaggcgttgctgttcgctttgcgacagcgcgttgcgggacgaccggttgttgtaatgcagccacagccagatgggcagcacgaacaaaataaacagcgtcaggggaatagccagaaacagcgcgctcatgtgtactccttacaggtgaggtgaaggcgcgctcaggcgccttgtcattattattgaagatcctgcttcattttcgctttcagctgttccagctgctcgctgatggcgtcgtcggctttcagttccgcaaactcctgatccagcgatttctgcttaccgaaagcatggctttccgcctcggcttccatatggtcgatacgacgctcgaaagattcaaaacgcgccatcgcttcgtcgattttgccgctgtcgagctgacggcgcacatcacgggacgagctggccgcctggtggcgcagcgtcagcgcctgctggcgggcgcgggtttcgctgagtttgttctcaagctcgccgatctctttcttcatgcgcaccagcgtatcatccaccagcgtcacttcatgttcgagggtggcgatcacgtcagttaatttctgtttttcgatcagcgccgcacgggccagatcgtctttttctttacgcagcgccagttccgctttttcctgccactctgcctgctgggcggtggcctgttcaatacggcgtgacagctgtttcttttcagccagcgcacgggctgaggtggagcgtacttcgaccagcgtgtcctccatttcctggatcatcagacgcactaatttttgcgggtcttcagccttctcaagcagtgagttgatgttggcgttcacgatgtcggcgaaacgagaaaaaatacccataattcagtcctcatattttctgttatcgggccaggccctgctgattgagtaatacaattcccgtgccagctttttatgttaatgataataaaggaaatgattaattttaccgcagcggtgaaatgggttagagtggtgaaatacaccaaccagtggcgaatttcatcatggcggaatacagagataatcttcttggcgaagcaaacagctttatcgatgtgctggagcaggtttcccgtctggcgccgctgaataaaccggtgttgatcatcggcgagcgcggtaccggcaaggagctgatagccaaccgcctgcactttctctcttcccgctgggacgggccctttatttcgcttaactgcgccgcgctgaatgaaaatctgctggataccgagctgttcggccatgaagccggggcttttaccggcgcgcagaaacgccatccgggacgctttgaacgcgccgacggcggcacgctgtttctcgatgagctggcgaccgcgccaatgctggtgcaggaaaaactgctgcgcgtgatcgaatacggcgagctggagcgcgtcggcggcagccgtccgttacaggtgaacgtgcggctggtgtgtgccactaacgccgatttaccgcagatggtggagaatgaaaccttccgcgccgacctgctcgaccggctggcctttgatgtggtgcagttgccgccgctgcgcgaacggcaaagcgacatcatgctgatggccgatcactttgccattcagatgtgccgcgagctggggctgccgctgtttccgggctttaccgaacgcgcccgcgacacgctgctgggctaccgctggccggggaatattcgtgaactgaaaaacgttgtcgagcgctcggtgtaccgccacggcagcagcgatacgccccttgacgagataattatcgatccctttcaccgcgccccgtcgccggtcaggtcaacgacggatagcgaagcgctgcccgccctgccgctggatctgcggcagtttcagcaatcccaggagaaagcgctgctggaaagcagcctgcaacaggcgaaatttaatcagaaacgcgcggcggaactgctgggactgacttaccaccagctgcgcgcgctgctgaaaaagcacgcgctgtaagggctattttttattcatcatcgctttcagatcggcgaaaggattatatttcgcctcgccgacatctttctgcgcatcttccccggcgatcaccgttgagccgtactgatccgcctcggtgtatttcgagtgctcatgatcgtggcaatacaggcacaacagctcccagttgctgccgtccggcgggttattggtatgatcgtgatcgatatggtgcaccgttaactcacgcaagtttgagtagacaaattcgcgtgagcaccggccgcacacccacggatagatttttaacgcacgttcccggtaatccacttccaggcgggcatagttcttcggaataatagccatcgcggcaatccttttggtcacagagatagaccaccataatatcaggcgggggcgtgtttgcggcaaatatcccgcacaaactcccgcagccagcgatgaccggcatcggcttccatacggggatgccacatctgggaaatggtgatcgggcgggtttctaccggcagcgtaaaggtatgcagccttgccgcctgctgatggatcagaaaagaggccggcaccagcgccaccagatcggacgcctgggccaccgccaccgccgccggaaagccgggcacgacggctgcgatatggcgttccaggccaagcgccgccagcgcttcatccaccggcccgcccgccttgccgcgccgtgacgccaccacgtggccgtgggcgatatactcttccacgctgacttccggcatcgcggccagcggatgcccgtgtctgaccacgccgacaaaacgatcgcggaacagcgcctgaatgcggatctccggtcccatatcaccaagcacgccgatttccagatcaatctgcccttcccgcagcggcgcggcgtttttcgcaagcttaggcgcaaagcacaatcgtacctgcggggcctgttgtgcggcggcgacaatcagttttggcccgaacgcctccacaaagccgtcgttagcccgcagggtaaaggtgcggcggtaagtggttaaatcgagcttctccgccgccggacgcagcacggccagcgcatcaaacaccgtctgccgggtgcgctcgcgcaccgcaccggcatagggcgtcagcaccatatggcgtccggcgcgcaccagcagcggatcgccggtcaccgtccgcaggcggctgagggtgcggctcatcgcagattcactgaggccaagccgccgggccgcccccgccacgctggcttccgccagcagcgcatcaagggcgatcagcaagttcagatccggttggttcatgtcagcctttccttatttccccgctcatcaatcgcactataacaggcgtccggtgcaggttataactgcaattgctgcgtcttccgccgggtgtggtacgccggtaggctgtcagcagatgacaatgcgcttaacaaggtgaatatgatggaactcttttctgacaaagcgggcgacgaaggcttacccggacgcccgcgtgcgctggcaatggcggcggtgatgacctccaccaccatggcggtgtttgacggatcaatggtgaatatcgccctgccgcagatcgccgctgcgcttaaggttgctgccccggcggcggtgtgggtggcgaacggttatttgctggcggcggcgatgacgctggcgattttcgccgcgctggcgaaccgctttggttttcgtctgctgtttgcctgtgggcttggcctgtttacggtggcctcgctgggatgcaccctgtcctcctccctgacggcgctgaccagctggcgtattgtgcaggggatcggcggggccgcgaccctgagcatcgcgcctgcgatcctgcgctccatctttcccgaccggctgctcggccgcattcttgggctgcatgcgttgctcatcgccgccagcaccgcgctggccccgctgcttggcggcacgctgctggcgacgctgagctggcgctggctgtttgccgttaatctgccgctcggcgtgatggccctggcgttaaccctgcgaacgatccccggcaaaaaagcgccgcagcgcgaaccctttgacgccgcgggcgcgctgctgtcggcgataatgctcggcgcgctgatcatgaccgccagcacctttgcccggccggagaaagacgacggtatgctgataaccgccctggcatacggactgctcgccattgtcgcaggcgtgctgttcgtctggcggcaacagcgggcgccaaaaccgctgctgccgctggcgatgttctcatcaatgcgtttttctctggcggcgctcacctcgctggcgtcttttgtcagccaggggatgacctttgtcgcgctgccgtttttattccagagcctctatggttacagcgcctttgaatcggcgctgctgtttaccccctggccgctgggcatcattctggccgcgccgcacgccggacgttttgcagatcgccattcccccgcgctgatctccaccgtcgggctgtgcgtgtttgccgcaggactggtcctgctggcgctgttgtcggatcacgccccgatgtgggacatcggcgtgcgcagttttgtgtgtggcctgggatttggctgttttcagagcccgaacaaccgggaaatgctggcgaacgtctcgcgggagaacagcggctatgcctcaggcgtactggcgatagtgcgtaccttcggacaatgtatgggcgcggcgctggtcggcgtgctgctgtcgctgtccggtgatgcgctggcggtacacctgagtttgtgggtggcggcgatggcgacggcagtggcgctgctgttcagcgtcagccgcctgcgaaagtgacgcgtttgatgacttttccgccagttatccgcagacatttttacgcggcggcgttaagtgcgatacactttgcagatcagtcttaaaaccaaagaaattatgcgcctaattttatcgtctctgctgatgagcgccggtctgttaagcggactggcgcagggcgagcctgtgccgcccgccgcccgcgatattcgtgacagcggctttgtgtactgcgtgaacggtcaggtgaacacctttaacccgcaaaaagccagcagcggcctgattgtcgataccctcgccgcccagctgtacgatcgcctgctggatgtcgatccttacacctaccggctggtgccggagctggcggaaagctgggaagtgctggacaacggcgcaacttaccgttttcgtctgcgcaacgacgtgtccttccagaccaccgcgtggtttaaacccacccgtaagctgaatgcggacgatgtgacctttaccttccagcgtattttcgaccgcaaacatccgtggcataacattaacggcagcagcttcccctatttcgacagcctgcaattcgccgataccgtggagagcgtgcgcaaaatcgacaaccgcaccgtggagtttcgtctgcgccagccggatgcgtctttcctctggcatctggcgacccattacgcgtcggtgatgtcggcagagtacgccgcggatctggcgaagaacgaccatcaggagctactggatcgtcagccggtcggcaccggcccgttccagctcggcgattaccgcgccgggcagtatattcggttacaacgtcacgaacgattctggcgtggcacgccgctgatgccgcaggtggtggtcgatctcggctccggcggcaccggacggttatccaaactgctgaccggcgaatgcgatgtgctggcctggcccgccgccagccagcttaccagcctgcgcgacgatccgcgtctgcgcctgacgctgcgccccggcatgaacatcgcttatctggcgtttaataccgacaagccgccgctgaataatccgcaggtgcgccacgcgctggcgctggcgattaataatcagcggctgatgcagtctatttactatggcaccgccgaaaccgctgcgtcgattttgccccgcgcctcctgggcctatgataacgaagcgaaaattaccgaatacaatcccgatgaagcgcgcgcacggcttaaagcgctgggactggaaaacatgacccttgagctgtgggtgccgaccagctcccaggcctggaaccccagccccctgaaaacggcggagctgatccaggcggatatggcgcaggtgggcgtaacggtgaagatcgtgccggtagagggccgttttcaggaagcgcgcctgatggacatgaatcatgatctcaccctttccggctggtcaacggacagtaacgatccggacagtttcttccgtccgctgttgagctgcgcggcgatcgaatcgcagaccaacttcgcccactggtgccaccgtgaattcgataacgtgttgcaaaaagccctgcgttcgcagcagctggcgtcgcgcattgaggcttacgacgaggcgcaaaccattctcgcccgtgaactgccggtgctgccgctggcctcatcgctgcgtttgcaggcctatcggtacgatatgaaaggcctggtgttgagtccctttggtaacgcctcttttgcgggcgtgtcgcgtgaaaaagagcattctgaggataaacagccatgatcatttttacgctgcggcgcatacttctgctgatggtcacgctgtttttgctgacctttgtcgccttcagcctgagctattttacgccccatgcgccgctgtcaggggcgtcgctgtggaacgcctgggcgttctggtttaacggcgtgctgcactgggacttcggcgtctccagcattaacggccagctgatttccgaacagttaaaagatgtgtttccggccaccatggagctgtgcattctggccttcacctttgcgctggtgctcggcattcccgtcggtatgctggcgggaatttcgcgcaataaatggcaggataaatttatcagcgcgctggcgctgctcggcttttccattccggtgttctggctggcgctgctgctgacgctgtttttctcgctcacccttggctggctgccggtgtccggacgctttgatctgctgtatgaagtgaaaaccgtgaccggctttgccattatcgacgcctggctgtcggattcgccctggcgcgatgagatgatcgtgagcgccctgcgccatatggtgctgccagtgctgacgctggcggtggctccgaccacagaagtgatccgcctgatgcgcatcagcaccatcgatgtgtttgagcagaattatattaaagccgcggccacgcgcggcgtgtcgcggctgacgattttgcgccgccatgtgctgcacaacgccctgccgccagtgatcccgcgtctcggtttgcagttctccactatgctgacgctggcgatgatcactgaaatggtgttcagctggccggggctgggacgctggatgatcaacgctatccgccagcaggattacgcggcgatttccgcaggcgtaatggtgattggcgcactggtgatcatcgtgaacgtgatttctgacattgtgggcgcgctggcgaaccccttgaaacataaggaatggtatgccctccgataacgtctacagcgaaaagcgcgcccccggcgcgctgcgcaacgtctggcgcaaattttacagcgataccgccgcgatggtcggtctgtacggctgcgcaggtctgatgctgctgtgcctgtttggcgcctggtttgcgccttatggcatcgatcagcagttcctgggctatcagctgctgccgccgtcctggtcgcgctacggtgaagtgtcgtttttccttggcactgacgatctggggcgtgatgtattgagccgtctgctcagcggcgcggccccgacggtgggcggcgcgtttctggtgaccctcgcggcaaccctgtgcgggctggtgctgggcgtggtcgccggagcgacgcacgggctacgctcggcggtactgaatcatattctggatacgctgctgtcgatcccttcgctgctgctggcaatcattgtggtagccttttccggcccacacctcagccacgcgatgtttgccgtctggctggcgctgctaccgcgcatggtgcgctcggtctacagtctggtgcatgatgagctggaaaaagagtatgtggttgccgcccgtctggatggcgcgacgacaatgaacattttgtggttcgccgtgctgccgaatatgaccgccgggctggtgacggaaattacccgcgccctgtcgatggccattctggatattgcggcgctgggctttctcgatctgggggcgcaactgccctccccggaatggggcgcaatgcttggcgacgcgctggagctgatttatgtcgcgccctggacagtaatgctgccgggcgtggcgatcatgctgagcgtcttgctggttaacctgctgggcgacgggatccgtcgtgcggtcaatgcgggggtggaataatgccgttactcgatattcgtaatctgaccattgaggtcaaaattggcgagcagtgggttcgcgccgttgaccgggtgagcattacgctggccgaaggggagatccgcgggctggtgggcgaatccggctccggcaaaagcctggtcgcgaaggcgatttgcggcgtcaacaaagataactggcgcgtcaccgccgaccgtatgcgttttgacgacatcgatctgatgcgcctctccgtgcgcgagcggcgtaagctgctcggccataacgtgtcgatgatcttccaggagccgcagtcctgtctcgatccttccgagcgcgtcggcaaacagctaatgcagaatatctccggctggacctataaaggccgctggtggcagcgtttcggctggcgcaaacgccgcgccatcgagctgctgcaccgggtgggcattaaagatcataaagacgcgatgcgcagcttcccctacgagctgaccgaaggcgagtgccagaaagtgatgatcgccattgcgctggccaaccagccgcgtctgctgatcgccgatgagccgaccaacgccatggagccaaccacccaggcgcagattttccgcctgctgtcccggcttaatcagaacaataacaccaccattttgttgatcagccatgacctgcaaatgctgagccagtgggccgatcgcattaacgtgatgtactgcggccagacggtggaaaccgcgccgagcgaggatttgatcagcacgccgcatcatccttatacccaggcgctgatccgcgccattccggattttggcagcccgatgccgcacaaaagccgtctaaacaccctgccgggagccattccgttgcttgaacagttaccgataggctgccgtctggggccgcgctgcccctatgcgcagcgcaaatgtatcgatacgccgcgtctcgcggggcctaaaaaccatcttttcgcctgtcattttcccctgaatatggagcgcgaataagatgccggaaacgctgcttgaagtgcataacctgagcaaaaccttccgctaccgcaccggctggttccgccgtcagacgctggaggcggtaaaaccgctcagctttaccctgcgcgagaaacagacgctggcgattattggcgagaacggctccggcaaatcgacgctggcaaaaatgctggtgggcatgaccgagccgaccaccggcgagctgcgcatcaacgatcatcctctgcactatggcgattactcgttccgcagccagcgcatccgtatgatttttcaggatccctccacctcgctgaatccgcgttcgcgcgtttcgcagatcctcgattttccgctgcggctgaacaccgatctgacgccggaagcgcgccgcaagcgcatcgccgaaacgctgcgcatggtcgggctgctgccggatcacgtcagctactatccccacatgctggcccccggccagaaacagcgtctggggctggcgcgcgcgctgatcctgcgtccgcaggtcattattgccgatgaagcgctggcctcgctggacatgtcgatgcgctcgcagctgattaatctgatgctggagttacaggaaaaacagggtatttcatatatttatgttacccagcatatcggcatgatgaagcatatcagcgaccaggtgctggtaatgcaccagggtgaagtggtggagcgcggcagcaccgccgacgtgctggcgtcgccgctgcatgagctgacccggcgcttgattgccgggcattttggcgaagccttaaccgctgacgcctggcgtaaagatgtctgacctgtggcgcagcagcgtaccgcgggaaaaataacgtgacagatcccattgtcagtgggatataatttaccgttagtgttgaataattgtgacttaataatcgtaacctgatgattattaagtcataaaatgagcagaaactataaggattcaaaactatgggttttcttaccggtaaacgcattctgattactggcgttgccagtaaactctccattgcctggggtatcgcacaggcaatgcatcgcgaaggcgcagagctggcctttacctaccagaacgacaagctgaaaagccgtgtcgaagggttcgccgctgacctgggctccagcctggtgcttccgtgcgacgtagcggaagatgagagcatcgaagcgctgtttaccgaactggctaaaagctggccgaaattcgacggtttcgtacactccatcggtttcgcaccgggcgatcagctggatggcgactacgtgaacgccgtaacccgtgatggttttaaaatcgcgcacgacatcagctcctacagctttgtggccatggcaaaagcctgtcgcgcaatgctgaacccgaactccgccctgctgaccctctcctacctgggcgcagagcgcgctatcccgaactacaacgtgatgggtctggcaaaagcgtctctggaagcgaacgtgcgttacatggcgaacgctatgggcccggaaggcgtgcgcgtaaacgccatctctgccggtccgatccgcaccctggcggcgtctggtattaaagacttccgtaaaatgctggctcattgcgaagcggtcaccccgatccgtcgcactgtgaccatcgaagatgtgggcaacagcgccgctttcctgtgctctgacctctccggcggtatttcgggtgaagtggttcacgttgacggcggcttcagcatcgccgcgatgaacgagctggaactgaaataatccccctgacgccccttccgcccggagggggtgttttccccgttatgcctttctgatctttgttatcacccaacaatatttcatcctccttcccgcttacgccaggataatgctgcgaaaaagatccggcgcatcctgatgtcacgtctccggatcgtcactttcagatcaaggaacgctcatggaacaacgccgtttttccggcaaaggtcactggtatcatgaaacccagtcgagtaccggccagactcccgcgctaccattagttcccgaagccgccaccgttaacgaccgctttttgctggatttaccgctgacgaacgacatgcttgccgcctgtgactcctggctacgcccggcacgcaatctgtgcgcccgtctgtttccgcagcaggtagccgtgagccgcctgcgcacctttaccgcttacgaccgcctcagcacggcgctgaccgcagcccaggtgtatggcgtccagcggctgtgcaatcactatgccgcacgcctcgcgccgctcaatggcccggatccctcacgggaaagtaaccgccgtctggcgcaaatcacccagtacgcccggcagctcgccagctcgccggaggtgattgataaccgcgcccggcagcagcttgatgaggttggcctgacctgcgacgacattattttgatggatcagatcatcggctttatcggttttcaggcgcgcgtggtcgccgcgtttcaggcgatgcagggcatgccggtgcgctggctgccaggcatggaaatgcaggcctgggctgatgcagaacgctttagcgccggggctgacggctggtccgcggccttcagcggcgtagaactgcgccgcgccagcgcaagccagctggaagcccatgcgcaatggcagacgcagccggagctgcgcgtgctggcggcgtcgctggcccatgagcatgttgtgcttaatgaactcggcgcgatcctggaaagcggcttacgggctgaactccccccggcggtagtgcagctggtggcgcaactgaccgcgcgcattaacggcagcgtggactgttttgcggccagcgcgcaacgcgatgagacgctgcgcaccgcgttgcaggacggtgagcaggcgctgctggcatggagtcaggacgacgcacaaacgcgggcggttattgtcgccgtacaactgctgacccgggcggcggatcgctttagcgccgcgcagtttattccgcttactgagcagggttttaccacccatcaggcgttctcgctgctggcgtggagcgggttatgcggctggttgaaccgtctgaaaatcgcgctgggtgagcgccagtaacgcgaaagagcgcttgctgcgccccccgtattcgcgtaaaactgtcagccgctcttttggccacgaaaatacaaaattatgttccaggacaacccgctgcttgctcagctaaaacagcaattacattctaagacgcctcgcgcggaaggcgtcgtcaaagccacggaaaaaggctttggtttcctcgaagttgatgcgcagaaaagctatttcattccgccgccgcagatgaaaaaagtgatgcatggcgaccgtattatcgcggtgatccatagcgaaaaagaacgtgaatccgccgagccggaggaactggttgaacctttcctgtcgcgcttcgtcggtaaagtgcagaaaaaagacgatcgtctgtccatcgtccctgaccatcccctgctgaaagacgccatccagtgccgaccggcgcgcggtgtcgagcacaattttgccgatggcgactgggcggttgcagaaatgcgccgtcacccgctgaaaggcgatcgcggcttttatgcagaactgacccagtttattaccttcggcgacgatcatttcgtgccgtggtgggtgacccttgcccgtcacaatctggaaaaagaagcgccgaacggcgtcgctaccgaaatgctggacgagggccttgagcgtgtcgatctgaccgccctggatttcgtcaccattgacagcgccagcaccgaagatatggatgatgccctgtacgccgaagagctggcggatggccgcctgcaactgacggtggccattgccgatccgacagcgtggatagcccaggacagcaagctggacaacatcgctaaagttcgtgctttcactaactatctgccgggctttaacatcccgatgctgccgcgcgagctttctgacgatctctgttcactgcgtccgcagaccctgcgcccggcgctggcctgccgcatgaccatcagcgctgacggcactatcgaagacaatattgaattcttcgccgctaccatcgagtcgaaagccaagctggtgtacgacgagatctctgactggctggaaggcaaagatggctggacgccgccgacggatgccatcgccgcgcagatccgtctgctgcatcgtatctgccttgcccgcgctgaatggcgcaccacccatgcgctggtgtttaaagaccgtccggattaccgctttgtgctgggcgaaaaaggcgaagtgctggacatcgttgccgagccgcgccgcatcgctaaccgcattgttgaagagtcgatgattgccgccaacatctgtgccgcccgcgtgctgcgcgataagctcggtttcggcatctacaacgtacatttagggttcgatccggctaatggcgaagcgctggcggccctgctcagcacccacggtctgcatgtggatgccgaagaagtgctgacgctgaacggcttctgcaagctgcgtcgtgaactggacgcacagccgtctggtttcctcgacagccgcattcgccgcttccagtcttacgcggaaatcagcaccgagccaggcccgcactttggcctcggtcttgaggcctatgccacctggacgtcaccgatccgtaagtacggcgatatgatcaaccatcgtctgctgaaagcgatcatcaaaaatgaaaccatcgcccgtccgcaggacgataccacggtgcagatgaccgaacgccgtcgccttaaccgtatggcggagcgcgatgtcggcgactggctgtatgcccgtttcctgaaagacaaagccggaaccgatacgcgctttgccgcagagatcatcgacatcagccgtggcgggatgcgcgtccgtctggtggataatggcgcggtggcctttattcccgccccgttcatccatgcggtgcgcgacgaaatggtatgcagccaggaaagcggtaccgtgcagatcaaaggcgagacggtgtataaagtcactgatgtgattgatgtgaccatcgccgaggtgcgtatggaaacccgtagcgtgatcgcccgacctgtggcataaaagccgaacggtatataaaccggtctcgctgttctggcgagaccgttactctctcctgacgtctgccgcgctacgtcaaaattccggattttttcccccacatttggctaaaaacagccacacttagttatgcacttttacgcatgaaaagtcgttcagaacaagagtttagcaatagatatgcaatttgttagccacgctttattataagaatgcgaatggaaaacagtaagttcaacctgctcctgtggagagtcagtgtgaaaacttcaccgttataaggttctgttgcgctttgggtggaatgggagactgcatgaaagacgatgtggagcaaaatttgctgtttcgttaccttgggaccaccagccctttctggcgtctcaccgctgacagcaacgcacttcatcttgccgcgagtgaaaccgcagacatcagccaggtgtttgcgctgagcgatcatcaggcggatacgatccgtgaaatgacggtgattaccaccagtttgaccatgaccatttccatgtttggcgatgacgtgccgctgcatctggtgggccgcaagatatcgaaaaaagagtgggcgggtacggcgtcttcctggaatgatacttcctccgtagcccgtgatttggtgcaggggttgtcctttgcggaacaggtggtatccgaagccaattcggtcattgtgatccttgatcgacacggcaacatccagcgctttaaccggctatctgaagaatatacagggatgcgcgagcaggaagttatcgggcagaacgtttttaaattatttatgagccgcagcgaggcgctcgcctcaaagcgtaatatcagcgagtttttccgcaacggcagttcctatgaagtggagcgctggatcaagacgcgcaaaggccagcgactgtttttgtttcgcaataaatttgtgcacagcggcagcggcaaaaacgaaattttcctgatttgttccggcaccgacattaccgaagagcgccgggctcaggagcggctgcgcgtactggccaacaccgacaccattaccggactgccgaaccgcaatgccatccatgaactgatcagcgatgccattgcctgccgcgacgatacgcaggtgggcattgtttatctcgatctggataattttaaaaaggtgaacgatgcctacgggcatatgtttggcgatcagctgttacaggcggtgtcgctggcgattttaagctgcctggaagaaggccaggtgctggcgcgtctgggcggcgatgagtttatcgtgctggcgacgaattcgtcgcagagtacgctggaagccatggcctcgcgtattctgacgcgcctgcgccagccgttccgcatcgggcttatcgaagtctataccggttgttcgctggggatttcccttgcgccgcagcacggcaacgatcgcgagagcgtgatccgcaacgcggataccgcgatgtatactgccaaagagagcggccgcggtaagttctgcgtcttctcaccagaaatgaatcagcgggtatttgaatacctgtggctggataccaatctgcgtaaggcgctggagaacgatcagctgctgatccactatcagccgaaaatgacctggcgcggcgagatccgcagcctggaggcgctggtgcgctggcagtcgccggagcgcggcttaattggccccatggagtttatctcttatgccgaggagtccgggctgattgtgccgctgggacgttgggtcatgctcaacgtggtgcagcaggtggcgaagtggcgcgacaagggcattcatttgcgcgtggcggtgaacgtttcggcccgtcagctggcggatcagactattttcagcgatctgaaacaggcgctgagcgatctcaattttgaatattgtccgatcgacgttgagttaacggaaagctgcctgattgaaaacgaggagctggcgctgtcagtgatccagcagttcagcgcgctgggggcgcaggtgcatctggatgatttcggtaccggctattcgtcgctgtcgcagctggcgcgcttcccgctggatgccattaagctcgatcagtcctttgtgcgtgatgtgcataagcagccaatttcccaatcgctggtacgggccattgtcgctgtggctcaggcgcttaatttgcaggtgattgcggaaggagtggaaagcgccaaagaagacgcctttctcacgaagaatggcgtcaatgaacggcagggttttctctttgctaagcccatgcccgcagccgtattcgagcgatggtataaacgttatctgacgcgcaaagcgcgttagctggctttactcagactggcgacatgccggttttgtaactgcaccagacgttccatgtaggcgatgtctttgggttgcaggcagaacgccgcgtccacccagtcttcggtgatgtccatcagttcactgcgaggcaactgtatgacccgctgacgcgcgcgcagcatggcacggacgccattgagacgcggttgcagcgtatcgatgaaggtgcgcacggcaaccgccccctgccccggttcaaagagttcatccaccaggcctttaggttcgtaccattccgccgtatgggattcgcctttatagatcaactcctcggccagcttcatgcccgaacgccgggcgaccagcgaatatccccccatgccaggaaacaggttaaaggcgatttccgggaagcccaggcgtgcgtcccgctgcgcgagcacaaaatggtgcgccagcgcggcttcaaagccaccgcccagcgcactgccttccaccatcgccagactgatcgccccggtatcgaaaccgcgtgaagcggcgtgcacacagtcgacacaggctcgcgcgtaagcccgtagcgcttcacgacggccattttgcaggcagtcaacgaagaaacccagatcgcctccggcgttataaataccggggaccagtgagcctgttacccaaaaatccaccgcgaaccccgcctgcctgaccagccaggaaatattcatgatctcctcaatcagtccgtgattgaagcatgggcggggttgcgcccgtaacatcatccagaccgtgcgacgttcctcttcgtagtagcctgccagttgggtaaagcgctctgtatcagtgaacaatttgcatgatgcatggttggtaactgtcatggtcttttcctcattaattaaagcgcattgcgcgcagatttagactaatgcaggagcaaaccaggcagtatgtgcgtaagctaatttataattggtacttatgcttttttaagatttccttttttcccttctctttttacactaatttctgcatcattgaatttattaacttttcgatacagggtgacgacatggccgacatcgacgcaaagcaactggcaggacgtattgatacggtgctggacattctggtggcgggtgattaccactccgccatccataatctggaaatcctgaaagacgaattactcgcccttgacgccgccgggcaaatatccccgcagggtgcgccaaaaacaccctgggaaatctgaataagacgctatgaattcccgacaacaaattattctgcaaatggtcattgaccagggccgcgtcagcgtggccgagctggcgaaaacaaccggcgtttctgaagttactatccgtcaggatctgaacaccctggagaagcaaagttatctgcgccgcacccatggctatgccgtgccgctggaaagcgacgatgtggaaacccgcatgatgagtaacttcacccttaagcgcgaactggccgcctttgccgcgtcgctggtgtctcccggtgaaacggtatttatcgaaaacggcagcagcaatgccctgctggcccgcgcgctggccgatgagaaagacatcactattattaccgtcagcgcctacatcgcccatctgttaaaagagacggcctgcgaagtgatcctgctggggggcatttatcagaagagaagcgaaagcatggttggcccgcttacgcgccagtatgttcagcaggtgcatttcagcaaggcgtttattggcattgacggctggcagccggaaacaggctttaccggacgggatatgatgcgggccgatgtagtcaacgcggtactggaaaaaagctgcgaagccattgtgctcactgacagctcaaaattcggcgcggtacatccctatactttagggccaatgggacgatttaaccgggtaattaccgatgaaaaactggatgcagcgcagcaggcgcaattaacgcaatccggactgattgtcgatatagtaaaaaaagcttccgcacaataactcgccagcgcccgccatgcgcgggcttacctttcatctctgagagttttccgacctgtcaattaagactatttacctgtctcgtttagcggcaggaagtaaaattatgttgaacgatataacaggacgtaactatcactcacgtgatctatagtaacacctgcgcaacataatttacggaaatgaacttaagtttgctgaacaggcactatactcatagagaaattctttccgtggatacctatttcaggagattagtatgatgatgttatctggtaaaaaaatggctacagcggtactggcggtaacgctggcaatgtctctgagtgcttgttctaactggtctaaacgcgatcgtaataccgcgattggcgcaggcgcaggcgcactgggcggcgcagtattaaccgacggtagcacactcggcacattaggtggcgcggcagtcggtggtattgtgggtcaccaggtcggtaaataatcgtacaggtgtcgcgcagtacagaatatatactggcgttattgcgtaaattcgcagtgaattaaaaggccacggcatttgccgtggccttatcttatttatccggttaaccgccagccagttttaccttcatacctttggcttccagtaatgatttaatcaggtcgcgtttatcgccctgaatttcaattacgccatccttcactgaaccaccacaaccgcatttctttttaagctccgcggccagacgggcaatttcctcgtcactggcatcaataccagtaatcagacagacgcccttccctttacggccgctggtctgacgctggatacggacaataccgtcacctttcgggcgctcgaccaccggtttgggttcatcgatacgtccactgtcggtggaatagaccagccggctgtttgcatccttcatttaggcctccacacgtaatgaagcattaatggccttcagcgtctgcgccggatcggcagattgcgtaaccggacggcctatgaccatgtaatccacaccggcagcctgcgcctgttccggcgtcataatgcggcgctggtcgccagcatcactgccctgtggacgaatacccggcgtgaccagtttgaaggcctgccccagttcgcttttaaaacgcacggcttcctgtgcagaacagacaacgccgtcaagcccacagttttgcgtcagacgcgccaggcgttcggcatgttccgccggagtgctggtgatccccaaatcatgcaggtcgctcgcttccatgctggtcaggaccgtcacagcaatcagcagcggcgcatctttaccgaaaggcatcaacgcttcacgggccgcactcatcattcgcgccccgccggaggcatgaacgttcaccatccacacgcccagctctgcggcggcggctaccgcatgtgccgtggtattgggaatatcgtggaatttgagatccaggaagacgtcaaagccgcgctgttgcaggtcgcggacaaattgcgggccaaacagcgtgaacatttctttcccgactttcaggcggcaatccgacggggaaatacggtcgacgaaagcaagcgcctgatggcgatcggcgtaatcaagggcaacaaccacaggggaatgcgttacagcggcaaaagaggatgtagcagtagacgtcatgatcagaccttcctgatgatgggcacccgcgcaggcgcaataagaataaacggcgtgcattctacctgcgcgccgttgaaaaggacagaatgcatttttttgctaccaggcgataagggcacgatgtcgcagtagttatgcatgggaacaaaaagtatgttgtaactaaagtgcgggttttttttaatattactgaccatcaaggccacgaatgggcttgacggtggaccacgcgcgacaggacgggcaatgccagtacatggtgaaagcggtaaagccgcatttgtggcagcgatagcgtggcttactgcggatctgctcgcccaccatgtcacgcaacgccatcaggctctctttcgcgcgcccttcttccgcttcctgcaaatggtaatccatcagtttgtggaacacgcgcatggtgggctgacgctggagctgacgcgtcaccagcatttgcgccgtatcctgcccttcacgttgctcgacgatatccgccagcatcagatcggctaccgcgccggtgttctcttccacgcagcgctgaagaaattccgcccactcatcggttttaccggtatgcagatagcaggtttgcagcatctccagcgtttcgctgaccagttctttatcctgatccaccacacgcagcagactttcgatggctttttcgtactcccctttcgccatcagcacgcggcccatcatgatggaaacgcgcgggctgttgcgatcggcagcggctcccttcttcagcagcgccatggcacgatccagatcgtcgttgcccatctgttgtaacgccagctcacagtagaagtgggcgatttcgacacgctgtttatctttacccagcttgaccagacgttcggccacatcaatggctttctgccagtcgctggtcgcctggtaaatttgcagcagttgttgcagcgcgccgatacggaagtcggtttcgtcaaccagctgattgaacatgtcttcagcgcgatcgtacagacccgccgccatgtaatcgcggcccagctgttgtacggccagcagacgctgatcgtaagacagcgaggcgctttccatcagcgtctggtgaatgcggattgcgcggtcaacctcgccacgcgagcggaagaggtttccgagggtgagatgggcctcaacggttccggtatcctcttttaacatatcgaggaacaggtcaaccgctttatcctgttgattactaagcagaaagttaacacccgccacgtaatcacgcgagagtcggtttgcctcatcctgctttgtttgttgcgcgcttctgcgccccatataccagccatacgcggccgctacgggcaacagcagaaacaacaactcaagcatataatgttattccttgacggacggcgtgccggtcgttacgggaacgtcgtttgcgggggcaagctgatgttcaagtcgtttaattttacgttccgcgcgtaccagcgaaacacgcacacgcagccagaacagtccgcataccagccagccaatcacaaagcctgcggcaaacagacacgccagcagcgttgaaatacggaattcaccctgcgccagcaaataattgaatgtgacgagctgatcgttctgtgcacccagcgtgaccgaaatgacaaaaatcgctaacaccagtaagaaaatgagtaaatatttcacattacgtcccgttatgtggattggagcgaataaattctgttcaactgactgcatccagccttataacctaccattttcgcgacctggacgaaatggaaaagcgagtgacctgatggatttgcgggcgaaattcgctatttcaaccccgaatgcgcgttaacccatcaggcccgtcgataatattattcgtcgtcgcggtcggcgatctctttcttctcttcgaccggcggcgttaatggcccgcagatacgctgcgccagcatggtggcgaaggtgacaagcagtccggaaatcagcgtggcgaccaccagatcgcgtggccagtgcattcccaacagcatgcggctgcccatcaccgccgtcgcccacatcagcagcacggcaatagtgatagtgcgccgccgtggccacagcaaacctacgcccagcaacgcccagctggcggcaaacatggtatgccctgacgggaaagcgaaaccggtctctttttgccagtgtttgcgcaagaacgccggaatgttctcttcaccgctcagctgctcttttaccagatgcccgcgatccttacgttttaaagtgtagaactcatcaaccggaatatggtgtgttttttcaagccagatgacaaaaggccgcggctcctgcacccgatccttcacccaggacttcacgccctgcccgattaggatagcggcggcgaggatcacaaaaagcatcagcgcggctttcagacgaaatcgcagacaccataaaaaccagccgcagagcagcacatgggtgatgatcccccagggctgcgtcaccgtttcggttacccagtacagcgccttcagccacgcgctgttgttacctggcgtccactgccagccggatccccatactatcagcggcataatcagtaatatccccacccccgccatggtgcgctttacaatagacagcatgttctctcctttatgtgccaggccgcttaatagtaactgaaaaacaacatcaccggcaggagtgacggatttgtgcgcttaatctttacagcccgttgacgcaattagagaagttggccgccttgtggcaaaatacccccagaatgaaagcctgagggcgacaaggcacgtcaggtgccagaataaatccggagaatcacatgcagcttaaacgtgtggcagaagccaaactgccaaccccatggggcgatttcctgatggtgggttttgaagaactggccaccgggcaggaccatgttgcgctggtctatggcgacatttcaggccagacgccggtgcttgcccgcgtccattcagagtgtctgaccggcgatgccctgttcagtctgcgctgcgactgcggtttccagctggaagcggcgctgtcccatattgccgaagaaggccgcggcatcctgctctatcatcgtcaggaaggccgtaatattgggctgctgaataaaatccgcgcgtatgcgttacaggatcagggttacgacactgtagaagcaaaccaccagctcggctttgccgccgatgagcgtgatttcactttatgcgcggacatgttcaaactactgggcgtggacgaagtgcgtttgctgactaacaacccgcgcaaggtggagatcctcaccgaagcaggcattaatattgttgaacgcgtaccgctgatcgtcggacgcaacccgaaaaacgcgcattaccttgataccaaggccgcgaaaatggggcatttgctggattaataaaaaaagcccggcggtatgtcccgccgggctagcgtgaagggttatcagtgcagcatgttgcggatcacgtaatgcaggatcccgccgtgctggtagtaagtcagctcggttgccgtatcaatacggcagcgacaggaaatcacttcctgcgagccgtcggcgcgggtcaggcgtaccggtaccgtcgcaccaggtttaagtccggtcagatcttccacatccagccgctcttccccgctcagccccagcgttttacgggtcacgccctgcgggaactccagcggcaaaatgcccatgccgatcaggttagaacggtggatacgctcgaaagattcagcgatcaccacgcggatccctaacagacgcgggcctttcgccgcccagtcacggctggagccggaaccgtattctttaccggcaatcaccgccagcggcgtgccctcctgctgataacgcatcgcggcatcataaatggagatcacttcactgcccggcagatggcgcgtcatgcccccttccacaccgggcaccatttcgttgcggatgcggatgttggcgaaggtgccgcgcatcatcacctcgtggttaccgcgtcgtgaaccgtaggagttaaaatcgcggcgctccacgccatggttttgcagatagcgtcccgccgggctgtcggctttaatgctgcccgccggtgagatatggtcagtggtcacagaatcgccgagcatcgccagaatgcgcgcgccctgaatatcctctaccggcttcggctgggcttccatctcctcaaagaatggcgaggagcggatgtaggtggagtcaaactgccagccgtaggtatcggaggcttccactttgatggacttccactcgtcagtcccttcaaacacttccgcatactccttgcggaacatgtcagtggacacctgctctaccgcacgggcgatctcctgtccgctcggccagatatctttcagatacaccggatcgcctttgcgatcgtggcccagcggatcggttgccaggttgatgttcatattgccggccagcgcataggccaccaccagcggcggcgaggccagccagttggttttcaccagcggatgaatacgaccttcaaagttacggttgccggaaagcacggccccgacggtcagatcgccttttttgatcgcctgttcgataggatccggcagcgggccggagttaccgatacaggtggtgcaaccatagcccaccaggttaaagcccagctcatcgagatacggcgtcagacgcgcctgcgccagataatccgataccactttcgagccgggcgccagcgaggctttcacccacggctgacgcttcagcccgagggtgacggcttttttcgccagcagaccggccgccatcagcacgctcgggttcgaggtgttggtacatgaggtaatggctgcgatgaccaccgcgccatctggcagctgatactgatgaccgttcagaacataatccaccggctgacgatctttctgggcggtattgagctccagctcggtgctggccgcaaaggcttttggcacatcgcccagcgccacgcgatcctgcggacgttttggtccggcaaggctggcttcgacgctgctcatgtccagttccagggtactggtaaagacaggttcatcacccggctgacgccacatgccctgcgctttcgcataggcttccaccagcgccacctgatcgtcgctgcggccgctaagacgcatgtactcaagcgtcacgtcatcaatcgggaagaatccgcatgtcgcgccatattccggcgccatattggcgatagtggcccggtccgccagcggcagggagtcgagaccgtcgccataaaactccacaaacttacccaccacgccgtgtttacgcagcatttgcgtcacggttagcacgaggtcagtggcggtgatgccttcgctcagtttaccggtgagcttaaagcccaccacatccgggatcagcatggatacaggctgaccaagcatggcggcttccgcttcgataccgcccacgccccagccaagcacgcccagcccgttgatcatggtagtgtgggagtcggtgccgaccagggtatccggataagcgacccactctttatcctgcagctcgctccagacggccttacccagatattccaggttgacctgatggcagatgccggtgccaggcggcacaacgctgaaccggctgaaggcctgctggccccagcgcagaaacacatagcgttcgtggttacgctccatttccagacggacgttttcttcaaaggcgtcgtcatcgccgaaatggtcgacggtgacagagtggtcgataaccagatcaacaggggaaagcgggttaactttagtggtatcgccaccaaggcgtttcacggcttcacgcatggcggcgagatcaacaacagcgggaacgccggtaaaatcctgcatcagcacgcgggcgggacgataagcgatttcacgatcggcgtgggcggatttcaaccagcctgcgagggcatggatatcctcctcagtgacggactcaccatcctgccagcgcagcaggttttccagtaacacttttaacgacttgggcaaacgggaaatatccccaagttcctttgcggccaggggcaggctgtagtaatggtaggttttgttttcagcctgcaatgtgtccttactggcttcgcgtagggtcgacgacataagctcctccttaatacagggattgcaattccctgattatcatcagggtctgtattaaagataacacaaacatgctgtaacgttttgataacaactcaaattgataaaagaggtaaaaccattgaagggataaaaacaaaaaaccccgcttaagcgaggtttttatgcggttagtgagccatcatccagaccagttgtccccagaacataaccgagacggtgaatgcgcccatccatgaccagtatttgagattatttatcatttatacaccctacgaattaatcaagcgccacaccgggttgttacccgtttctatattgctgaggtgtatttattaagaagtacaaaagaccgctgggcgtcaggctaatttcgcgcccacgctgttggttaaattattgtttttttggttcgtcttctgcgaacgtttcaataaaggcacgctgctgcggggtgagttcccattcgtcaggaatacgcacctcggcgtcctttttggcgctaagaggcttgtcatgtaactgacatactggcttcactgtgccgaactgccccgtaaacaccattctcaaccccaaaatttccacaccagcaaggctacaaccacccagaacagggctgagccaagaaacaccgccagccaggctttgcgtttcagcgcgtgatccctttgcgattcgtcgcttcctgatggcattgctaacctcacacaatcgacatcacttatcattttgacacctaacaataggtataagtaatcactagatgagacaaatcctaaaataagtttaggaaaaaagccagcgaatttaccaatgatttccagttaaatattcaatcttttgaccggaaataaataattgaagaataaaatttgcggacccgtaaattactttctacttttgtcgcgaaaacacgacacaattgcggttaagttgtgacaggaatcactcggggaaatgtgagttaaggcagatgatgataattctgatttaggtttagggcgataaaagggtatcttcccgggcgggaagataccgcaggaaattatttttctggcagcttaatgtcctggaacatggcttcaatatcatcatttgaacgcaatgccaccgcggtatccaccacgtcacgggttaaatgtggtgcgaagcgctgaataaaatcatacatataactgcgcaggaaagtgctgcgacgaaaaccgattttcgtggtgctgtggctgaacacgtcctgtgcgtccagttttaccagatccggatccgataccggatcaaccgccatgctggcgatcacccctaccccaagacccaggcgcacataagttttgatcacgtcagcgtccgtggcggtaaagacgatacgcggcgtcagcccggcgcgattaaaggcggtgtccagctctgaacggccggtaaagccaaaggtataagtaaccagcgggtactgcgccagctcctcaatgctcaccgactgtttgcccgccagcggatgatcgggcgtgacgacaatcgaacgattccagtggtagcacggcagcatgaccagatcgtcatacaggtgcagcgcttcggtggcgatggcgaaatcagcattgcctttggagacggcttccgcaatctgcgtcggcgagccctggtgcatatgcagcgaaacacgtgggtagcgctcaataaagcccttgattacgccgggcagcgcataacgcgcctgggtatgggtggtcgcgacgtagagcgagcctttatccggccaggtatgctctcccgccaccgacttaatggcatcaactttggagagcacttcacgggcgatgcgtatgatctcctcaccggctggcgtgacctgggtaagatgcttgccgctgcgggcgaaaatctggatccccagctcatcttccagcatacggacctgtttgctgatgccgggttgcgaggtgtatagcccctcagcggtagaggagacattaaggttgtgattcaccacctcaacgatataacgaagctgctgtagtttcatgacggaccatccggttgagcgctgacgagcaatcgtttaagacgatttaataataagaaatgacttaactataaccactatatcattaatgcccggtctgtatagacaggaacgcaaaattataagcaacaaaaaagggccggatatccggcccttgcagggagcagacaggctaaattacttcttaccttccacccatttcccgtcgatgaagaaagcagaccagccggtcgctttaccctctttctcggcggaaacatactgctgcttagtcttacggctaaagcgaacgacagttttgttgccttctggatccgcgacaggcgcatcggccagataacgcagtttttccggcagacaatcgcggaagcgatgcagctcttccaccagcggtgcgcgggtttcacgggatttcgggaaggtgttcgccgccaggaatacccctgccgcaccgtcgcgcagtacaaaataggcgtctgatttttcacatggcagctcaggcagcggcaccggatcttctttcggtggcgcgacttcgccgttacgcaggatcttacgcgtgtttttgcattcgtcgttggtgcaggccatgtacttgccgaaacgccccattttcaggtgcatttcagaaccacacttctcacactccacgatcgggccgtcatagcctttgatgcggaattcgccctcttcgatttcatagccgtcgcaggtcgggttgttaccacagacgtgcagcttacgcttgggatcgatcagatagctgtccatagcggtgccgcatttcacgcaacgacgcttagcacgcagggcgttggtttcggcgtcgtcgccttccagcacgttaaggacttcgttttccggcaccaggttaatggtggttttgcagcgttctttcggcggcagcgcatagccggaacagccgaggaacacgccggtgctggcggtacggatacccattttgcgaccgcaggtcggacagtcgatactggtcagcaccatctgattcggacgcatgccgccttcttccggatccttttccgctttttcaagctggccggtgaagtcggtaaagaagttgtccagcacgcctttccattccgcttcatggttggcaacctggtcaaggctgttttccatttgcgcggtgaaatcgtagttcatcagctcgcggaaattctcttccagacggtcagtgacgatttcgcccattttctcggcatagaagcggcggttttctacacgcacgtagccgcgatcctgaatggtcgagatgatagaagcataggtcgacggacgaccgataccgcgtttttccagctctttcaccagggatgcttcgctgaaacgcgcaggcggcttggtaaagtgctgcgccgggagcagttccacaagggataccacatcgcctttgttcaccgccggcagcgtgcgatcttcatcgcccttacgcagctgcggcatcaccttcgtccagccatcgaaacgcagcgtacggccacgcgccttcaggcggaactcgcccgcttccacggtcagggtggtggaatcgtactgcgctggcgtcatctgacaggcgacaaactgacgccagatcagctgatacagcttctgcgcgtccgcttccatatccttcagggactctgccagcaccgccacgtcggaaggacggatggcttcgtgcgcttcctgggagttttctttgctggcgtactgattggcgctttccggcagatattttttaccgaaattatcgctgatatagccacgcaccatgctgacggcgtcctgactcaggttggtggagtcggtacgcatataggtaatgtggcccgcttcgtacagacgctgcgccatcatcatggttttcttcacgccaaagccaaggcgcgtactggccgcctgctgaagcgtggaggtaataaaaggcgcgccaggcttgctgctggtgggcttatcttcccgatccgtaacggtgtagcgcgctttttccagcaggcttaccgccgccatagtctgctcgcgattaaccggacggaaaggcttgtcctgctgatgcgtcacctgcaacggcagcgcatcgccggaaggcgtggtaacgctggcgtcgatttcccagaactcttccgggacaaaggctttgatttcgcgctcacgctcgaccaccagacgcaccgccacggactgaacgcgtccggcagacaggccgcgggcgatctttttccacagcagcggcgacaccatgtaacccaccacgcgatccacaaagcggcgcgcctgttgagcatttacacggtcgatattcagttcacccggcttttcaaacgcctgctggatagcgtttttggtgatttcgttaaacaccacgcggctgtagcgcgagtcatcgcccccgatcacttcccgcaggtgccaggcaatggcttccccttcgcggtcaaggtcggttgcgagatagatatggtccgctttttcagcgatggctttcagttcggcaacgactttttctttgcccggaagcacttcatagcgtgcatcccattcgttccatgggtcaacgcccatgcggttgaccagcgcgccacgttcatcctttttaggctttttggccgttttggtggtggcggagtcggcgctctttttgggtgctgagccactggtcggcagatcgcggatatgaccgacgctggatttcaccacgtagtcattacccagatacttattgatcgttttggcttttgccggggactcaacgatgacgagtgctttacccatattcacctttacctaatttgattcttccaggaatacgtcgcacgttgattcactctccaccgcgacatccgatgatgtggcggcgatatccgtggttatcaacccctctttaaaaccgggcgcgtgaagtgtggtgcccaggtgactgagttcacaggtgttttcgcgcatcagtgctgtagcacgacggacttaaggtcgaatgtcaagcaattctgttgccagattgacgaaagcgcacactctacctgataaaattcgttacgcaactttattagcatgcaaaagcaaatcacgccagccagtccccggtgtgaaaaccattttaaaaacagggaaaatttgcgcctggcccaccggcagacgtagaataaatgccttgtcagaggagcagactatgcacgagaacattcaacctatcgatcgccagtcactattagctgaagctaaccgaatcatccgcgagcatgacgattttattcagggcatcgaagcgacggatgtcactgaacgcaacggcgtgctggtgttcagcggcgactatttccttgatgagcaaggcctgccgacgtcgaaaagtacggcggtgtttaatatgttcaaacacctggcccatgtgctgtccgaaaagtatacccttgcggactgacggcaataaaaaagcgaggtgattcacctcgctttttgttttacagcaacggtttttcaccgcgctgccaccagcgcagcagcaggcggtcagcggcttccgccgcactgccggtaaagcggtccatcagctttttacgctgggcgtaacggatgccgatcacctcgcgctctttaatcagccccagcagcagatcgtcgctggtgcccacttcatccaccagtcctttttccagcgcctgtacgccataccagtgctcgccagtggcgacctggtcgatgtccagcgacggacgcatctgcttcacatactctttaaacagatcgtgcgtctcattcaggctctcacggaacttctgccgcccttcttcggtgttttcacccagcagcgtcaacgtacgcttgtactgcccggcggtgtgcagctcgatgtcgatgtctttgcttttcaggaagcggttaaagttcgggatttgcgccaccacgccgatagagccgacgatggcgaaaggcgcagccacgatcttatcggccacgcaggccatcatatagccgccgctggccgccactttatccaccgccaccgttaaggggatgtttttgtcgcgcaggcgctggagctgggaagacgccagcccgtagccatgcaccacgccgccgggactttccagacgcagcaccacctggtcttccggccctgcgatggtgatcaccgcggtgatctcttcgcgcagggagttcacctcatgggcatccatactgcctttgaaatccagcacaaaaacccgtggcttcgtggccgtaaccggggtgccctgcttcgcgctggccttcgccgctttcgcgtcctgcttcgcttttttcttctgcgctttatgccacagcttttgctggtgatcgtccagcagcgcgacggagacctcctcctgcatctccttatattgttcgctcagcctggtgacacgtaattcaccccgctgacgcttgcgctgggcaagatttacaatcagtaccgccacgacaacaatcgccagcacaacggtggcaatctttgccaaaaacaacccatattcagacagtaattccacgcgtaccaccttggttaaaccgcattacgttcgcattcagtgtacatgacaggttccggctcgtcttctgccaccgcacaatgttacgaggcatcttcctgatttttttagactccatgaaaaggttgcaaagtgttaaccagcaggattgtctgcctttggctgattgaaatacgggccggattaaggcataaaaccagcaagtcaagtcgaagtcagcctggcgcgccacgatcgcgacgcctgaggagagaatgtgtattaccagccacaacgagatctactgcaaaaccgcatcattctggtcaccggcgccagcgcaggtattggcgaagaaaccgcgcgtacctatgcccgccacggtgcccaggtgatcctgctggggcgtaacgacgaaaagttgcgccgggttgcgcaggccgttgcggatgaatgcgggcagatgccgcgctggtttacgctggatatggaaacctgcacccctgccgactgtgaacagctcgcgcagacgcttgccgcgcattattcgcggctggatggtgtattacataacgccggtctgcttggcgatatctgtccgatggatcagcaaaatccgcaggtctggcaacgggtgatgcaggtcaacgtcaatgccacctttttcctcacccaggcattgcttcctttattactgaaatcagaagccggttcgctggtatttacctcctcaagcgttggacgtcagggtcgcgccaactggggcgcttatgccgcctccaagtttgccaccgaaggcatgatgcaggtgctggcagaggagtatcaaagccgtcatctgcgggtaaactgcattaatccgggcggaacccgcaccggtatgcgcgccagcgccttcccgacggaagatccgcaaaaactgaaaacgccggcggatattatgccgctctatttatggttaatgggcgatgacagccgtcgcaaaaccggcctgagctttgatgctcagccaggacgtaaaccgggaatatcgcaatgagtgaagatcgttatcagcagcgtcagcagcgcgtgaaagagaaagtcgatgcgcgcgttgccgccgcccaggatgaacgcggcattatcatcgtctttaccggcaacggcaaaggcaaaaccaccgcggccttcggcaccgcgacacgcgctgtcggacacggcaaaaaagtgggagtgatccagtttatcaaaggtacctggcctaacggcgagcgcaatctgcttgagccgcacggtgtggaatttcaggtgatggccaccggctttacctgggacacgcaaaatcgtgaatcggacaccgccgcctgtaccgccgtctgggagcatggccgccggatgctggcggatgcctctctggatctggtgatcctggacgagctgacctacatggtggcctatgactatttaccgctggaagaggttatcagcgccctgcaaaatcgtcccccgcagcagacggtgattattaccgggcgcggttgtcatcgtgacattctggaactggcggataccgtcagcgagctgcgtccggttaaacatgcttttgatgcgggcgtaaaagcgcagatgggaatagattattgagtgattttgccaggtggcgctacgctcacctggcctgccagtcacagtcctgaaaacccgcgcaagcgaagcgccgccgggcttgtgtacagattaaccgtttgttttgttacgagtgcttgagcggcgaccggttgatgccggacgcgggtttgaggtctggctgtgacgttttaccgcacggcggatctgattcgctttcacccggcggcgatctttctcgacggccacttttgattcggtttccggtttcagctccaccagctcacgcaggtagttggtctgcgccagatccagttcggtataacccccacgcggcaggcctttcggcagcggaatatcgccgtagcgaacgcggatcaggcggctgacctgcacgccaacggcttcccacaaacgacgcacttcacgattgcgcccttcggttaaggtgacgttgtaccactggttgatgccttcgccgccgctgaacttgatggttttaaaggcggccgggccgtcttccagctgaacaccacgggccagttcacgcagcttgttatcgtcgacctgaccgaaaacgcgcacagcgtattcacgttccacttcacggctcgggtgcatcagacggttcgccagttcaccatcggtggtaaacagcagcaggccgcaggtattaacatcaagacgccctacggcgatccagcgcgcgccgcgcagtttcggcagacggtcaaatacggtcggacgcccttccggatcgttgcgcgtacacagctcaccttcgggtttgtaataggccagcacgcggcagatttgttcaacggattcttttacggagatcagatgtccgtcgatacggattttcaggcccggctgaacctcaacgcgatcgcccagcttagcaattttgccgtctacgctgacgcgacccgcttcgataatggtttcaatttcacggcgtgagccgtggccggcacgcgccagcactttctgtagtttttcgctcatggagcatccttcaggtgtcgccttcacaggcgtctggtatactttcaaaaacaacgagttatgaatttcaccctcgctgctatgtaaaatcgctggcgtcaaagaacgcgcccaatttcatgtggccgcacatattacacgaatttatgcacgaatgctgcaatgctgctcgcgaaccgcatttctggagtatataaggaaggcataatgaaaagctttacctcttctgtggctggctgtcagatccgctatcacgatctgccggggcctggcgaaccgctggtctttattcacgggctgggatgcgcctcgtcctttgaatatccgcgtgtcgtcatggacccggctttctcaccacgtcgggtgatcctgattgatttaccgggcagtggctacagtgataaaccagcgtattacagttactccaccaccgatcaggctcaggcggtaactgaattgctgacggacattggcctgacgcagttctggttatacgggcacagcatgggcggtagcattgccattgaagtggccaccgcaatgcaggcatcacttctgggactaattgtatcggagccaaacttttataaaggtggcggccaattcagccgcgggattgcggcaatctcacaagatgaatttatagccggaggttaccagggcttaattgataacgaagagagtccatggaaaggttctttgcagagcactctgccgctcgccgtctggcgcggagcaacatcactggttgaaggtatcgaacctgaatggttttccctctttaccgccctgccggttcgtaaacagttactgttcggggaatggtctttgccggatcaggattttgaagcggttaagtcacaaggaatagcgtgccggatcattaatgccgcaggccactctatgtcatgggaaaacccgacaggactggcgcaggcattaagcgagttctgtacgctataagccgggccacctgttgtggcccggcgcatcacttataagaaaggtttaacgtccccgacgccttcgcgcaggatcaccggcgaatcatcggttaaatcgataaccgttgttggctgctggccaaggtaaccgccgtggatgaccagatcgacatgtttttccaggcgatctttgatctcttccggatcggattcggtaaaatcgctgcccggcagcatcagcgaggtggaaagcattggctcattgagcgtttccagcagcgccagggcgatggggttggatggcacacgcaggccgatggttttacgtttttcctgcaacagccggcgcggcacttctttcgtgcctttcagaataaaagtgtagttgccgggcgtgttgtttttgatcagacggaacgccacgttatccacataagcgtaggtggacaactccgacagatcgcggcacatcagggtaaagttgtggccgtccggcagctggcggatgcggcaaatgcgctccatggcgcccttgtcttccagtttgcaccccagcgcatagccggaatcggttggataaacaatcaccccgcctttgcgcacaatttccacggcctgattaatcagccgcgcctgcgggttgtccgggtgaatatagaaaaactgactcatactgccctctcattggtgttctgtggctgctcccacgatgtccacaccccttccacgcctgcgggtaaccagagcttacgacccagttcgatccacgggcagggctgatggaaatccgagccctgcgaagccagtaaaccaaactgttgcgcataagctgcaagctgggtgcgctcgttaggcgcctgctgacattgcgatacttccatggcgtcgccgccctgttcggcgaagtgcgccagcagtcttttcagccatttagcgctcaaatcataccgccccggatgggcgataaccgctttgccgccagaatgatgaatgacatcaatagcttgttttattgtacaccactgtggcggaacgtagccggttttcccccgcgcgaggtattttttaaatacatccgccacgttattggctttgccgctggcgaccagaaaacgcgcgaaatgcccacgggtcacggcaccgccctgcgccagggcctgcgccccttccagcgcgccgggaatatgcgctttttcaagccgttcggcgataagctgcgcccgctgctggcgtcgcgccttttgttcgtccagcagttcacacaccgccggatgagtgctatcaatattgaggccgacgatatggatctcatggttttcccagagggttgagatttccacgccggggatgagcgttaatgccaggcccgcgcgttcgatttcggcctgcgcggcggcgatgccgtcggtggtgtcatgatcggtgatcgccagcgtaccgacgcgcatctcaaccgcgcggtgcaccagtttttcgggtgaaagcaaaccgtctgaagcgagagtgtgggaatgaagatcgtaaatcactgcgtaattcgtgtcgctcaaagcggctcccatggggatataaagaaggtgaccgcgccatcataacggttgccgatgatttttgcgaaatcaggggttgactttatttccccgaaccagttaactagtacgcaagttcacacgacgaggtatctgaaaatgactgcattctcaacacgtaaccgctggtggcgcactcctgattacgggcagtgaggtcacgtctgcgtcacgcaaacagataccccggcccgcctcgtgagcgggcttttttatgaacaaaataacgagaacgattatgcaaacgcaaaaaccagcactcgaacttcttactgatgatgcggtgtaccgtgaaaatccaacggcgctgtttcaccagatctgcggcgcgcggccggcgacgctgctgctcgaatccgcagacatcgacagcaaaaatgatttaaaaagcctgctgctggtggatgccgcgctgcgcattaccgcgctgggtgacactgtcaccatcaatgcctttaccgccaacggcgcgtccctgctgccgctgctggacgcggcgctgccctcaggcgtggaaaatataaaaacggataacagtcgtgtattgcgcttcccgccggttagcgcgttgctggatgaagacgcccgcctgtgttcgttgtcggtgtttgacgccttccgcctgctgcaaacgctggtcacactgcctgccgatgagcgtgaagcgatgttctttggcggtctgttcgcctatgacctggtggcaggttttgaagaattaccggccctggcgcaggataataactgcccggattactgtttttacctggcggaaacgctgctggtgatcgatcaccagaagcagcatacccgtatccaggcaagcctctttacgccgcaggccgccgagcgcgatcgcctgacgcaacgaatggcaacgctgcgccagcagttgcacgacctgcccgttgcgctgccggtggaatccatcgcctccatgcgctgcgactgtaatcagagcgacgaggagtacggcgcggtagtgcgcgaaatgcagaaagcgatccgcgccggggaaattttccaggtggtgccgtcccgccgcttctccctgccctgcccgtcgccgctggcggcctatgatgtgctgaagaaaagcaatcccagcccgtacatgttctttatgcaggatgccgatttcaccctgttcggcgcgtcgcccgagagctcgctgaaatatgacgcaaacacccgccagattgaaatctaccccattgccgggacgcgcccgcgcgggcgtcgtgccgatggctcgctggatcgcgatctggacagccgtattgagctggagatgcgtaccgatcataaagagctgtcagagcacctgatgctggtggatttagcgcgtaacgatctggcccgcatctgtacgccgggcagccgttatgtggcggatctgaccaaagtcgatcgctactcctttgtgatgcacctggtttcccgcgtggtgggtgaactgcgccacgatctggatgcgctgcacgcttatcgcgcctgtatgaacatgggtaccctgagcggggcgccaaaagttcgcgccatgcagctcatcgccggtgccgaaggtacccgccgcggcagctacggcggcgcggtgggttattttactgcccacggcgatctcgacacctgcatcgtcattcgttccgcctacgtggaaaacggcgtcgccaccgttcaggcgggcgcaggcgtggtgctggattctgtgccgcagtccgaagccgatgaaacccgtaataaagcccgcgccgtcctgcgcgccattgccactgcacaccacgcacaggagacgttctgatggctgatattctgctgctcgataatatcgactcgtttacttacaacctcgccgatcagctgcgcgccagcgggcacaatgtggtgatttaccgtaatcatgtcccggcgcagacgctgattgaccgtctgaccaccatggacaacccggtgctgatgctctcgccagggccgggcgcgccgtcggaagcgggctgtatgccggagttgctcacccgtctgcgcggcaaactgccgatcatcggcatctgtctgggtcatcaggcgattgtcgaagcctacggcggctacgtgggccaggcaggtgagatcctgcacggcaaagcgtcgagcattgaacatgacagccaggcgatgttcgccgggctgagcaatccgctgccggtagcccgttaccattcgctggtgggcagtaatattccggcgggtctgaccatcaacgcccatttcaacggcatggtgatggcagtgcgccacgatgcggatcgcgtctgcggcttccagttccatccggaatcgatcctcaccacccagggcgcgcgtctgctggagcagactctggcatgggcgatgcaaaaactggagcagaccaataccctgcaaccgatcctcgaaaaactttaccaggcgcagaccctgagccagcaggagagccaccagctgttttccgcggtggtgcgcggcgagctgaagccagagcaactggcggcggcgctggtcagcatgaagatccgcggcgaacacccgaatgagatcgccggggccgccaccgccctgctggaaaacgccgcgcccttcccgcgcccggattatgcctttgcagatattgtcggcaccggcggcgacggcagcaacagcatcaatatttccaccgccagcgcttttgtggcggcggcctgtgggctgaaagtcgccaagcacggcaaccgcagcgtttccagtaaatcgggctcttccgatctgctggcggccttcggcattaatctggatatgcaggcggaaaaatcccgcaccgcgctggacgagctgggcgtctgtttcctgttcgcgccgaaatatcacaccggttttcgtcacgccatgccggtgcgtcagcagctgaaaacccgcacgctgtttaacgtgctggggccgctgatcaatccggcgcatccgccgctggcgctgatcggcgtctacagcccggagctggtgctgccgattgccgaaacgctgcgcgtgctgggctatcagcgtgcggccgtggtacacagcggcggcatggatgaagtgtcgctgcatgcgccgacggtggtagccgaactgcatgaaggagaaatcaaaagctatcagctgaccgccgccgattttggcctgacgccttaccatcaggagcagctggcaggcggcacgccggaagaaaaccgtgacattctgacgcgcttattacaaggtaaaggcgaggctgcgcatgaagctgccgtggccgctaacgtcgccatgctgatgcgtttgcacggtgaagaagatttacaggccaatgcgcaaaaagttctggatgtgctgcacagcggcgcggcgtatgacaaagtcaccgcacttgcggcaagagggtaaatgatggaaaccgttttagcgaaaatcgtcgcagataaggcgatttgggttgaggcccgcaaagcgcaacagccgcttaccagttttcagaatcaggtggtgccgagtacgcgtcgcttctattctgccttacagggcgcgcgcacggcctttattctggagtgcaagaaagcatcgccgtctaaaggcgtgatccgtgaagactttgatccggcgcagatcgccgagatctacaaacaccatgcgtcggctatttcggtgctgacggatgaaaaatatttccacggcagcttcgattttctgccggtggtcagcgccatcgcgccgcagccgatcctctgtaaggatttcattatcgatccttaccagatttacctggcgcgtttctaccaggcggatgcctgcctgctgatgctgtccgtgctggatgacgagcagtaccgccagcttgccgccgtcgcacatagcctggagatgggcgtgctgacggaagtcagtaatgaagaagagctggagcgcgccattgcccttgaggcgaaagtggtcggcattaataaccgtgacctgcgcgatctttctatcgatctgaaccgtacccgccagctggcgccacgcctgggcgcaggcgtcacggtgatcagcgagtcaggcattaatacctatgcgcaggtgcgtgagctgagtcatttcgccaacggattcctgattggctcggcgctgatggaatatcccgatctgaatgccgccgtgctgcgcgtgctgctcggcgaaaacaaagtctgcggcctcacccggtcagaagacgcgcaggcggcttttgaggcgggcgcgctgtacggcgggctgatttttgtcgatacctcgccacgcgcagtcagcgatgaacaggcgcaggcggtgatcaatgccgtgccgggtctgcgttacgtcggcgtgttccgcaatgcgccggtggaggatgtggttgcacgcgcgcaacggctggggcttgccgccgtgcaattacatggtacggaagaccagcagtatgtgaatgcattacgcgccgcgctgccggctgatgtgcagatctggaaagcgctcagcgtcacccgcagcctgcccgcgcgggattatcagcacgtggacaaataccttttcgataacggtcagggcggcagcggggagcgatttgactggtcgctgctggcaggccaacgcctcggcaatgtactgctcgcaggtggccttggcgccgataactgcgtggaagccgccagggccggttgtgccggtctcgattttaattcaggcgtagagcgtgaaccgggtattaaagatgccgataaactggcctcggttttccgcacgctcagagcatattaaggaagcaagcatgacaacattactgaatccctatttcggcgagtttggcggtatgtacgtgccgcagatcctgatgcccgccctgcgtcagcttgaagaagcttttgtaaacgcgcaaaaagatcctgaattccaggcgcagttcactgacctgctgaaaaactatgccggtcgtccgacggcgctgacgaaatgccagaacctgacggcgggcacgaaaaccacgctgtacctcaagcgtgaagatttgctgcacggcggcgcgcacaaaactaaccaggtgctgggtcaggcgctgctggcgaagaaaatgggtaaaacggaaatcatcgccgaaaccggcgcgggtcagcatggtgtggcgtcagcgctggcctcggcgctgctcggtctgaaatgccgcatttatatgggcgcaaaagacgtggagcgccagtcgccgaacgtcttccgtatgcgcctgatgggcgcggaagtgatcccggtctacagcggctcggccacgctgaaagatgcctgtaacgaggcgctgcgcgactggtccggcagctacgataccgcgcactatatgctgggtaccgcggctggcccgcaccccttcccgactatcgtgcgtgaattccagcgcatgatcggcgaagagaccaaagcacagatcctcgaaaaagaagggcgtctgccggatgcggtgatcgcctgcgtcggcggcggttctaacgctatcggcatgtttgctgactttatcgaagagaccggcgtcgggctgattggcgttgagcctgccggacacggtattgaatccggcgagcacggcgcgccgcttaagcatggccgcgtggggatttacttcggtatgaagtcgccaatgatgcagacggaagatggtcagattgaagagtcttactccatttctgccggtctggatttcccgtccgttggcccgcagcacgcgcatcttaacagcatcgggcgtgcggattatgtgtccatcaccgatgacgaagcgctggacgcgttcaaactgctgtgccgcagtgaaggcattattccggcgctggaatcttcacacgcgctggcccatgcgctgaaaatgatgcgcgaaaacccggaaaaagagcaactgctggtggttaacctgtccggccgcggcgataaagacatctttacggttcacgatattctgaaagcgcgaggggaaatgtaatggaacgctatgaaaacctgtttaaacgcctgaaggatcgcaaggaaggcgcgtttgtccccttcgtgacgctgggggatcccacccctgagcagtcgctgaaaatcatcgacacgctgattgaagcgggtgccgatgcgctggagctgggcattcccttctccgatccgctggcggatggcccgaccattcagaacgcgaccctgcgcgcctttgccgcaggtgtcacccccgcgcagtgctttgaaatcctgaccaccgtgcgccagaaatatccggatatgcccattggcctgctgatgtacgccaacctggtattcagccgcggcattgatgagttttatgcccagtgtgaaaaggccggtgtcgattccgtgctggtggcggatgtgccggtggaggagtcagccccgttccgtcaggcggcgctgcgtcacaatgtggcaccgatttttatctgcccgccgaacgccgatgacgatctgttgcgccagatcgcctcttatggccgcggctatacctatttgctgtcacgcgccggggtgaccggatccgagaacggcaccgcgctgccgctgaatcacctggtggataaactgcgggaatataatgccgcaccggcattgcagggatttggtatttcggcaccggctcaggtgactgccgcgctgggcgcgggcgctgccggggcgatctccggctctgccattgtcaaaattatcgagaagcatcttgataactccaccgcgatgctggcggagctgaaagcttttgtacagggcctgaaagccgcgaccctgccgcaataacctcatctgccgcctgaatgataatcgggcggcatattcctgtcagaatcgataacccgcgccaaacataaatacccagggatcgagacgggtatgcacgctctgctgctcgccaccggctttaaaacgtacatcggtatcaatatccatataccagactgacatgttcagcagccagtcacggttgatgagataatccagccccacctgccccgccagcccccatgaatctttcaggctcaaatccgacagcccggcttctttgccggtatcattgaatttttcatcaaagaacgtggtgtagttgacgcccgcgccgatatagggacgcgctttgctggtggcatcgccgaaataccactgcgccatcaacgacggcggtaaatgatgaacggtcgccaggtcgccggtcggccctgtaccgactttatgacggaacggcgtggcagccagcaattcaacgccaacattgtccgttgccatataagtgaaggtcagacccagttgggtattgttatcgacgttaaacccgccgaggctgcccagcacgttatcagagccttccgtcgggcgcacggtggcggaaccggcacggacaaagaattcgcctgcttcatgggcatacacgttttgggaaagacctgccagtaccagcgctgccacagctaactttttcatctccactcctttgatgtggttttatttgcgcggtgaatatacctacatcgaagtagaaagtgatctgccacagatcacatttaaaccaataatttaacctttgttgatctggattaattttaccgcccattccgataaaaccgtgtttaccggtctgcatcaatttttactttttgtgcgtaacgggcagccattactctcgctttacaaagatatgcttttccataccacccttgatgctgccacttgcgggtcaaccagggtacaatcggcagctgaataaacacctgcttaactcaaggagagggcatgtctatcacggcgaagtccgtttaccgtgacacgggaaatttttttcgtaatcagttcgttactattctgctgatcgcgttgttatgtgcatttatcacggtgatgcttggtcatgttttttcgcccagtgaggaacaactgtcgattttaagcgaaggcgataatctgtccggcagcgttggtctgatggaactggtgcagaatatgacgccggagcagcagcaggttttgctgcgcgcgtcggcggcgtccaccttctccgggctgattggtaacgccattctggccggtggtgtgctgctgatgatccaattgatctccgccgggcagcgcgtcagcgccctgcgggcgattggcgccagcgcgcctgtgctgccgaagctgtttgcgctgattttcatcaccaccctgctggtgcaggtgggcattatgatgatcgtcgtgcccggcgtgctgctggccatcgttctgtcgtttgcgcccgtcatgctggtgcaggaaaaaatgggtatctttgccgcgctgcgcgccagcatgcgcatggcctgggcgaatatgcgactggtggcacccgccattatcggctggctgctggcaaaaacagtgctgctgatgtttgcctccagctttgccgccctgacgccgaacgtgggcgcggtggtggctaatacggtgagcaatttaatctctgccgtactgctgatttatcttttccgcctttatatgctgatccgtccttaacattcacccgtcggccttcacgtcgacgggtattactatcggaattaaagaatgaagcagtttcttgattttctgccgctgattgtctttttcgccttctataagctgtatgacatttatgccgggacggctgcgctgatcgtcgccactgccgtggtgctggtttacagctgggtgcgttaccgcaaagtggaaaaaatggcgctgatcacctttgtgctggtggcggtatttggcggcttaacgctgttcttccataacgatgaatttattaaatggaaggtgacggtaatttatgcgctgtttgccggtgcgctgttattcagccagtgggtgatgaaaaagccgctgatccagcgcatgctgggcaaagagctcaccctgccacagcacgtctggtcgaaactgaatatcgcctgggcggtgttctttattctctgcgggctggcgaacatctatattgccttctggctgccgcaaaatatctgggttaactttaaggtgtttggcctgtcggccttaacgctgattttcacgctgctgagcgggatttatatttaccgtcatatgccgacggaagataaatcctgacgccgtttcagactgagataataatgacgacaacaaatgaggctccgcagggagaactggtattacgcacgctggcgatgcccgcagatactaatgccaatggcgatatttttggcggctggctgatgtcgcagatggacatgggcggcgcaattatggcgaaagagatcgcccatggccgcgtggtgacggtgcgcgtcgacggcatgacctttctgcgcccggtggccgtgggtgatgtggtgtgctgctatgcccgctgcattaagcgcggcaatacctctgtgaccatcaatgtggaagtatgggtgaagaaagtctcatccgaacccattggccagcgctataaggccaccgaagcgctctttatctatgtggccgtggacagcgaaggtaaaccccgcgccctgccgccacagccctgaatcgaagacaataaaaaagcctctgtacagaggctttttttttggcccggcggcccgtcagtccatcgaggccccgccgttcagtcggaagacgatgttaacggtgatgccgttacccggtttgcccggctcataacgccatttacgcatcgcggttttcacttcccgctcgaacatattgcgcggcgtggcgtccaggatctggacattctctacgcgcccgtcggaggtcacgtcaaatttaacccgcacacggccttcaatacgcagcgcctgcgcgcgcgcaggatactgcggctcaccacgacttatcgcgcgcggaccggccggagtgttattcaccggtcggctttgcgccggcgccgggttggtcacggtacgcggcgctaagctctgtgctggcgcgctcggacgcggttccaccgggcgcatatcccgcttcggctgctcaacgcgtttttccggttttggcttcggcttcggtttgggtttcggctttggcttcggtttttcgatcaccaccggcgcttcttttggcggctccggaacgggttccggctcaggctctggttccggttcaaccaccggttccggcggcggtgccacctgtggcggctccagctcagcgggggtgaccatggtgacggagatgggctgcgagggcgcaggcagttcaataacctgttttacggaactataaagcaccacggccaccacagcggcgtgtacaccaacagacagcagcgtcggccaggcaatgcggcgaggcgtatcaaaggtcattgaagtcataatcgtatcagttaaaaaaccaggccctgattttaaatgcaaatagcaatcatattcaataagccatctcatctatcgcgcatttagtgcgttcatttcctgtaaatagcgcatgtaaatcaaggttattaacaccccggctaactttgcgttgcagtccagaatactttcacttaacgtaacccgcgactttacccattaaggagtttgcccgtgctttatgtgatttacgctgaagataatgctgattcgctcgaaaaacgcatgtcagtgcgtccggcacaccttgcccgtttgcagttgctgcgtgatgagggtcgtctgctgaccgcggggccgatgcctgcggtggacagtaacgatccgggcccggcgggctttaccggctcaaccgtcattgcggaattcccatcgctggaagaggcgacagcctgggcagatgccgatccgtatgtggcggcaggcgtctataagaaggtttcagtgaaaccgttccgcaaagtattttaaggcgcgaaacagtgggcaccggctggcggtgccctggggatcagaattcctgaaacgcaaacagcagcgaattacggtgatggttgagtaaacattttctgatcgagtggatgcgcatatttcgacgtgactgcccttccagccagcgcgccttacggcggctcgcctggcgaaccatacgccagcgccctacttccggtctactacgcttcatgatgacaactctttaataacgaagcccgcattatagacccttgcacgggccataccagcgcttttgtcggtggtttttatttgccagttgaatgcttacgcgtaaactcaggggattacgcattcaaaaggattttttatgacaaccttctacacgctggtgagttggctggtcattttgggatactggctcctgattgcaggtgtaacgttacgcatcctgatgaaacgccgcgtcgtcacctccgccatggcctggcttctggtcatctatatcctgccgctggtgggcattattgcgtatctctcctttggcgagctgcatctgggcaaacgacgcgccgaacgcgcccgggcgatgtggccctccaccgctaaatggttaaacgatctcaaagcctgcaagcatatcttcgccgaagaaaacagcgacgttgccgcatcgctgtttaaactgtgcgaacggcgtcagggcatcgccggggtgaaaggcaaccagctacagctgctcacctcttctgatgatgtgatgcaggcgctgatccgcgatattcagctggcgcgccataatatcgagatggtgttctatatctggcagcccggcggcatggcggatcaggttgctgaatcgctgatggccgccgcccgtcgcggcgtacattgccggctgatgctggattccgccggcagcgtgaattatttccgcagcccgtgggtcaatatgatgcgcaacgcgggcatcgaggtcgttgagtcgctaaaagtgaatctgatgcgtgtctttttgcgccgcatggatttacgtcagcaccgtaaaatggtgatgatcgacaactatatcgcctacaccggcagcatgaacatggttgacccgcgcttcttcaaacaggatgcgggcgtcggccagtgggtagatttaatggcgcgcatggaaggcccggtgtcaaccgcaatgggcattgtctattcctgcgactgggaaatcgaaaccggtaaacgcatcctcccgcctccgccggacgccaatattatgccgtttgagcaggccagcggacataccattcacactatcgcttccgggcccggctttccggaggatttgatccatcaggcgttgctgaccgcagtctattccgcacgtgaatatttgattatgaccacgccctatttcgtgccgagcgacgatctgctgcatgccatctgtacggcggcgcatcgtggcgttgacgtgagcattatcctgccgcgtaaaaacgactcggtactggtgggctgggcgagtcgagcgttcttttcggaactgctcgccgccggggtgaaaatctatcagtttgaaggcggcctgctgcataccaagagcgtgctggtggatggcgaactgagcctggtgggtacggtcaatctggatatgcgcagtttgtggctcaactttgagatcacgctggtgatcgacgacgccggtttcggcgccgatctggcggcggtacaggacgattatatttcgcgttcacggatgctggatgccagactgtgggttaaacgcccgctgtggcaacggatcactgagcgactgttttacttcttcagcccgttgctgtaaaacgtgcccaacagtggttaaccaggtagtcatcatggaaatggatctgaacaatcgtctgactgaagacgaaacgcttgagcaggcttacgacatttttctcgaactggcggtcgataacctcgatccggcagacgtgatcctttttaatttacaatttgaagagcgcggcggtgctgaactgttcgatccggcagaagactggcaggaacatgtcgattatgatctgaacccggatttcttctcggaagtggtgattggtctggcggataccgacggtggagagctgaacgatattttcgcccgcgtgctgctgtgccgggaaaaagatcacaagctttgccatattctgtggcgtgaataaactgcctatcaatgtaaaaagggctgacgagtgtcagcccttttttattacttctgtgccgggtggcgctgcgcttacccggcctgcacagaacctgtaggcccggcatgcctgcgcccccgggcaaggttttaagttacaggggatcaaccttcaggcacgacaccgcgtgctggaaactgccctccagcaccggacgggttttcgcgcattccggtccggcaatcgggcagcgggtgcggaaaacgcagcccgacggcggattgatcggcgacggcagctccccttccagcaactggatctgcttgtttcgctccagatccggatccggtaccggcaccgctgacatcagcgctttggtataagggtgcagcggattgtggtacacctgatcgtaagtgcccagctccaccgcgtgtcccagatacatcaccagcacacgatcggagatgtgcttcaccaccgccaggtcatgggcgatgaagatcagcgacagccccatttcacgctgtaatttttgcagcaggttcactacctgcgcctggattgacacgtccagcgccgacaccggctcatcgcaaataatcagcttcggctcaaggatcagcgcgcgggcgatgccgatacgctgacactgaccgccggaaaattcgtgcgggtagcggttgataaggttcggcaacaggccgaccttcagcatcatcgctttcacgcgctcgcgcacttcctggcgggaaattttcggctgataggtgcgcagcggctcggcgatgatttcgccgatggtcatacgcgggttcagcgaggccagcggatcctggaaaatcatctggatatcgctgcgcacatcgcgccactcttccggcttcatccccagcagatctttccccagccacgcgactttaccgtcggtggctttcaccaggccaataatggcgcgggcaaaagtcgatttaccgcagccggattcacccaccacgccgagggtttcgccttcatacagacgcagcgtgacgccatcaacagctttcagggttttggacggctgccagaaccactgtttaccgtctttgatgtcgaagtgcactttcagatcggcaatttccagcaggacttttctttcttcggtcagcgcattcataccagttcctccaccggcttaaagcaggcacgcaggcggcccggggcgaattcttccagcggcggcgcggtgtgacaaatttccatcgcatgcgggcatcgcggctggaacgggcagcccttcggcagacgcagcaggttcggcgggttgcccggaatggtcagcagcgcttcgccttcagcattcaggcgcggcacggcgttgagcaggccaatggaatacgggtgcgccggctgatagaacacattgcgcgccgagccgtactccatggtacgtccggcatacatcaccagcactttatcgcagataccggcgaccacgccgaggtcgtgggtgatcatgataattgcggtgttaaattcgcgtttaagctcgttgagcagagtcatgatttgcgcctgaacggtcacgtccagcgcggtggtcggttcgtcggcaatcagcagcttaggacggcacagcagcgccatggcgatcatcacacgctggcgcataccgccggaaaactcatggggatacatgcgcatacgcttacgcgcttccggcatttttaccgcatccagcatacgcactgactcttcaaaagccgcggctttgccgaggtttttgtgcagcatcagcacttccattaactgctcgccgacccgcatatacgggttcagcgaggtcatcggatcctggaaaatcatcgaaatttgttcggcacgcagcttattaagcgcctgctcaggcaggttgaggatctcgcggccattaaatttcgccgatccgccgatcacgccgttggaggccagcaggcccatcagcgcaaaggcggtctgggatttacccgaacccgattcgcccacgatacccagggtttcaccggctttcaggctgaagttcaggtcatttaccgccgtcacgtcgccgtccggagttttaaacgtcacccgcagatctttcacatccagcaggatgtcggaagtttgctgcgcctgagacgtcgatacgatttcagtcatgctcattacagcgctccttaacgatctttcgggtcgagggcatcacgcaggccatcgccgataaagttgaaacaaaacagggttacgaccaggaatactgccgggaacagcagcagccagggtgaaacttccattgagtttgcgccatcgctcagcagcgcgccccagctgctcagcggctcttgcgtgccgaggccaaggaagctcaggaaggattcaaacagtatcatgctgggtaccagcagcgaggcgtaaaccaccaccacgcccagcacgtttggcacaatatgacgtacgacgatattaaaggtggagactccgccaacctgcgcggcttcgatgaactctttacgtttcaggctcagcgtctgaccgcgcacgatacgcgccatatccagccaggacaccatgccgatagcaacaaagatcagcagaatgttttgcccgaagaaggtcaccagcagaataacgaagaacataaacgggaaggagttgaggatctccagcaggcgcatcatcacggaatccactttgccgccgagatagccggaaagcgagccgtataatgtgccaagcaccaccgccaccagcgcggcggcaatccctaccatcagcgagatacgcccgccgatagccacacgcaccagcagatcgcggccagaggagtcagtaccaaagtagtgacccgattccatatccggcgcgctggacatcatgccccagtcggtatcgaaataactgaactgcgacagcgccggggccagcgccacaaacagcgcaatcagcaccagcacaatcaaactggtgacggcggcgcggttatgcataaagcgacggcgcgcgtcctgccacaggctgcgcccttcgacttcaagcttctcactgaagttttccagcgcctcgctgtttttcttacttaacatcatggcgtactccagcgttagtaacggattttcggatcgataacggcgtagagcacgtcaacaatcgcgttaaacagaatggttagggttccgacaaggatcgtcaggctcagcaccagcgaatagtcgcggttgagcgcgccgttaacaaacagctggccgatacccggcagaccgtaaatggtttcgatgaccattgagccggtgatgatgccgacgaacgctggccccatgtaagagagcacaggcagtaaagcgggtttcagggcgtggcgcaggataatacggcgcatcggcaagcctttcgcccgcgcggtacggatgaagttggagtgcagcacttcaatcatcgatccgcgggtgatacgcgcaatactggcgatgtaggccagcgataacgccaccatcggcaggatcatgaattttggcgcgccgccgttccagccaccggctggtaaccatttcagcgtgatcgcgaatattaataccagcaacggggctaccacgaagctcggaataaccaccccggtcatggcaaagcccattactgtataatcccatttggtattttgtttgagtgccgcgattaccccagccgcgacgccaaaaatgacggcgaggaggaaggctgctgcgcctaatttcgcggagaccgggaagctcgacgccaccaaatcgttaacggagtagtctttatatttgaaagacggtccgaaatccccctgcgccagctgtttcagatagctgaaatactgcgtcatgatgggatcgtttaaatggtatttcgcttcgatattcgccatgacttccggcggcagcgcgcgctcgctggtaaagggactacccggcgcaagacgcatcataaagaaggagatagtgataagaattaagagtgtcggaattgcttccagacaacgacgtaaaataaatttcaacattgcccgtaccttctggcctgtgcctttgcgtgcgatgaattaagacacgatggggcaaaacgtaaccgtcaaaaaatacggtgacgccctgccccacgaattgccattaatgtttgataacgtagagatctttagcgtaaacgttatccatagggtctttaccggaatatccgccaacccatggtttcaccagtcgggcgtttacgtagtaatacaccggaacgatggcagagtctttgccaagctgctgctctgctttgtcatacagcgcgctgcgctgcgcttcatcggccgctttcacggattcagccatgatgctgtcgaatgccgggctcttatagtgcgcggtattcattgagctgccggacagcatggtgttcaggaaggaagtcggttcgttgtaatccgcacaccagcccgcacgcgccacgtcgtagttaccctgatgacgggtatccaggaaagttttccactcctggtttaccagcttgacgttaacgcccaggtttttctgccagatggacgaggcggcgatagccagcttcttgtgtagatcggaggtgttatacagcaggttgaaggacagcggcttatctttggtatagcccgcttccgccagcagttttttcgcttcttcgttacgtttttcctgggtccaggtgaaccactccggcttggtcagtttcgcaccatccgcatacggcggcgtataaccgaaggctggcagatcgccctgcgctttcactttattggtgatgatatcgcgatccaggcccagtttcagcgcggtacgtacgcgagcatcgttgaacggcgctttctggttgttgatttcgtaatagtaggtgcacagatacggatcaacgtgaacttcctgcgggatctcttttttcagtttctggaagagttcaatcggcaggttgttataagtcatgtcaatctcaccgctgcggtagcggttcacgtcggtgacttcagacgagattggcaggaaagtgatctggtcgagaacggtttttgcgttattccagtagttggtgttacgcaccatcacgatacgttcgttaaccacccagtcctgcaatttaaatgcgccgttggagacgatatttgcaggctgcgtccatttttcaccgaatttctcgatcgcggttttgttcaccggcgacatagccgggttaaccagcagtttatagaaataaggcactggctcgctcagcgtgacttccagcgttttgtcatcaatggctttgacgcccagctcgctcggcttcattttgccgtcgatgatcgcatcaacgttaagaatatgaccgtactgcgggtagcttgcgtatggcgaggcggtgtttggatccaccagacgctgccagctgtagacgaaatcctgtgcggtgacaggctcgccgttggaccatttcgcatctttacgcagatggaaagtccacactttaaaatctttgttttcccatttttcagccacacccgggattggatggccgtcaaccggagacgtgatcagcagaccttcaaacaggtcgcggctgacgtttgactcaggaacgccttcgattttatttggatcaagggattgtggttccgcgccgttattacgcactaaaacttgtttctctgccagctgaacgcccgctggcacatccgccgccatagcaacattgccggcgatgagtgcagtcaggatccctgccgcgattaggcttttctttgtgatgatggacattgtgttgtgactccgatcattataattactggtgcgaacaccagcctgtttcatacccgttaagggttcctgtgcagtgcaggagtttttgctaccgccaggcgttttttgctttttgctatcaccgactttcattattaccggcagctcgtatggcagccttctgtcgattttcgcgcatttcccctgttctgaaatgcgtctgttctgtccggacgagggttatatgaaaatgattctcatctttattattcgtccacaaaatataaggccggaaagtaccaaaagcgctgatccctcgccaatacattttgcaaatttgttaagcaattctcttttatggcagatggcgggcggtcaaagacgggagttgatgttgcgtgtacatcagtaaactttttaagttcagtcgcttaccgcgttgctacttcgtccttgctgctttgtcgtgacattgattgttttttacacaaaaaagtaacaattggcgactaattagcacattcatctgcctggatgatgaaattactaatatcatttcaattatctgacagcaagcccaagagtatcatgtgaggaaaataacacggcgactgcgtttataatgaccacccccgaacggaggtggcgggtaactaaatgaaattcatggattaatagtaaacagtactatttattatatttgatgtaattttcaactttagttataagttttactgataatgaaaaacatcaggcgagcagccctggaaacagcgctttaataccggtaacaataaattcaatccccagcgccatcagcagcagccccataatacgcgtaatgacgttaatgccggtttgccccagcaggcgcaccagccagggcgctatacgaaagacgccccaacagcacagcgcaaaaagcgcaatggcgacagaaaagcacagcagatgcatccagttgtgataacgcgtgccccagacaatagtggagctgattgcccctggacctgccatcaacggcaatgccagcggcacgacgccaatgctttcacggatcgccgtctccgacttctcctgcttattctgtttatcttccccaagcttaccgctgatcatcgacatcgcaatggttaccaccagaataccgccagcaatgcgaaacgaatcgatggaaataccaaagagttgcagaatgccgttaccgagaaacagtgaggtcagcaggataatggcaacagacaggttggccgtcagattggttttgttccttgccgccgccgtctggtaactggtcatactaatgaagacgggaataatccccaccgggttaaccagagcaaataagccaataaaaaattttgagtaggttggaaaatcaaacaacgtctggatcacggtcggctccgcatagtggcaaggctgatggcaaaagtccctgtaaaaaccgtgctgaagatacgctttttgtcagcatagttcaccaggaaaatcattaaaaacattactatcccgggatgttagaaaattgtactaattattataatctccagggagtcttcccctgattccataacaattattgtacatcacgaaaaagagcctgctgaaaggtgtcagcttgggtaaaacttgatttagatcacgatttcactactcagaagtgagtaaccttgattacgccgccagggagaacagcgtcaagcgggttcgatgcttaggtaaggctcttttagtaaatcaggggcgcagttttgaatttaagttgttgtaagtaaacactttctcaggctgttgttggtcttgactatactgacgtgttagcagctgatttactaaaagagtttaacattatcaggagagcattatggccgttactaatgtcgctgaacttaacgcactcgtcgaacgcgtgaaaaaagcccagcgtgaatatgccaactttactcaagaacaagtcgacaagatcttccgcgccgccgctctggccgctgctgatgctcgtatcccgctggctaaactggcggttgccgaatccggcatgggcattgttgaagataaagtgatcaaaaaccacttcgcttctgaatatatctacaacgcttataaagatgaaaagacctgcggcgtgctgtctgaagacgacacgttcgggaccatcaccatcgccgaacctatcggccttatctgcggtattgttccgaccactaacccgacttctactgcaatcttcaaatcgctgatcagcctgaagacccgtaacggtattatcttctcgccacacccgcgcgccaaagacgctaccaacaaagccgccgacatcgttctgcaggctgccattgctgccggcgcaccaaaagatctgattggctggattgaccaaccctccgttgaactgtccaacgcactgatgcatcacccggacattaatatgatcctggcgacaggcggcccgggcatggttaaagccgcttacagctccggtaaaccagcaattggtgtgggcgcaggtaacacgcctgtggtggttgatgaaaccgctgacatcaaacgtgctgttgcttctattctgatgtccaaaaccttcgataacggcgtaatctgcgcgtccgaacagtccgttatcgttgtggattccgcctatgacgccgtacgtgcacgctttgcgagccacggtggttacatgttgcagggtcagaaactgaaagccgtacaggacattatcctgaaaaacggcgcgctgaatgccgctatcgttggtcagcctgccaccaaaatcgcagagctggcgggcttcaccgttccggctgataccaaaattcttatcggcgaagtgtctatcgtcgacgatagcgagccgttcgctcacgaaaaactgtccccgacgctggccatgtaccgcgcgaaagattttgaagacgccgtggttaaagccgaaaaactggttgagatgggcggtatcggccacacctcctgcctgtataccgatcaggataaccagccggaacgcgtcaagttctttggcgataaaatgaagaccgctcgtattctgatcaacacccctgcttctcagggtggtatcggcgacctgtacaactttaaactcgcgccttccctgactctgggttgtggttcctggggtggtaactccatctctgaaaacgttggtccaaaacatctgatcaacaagaaaaccgttgctaagcgagctgaaaacatgttgtggcataaacttccgaaatctatctacttccgccgtggctccctgccaatcgcgctggacgaagtgattactgatggtcacaaacgtgccatgatcgtgactgaccgcttcctgtttaacaacggttacgctgaccagatcacctccgtgctgaaggccgcaggtgttgaaactgaagtgttctttgaggttgaagctgacccgacgctgtctgtggtacgtaaaggcgctgaactggcgaactccttcaaaccagacgtcatcatcgcactgggcggtggttccccgatggacgccgcgaaaatcatgtgggtcatgtacgaacatccggaaacccacttcgaggaactggcgctgcgctttatggacatccgtaaacgtatctacaagttcccgaaaatgggcgtgaaagcaaaaatgattgcggtcaccaccacctccggtaccggttctgaagtcacgccgtttgcggttgttactgatgatgccaccggccagaaatatccactggcagactacgccctgaccccggatatggcgattgttgacgccaacctggtgatggatatgccgaagtcgctgtgtgctttcgggggactggatgccgtaacccacgcgctggaagcctacgtttccgtgctggcgagcgaattctctgacggtcaggctctgcaggcgctgaaactgctgaaagagaacctgccggcgtcttacaacgaaggttccaaaaacccggttgctcgcgagcgtgtacacaatgctgcaaccatcgccggtatcgcgtttgcgaacgccttcctgggcgtgtgtcactccatggcgcacaaactgggctcgcagttccacattcctcacggtctggcgaacgccctgctgatctctaacgttattcgctacaacgcgaacgacaacccgaccaagcagacagcgttcagccagtatgaccgtccgcaggcacgtcgtcgttacgctgagatcgcagatcacctgggcctgagcgcaccgggcgaccgcaccgctgcgaagattgaaaaactgctggcatggctggacagcatcaaagctgaactgggcattccgaagtcaatccgcgaagccggtgtacaggaagcagacttcctggcacacgtagacaaactgtctgaagatgcattcgatgaccagtgtactggcgctaacccgcgttatccgctgatctccgagctgaaacagatcctgctggatacctactatggacgtgagtacaaagaaggtgacaccgcagctacagcaacagaggctgtagcggtgaaagcagacaaaaaagcgaagaaaaccgcataactcctcgcttaaatgaaaaacccgcctgatggcgggtttttttatggcctgagaggcgctctgtgacgttttaacggctaaataggccctacccccgcacccgcttctggatcaccgtcagcgagccctcagcaagcgcatccttatagtgcttacggcacacggaaacatagcgttcgttgccgcctatcaccacctgctcgccttcgttgtacggacgccccgcctcatccaggcgcaataccatactggctttacggccacagaagcagatggtttttaattccaccagtttgtcagaccaggccagtaaatactggctaccgacaaataactccccgcggaaatcggtacgcagtccgtaacagagtacgggaatatcaagctgatcgaccacttccgataaatcatgcacctgctggcgggttaagaactggctttcatccaccagcacgcaatgtacgggcttacgcgcgtgctcagcgcttatttcatcaaagagtgaagactgctgattaaacaatttagcaggggaagagaggccgatacgcgagctgactttgccggagccgaaacggttatcgatttccgccgtgtagaccaccgcgcgcattcctctttcctggtaattgtaggaagactgtaacaatgcggtggatttacccgcattcattgctgaatagtagaaataaagctgtgccattggccgccacaccccgatcaaagtaaaaatatttcagggcgggatagtaccatattttatctggtcatcactgcgtcgacgcacaaacagcgtgtcgccgcccctgcgctttatccgggatatacaacctgagcattttggccgctgttactgccaaagaaacgtcagcgctattcacaataagtcacattttatgctttttttaaaccccttcgcttttagttatggttcagaaattattaatgatttgcgcttacgtggtggcgaagcgactaatagaaaaggttgatatttatccacagcggctttaacaccttgcggattaatcgtaaattcaccctgcctgcacgcggcgaggcggcatgatacttcgtgtggataagctatttttgcgaggcgtctcgtaaaaaatttaagatagcgcaattaataaagaggataaataacggctgattttgaattccttacattgtcagctattgcacaacgcaaattaacgctctattattagctcaacaaaccaccccattataagtttgagattactacaatgagcgaagcacttaaaattctgaacaacatccgtactcttcgtgcacaggcaagagaatgcactcttgagacactggaagaaatgctggaaaaattagaagttgttgttaatgagcgtcgtgaagaagaaaacgctcaggctgcagaaatcgaagaacgtacgcgtaagctgcaacaataccgtgaaatgctgattgctgacggtattgatccgaacgaactgctgaacagcatggctgccgctaaagtaggtactaaagctaagcgtgctgcacgtccggctaaatatagctacatcgatgagaacggcgaagaaaaaacctggaccggccagggtcgtactccggctgttattaagaaagctatggatgagcaaggcaaaaaactggaagatttccttatcaaaggttaatcacctgccccttgctgaaatcccgccgctggcgggattttttttgcctgcaaattacccctgcccgttacctgttatcacattaccccgttctgtttactggtgaaaaaccaggcatcccatacccctgttttcttaatggccgccgctaaataactgcgctggctggttgcgcaaacaatgaatataggggcagaaacaatcagcaataaaaaagccggagacactccgcaggtggcggcgttatctccggctcagttaaagcccgggtattagcgctttacttcttaaaacccatggactcttccagccaggttttaaattcttcgccatgtgctttgtgacgaataccgtattccacgaaagcctgcatatatcccagcttattaccgcagtcatggcttttgcctttcatgtggtaggcttcaacggtttccttctcgatcagcatatcaatgccgtcggtcagctgaatttcatcaccggctcccggaggcgttttcgccagcagtggccagatttctgcgctcagaacataacgccctacaacagccagattggaaggcgctacgtccgctttaggcttctctaccacgcctaccatcggcacgctctcgcccggtttcagctccgcgcctttgcagtcaaccacaccgtaagcggtcacgtcttctaccggctcaaccatgatctggctgcagcctgtttcatcgaaacgctggatcatctccgccaggttatcctgcgagagatcggattcaaattcatccagaatcacgtcgggcaggatcactgcaaccggctcattgccgacaaccggatgcgcgcaaagtacggcgtgtccaagacctttcgccagaccctgacggacctgcataatagtcacgtgcggcgggcaaatagactgaacttcatccagcaactggcgcttaacgcgtttttccagcatggcttcaagttcaaaactggtatcgaagtggttttcgatagagtttttagaggagtgggttaccagtacaatttcggtaatacccgcagcgatacattcatttacgacatactgaattaatggcttgtcaaccagcggcaacatctctttcgggatcgccttggtggctggcaacatcctggttcctaatcccgcaaccgggataactgctttcgttacttttgaattaagggcagccattgaaaatctcctggaatgttcacattgggaacatgtacataatgaatcacgcgttagagtatatcagcccggagctgtgagccgggtccgaaatgaacgcattgaggcttaattaagacaattacttataatactgcgcagatagtaacacccggagagaacggcaggtaaagctaaatcaccctgccgttgcgtttgctcattcggcagtcaacattaaacgtaaccgaccgcctgcgccccaaacctgacactgccatgcttcgctgcgatggctgacctggtttaaataggtatttcccagcgtacccagcggaacgccgttgctaatctgaatttgatgctcaccggtattaagcgtggcattaagaccggccgacaccagaatgagatttttaagctcatggtggtaatagccaaccagtagcggaaactgccctggtaaatttgcctggcgcagtaattgattaacctgctttaacaaacttcccagttcaggcaaacgctgacgctgatgagagagctgttcctgtaataagccgttaaacaatgcccgcagcaataatgcggctaacacaccgttatcgccggcgcgggtgacatccaggcaataaaatgcgaggtctttttcagagagtgctgcaatatcgagcaccagacccggctgatcggcagataccagctggcgataattaatacggcaatttgagatatgttgctgaaccggaggctgtaactcctgcaacaatttggcggcggcctgcggatcgcttaccagcgcatcccagtcctgaaaaaggcgttcttcttcctctacccgggaattaaacatattgggatagaggcaggcataaaccgtttcacgtaaacggttcagatcttttaccggtttcagtaatacatcctgtacgcccagacgtaaagcacgggcaatgtcggacatattttctgtcgctgatataaccaggatgggcatctggtcgcgctcattgcgcaaatgttccacgagtttcagaccgttcattcgtggcatggcaagatcgcaaatcattaaatctggtctcaccgtcttcatggtctcaagcgcatcgaggccatccatcgccagtgaagtagttgcgcctaaagaagtgagccatgaatccaacagtgaacggaaaacgggttcgtcctcaacaatcaaaatatgttttccagtcaaaggctgcgtcatgttctctcccctgctttgcagtagttcaatagtggcatgctattgcaactcgcgcctgtcagaatttcctgaagtcatcgaatatatttttcgctaaaccgcgccggaaagatgtagcttaccgtgcggttcccctttagctccggatgcgttacacaaaagctctccttgtccgcgtgagacaactggcggagacaagtgaacctcatagggttagcaaaacgtcggatacgttgtcgggaatgccgttgtgtgtaaaccgatgcaggaagacctgaagaggattgcacagctttgcgacgccgtcagggccaacaaactacaccttaatgcctcgcgactaaaccttttacgccctaaatcgttgattaaaccactggcgaacccgtcgccagtccagcctcacctttgctcgtgacgttttttacatccccggcttccagccatagcatcgaggctatcgctcggttaacatagatgcatccatgcgccgttgcgccattattattccaggattacgattttgtctcaaccttgtccctgcggtagcgctcaggagtatagcgcatgttgcgcacgttatgtgtctggtgaacagcttgcgccggatccgtcacatcttatgcgctcccgctatagcgcatttgtattaaaagatgcggattatctgatcaaaacctggcatccgtcgtgtcatgctgccgcctttcgtcaggacatcgaaaagggctttgcgcaaacggaatggcatggcctgacggtttacgcgcacgaagctggtgcaacccaagatgaaggctatgtcagctttgtggcgcgttttagcgagcagggtaaacccggcgctatcattgaacgctcacgtttcctgaaggaaaatggtcagtggtattatatcgacggcacgcgcccactgtttggccgtaacgatccctgcccttgcgggtcaggaaaaaaattcaaaaagtgttgcgggcaataaacccagcttcaccctcatgcaaactcaacaggattttcgcggcaatgcattcattacaacgtaaagtactgcgcactatttgtcccgaccagaaaggtcttatcgcgcgcatcaccaacatttgttacaagcacgaactgaacatcgtgcagaataacgagttcgttgaccatcgcaccggacgcttttttatgcgtaccgaactggaaggcatttttaatgatgccacgctgctggccgatctcgacagcgcgctgccggaaggatcgatccgtgaactgacgccggcaggccgccgccgcgtggtgatcctggtgactaaagaagcgcattgcctgggcgatctgttaatgaaagcgaattatggcggactggacgtggaaattgccgcggtgattggtaaccacgataccttacgctcgctggtggaacgctttgatattcctttcgagctggtcagccatgaaggtcatacccgtgaagcgcacgatgaattaatggcggccgccattgaagcccatcagccggattacgtggtgttggcgaaatatatgcgcgtactgacgccgacttttgtctcccgcttcccgaataagatcattaatattcatcactcgttcctgcccgcctttatcggcgcgcgcccgtatcatcaggcctacgagcgcggcgtgaagattatcggcgcaacggcccactacgtgaatgataatctcgacgaaggcccgatcatcatgcaggacgtgatccacgtcgatcacaactataccgcagaggatatgatgcgcgccggtcgtgacgtagagaagaatgtgctgagccgtgccctgtatcaggtgctggcgcagcgcgtgtttgtttacggcaaccggaccatcattctgtaagcggtaatgaaatgaattgcttagcattgctgcatgacgcataaaaagcaggcaaacgattcattttcacgaaaggaatgctttacagcggcgcgtcatttgatatgatgcgccccgcttccccagcggaggcaggccagtaccagtattaccccgtggtggggttcccgagcggccaaagggagcagactgtaaatctgccgtcatcgacttcgaaggttcgaatccttcccccaccaccatctcttctcaaaatttgaattacccctggtggggttcccgagcggccaaagggagcagactgtaaatctgccgtcatcgacttcgaaggttcgaatccttcccccaccaccatctctgtttcatcccctcataattaaatcaaacaccgacaatatgctttttgcccggtggcgctgcgcttaccgggcctacgaatatcctccaaagatttccctgtaggccggataaggcgtagccgccatccggcgcaacgcaaacaaaaaaccccgcctgagcggggttataacggcgctgaatgcgtgcttagcgacgcgcgcgcactacctgatacttacgcgtcaaatactctaccggtgcgctccagatgtgtaccaggcgcgagaacgggaacaggacgaacagcgtcatgcccagtaccagatgcacacggaaaataaaggccacgccgtccagatgcgcagatgcgccgccgtggaaggtcaccaccgattgcgcccagcccaccagtttcatcatttcactgccgtccatatgctgcgccgagaacggaatggtcagcaggcccagcgcgcactgcaccatcagcagggaaaggatcagaatatccgccccggtggtggtcgcccgtacgcgcgggctgaacaaacggcgtttcagcagtagcaggccgcccaccagcgtaagcacaccacatgcgccgccggcgatcatcgccatcttctgcttcacgtcaatcggcaggaaagattcatacatccagtgcggcgtcagcatccccagtaagtgccctgcaaaaatgccgagaataccgatatggaacagattagacgcaagattcatgcccttgcgatccagcatctggctggagcctgcccgccaggtgtactgaccatagtcataacgcagccagctaccgaccaggaagacggtccccgcaatgtacgggtagatgtcaaagaagaacatattcaggaaatgcattattgctgccccccgttagaaatattcagatactgcggagcgacagcccccgcaaaacgacgctgatgggcgctgatctccgactcgccacagctctgttcagcaaagaatttcacctgctcttcttcccagacggcgtcaagcgcctgcggggtgtcatcacgggcttcaccggcgattttctcggccactttgtcgctgtcaatggtggtgttcgccagattcagcagcacgccgaacagcgtcgcgtacgggctttcacgctgttgcagacgcgcacttaacagcgcgaggatcggggcgatgtcctgcaagccacccagcgcctcgtcttttggcaactgcgccagatattccagatacagcggcagatgatccggcagttcgcggctgtcgagctgcagaccgtggcgctcatactgcgccatcagatccaccatcgcctggccccggtcgcgggattcaccgtgcacatgctcgaacagcaacagcgaggtcgcgcgaccacgatcgaaaagttcgctgtagcgtgactggacatccagcatgtcctgctgcgtcaaatcacgcagaaagaccgtcagcgcctgagcgtcgcttttctcaagattttcagaggaggcgaaaccatcaaataattcctgctgatgctgccacagggcagcatccgggtattccagcaggcgggaaatcatcaccagttcgatcatgggtgcggctccgttttgctggtcacatcgaccgcgtcgatgcgacggctgttgaacaggttaaaggagctgtcagatccgtggcagccatcgccaaaggtaaatccacagccgcttttttccgggaaggcatcgcgcgccagttcacggtgactggacggcaccacgaaacgatcttcgtagttggcgatggccagataacggtacatctcctgcgcctgggcttcggtcagccccacttcttccagcgcacgggtatcgagcacgccgtccacggtttcagcacgtttgaagtgacgcatcgccagcatacgtttcagcgccagcagtaccggctgggtgtcgcctgcggtcagcaggttcgccaggtactgcaccggaatacgcagactgtcgacgtccggcagaataccgttgctgctcagctcgcccgcatcggcagcggactggatcggtgacagaggcggcacgtaccagaccatcggcagcgtgcggtattccggatgcagcggcagcgccagcttccagtccatcgccattttgtacaccggcgagttttgcgccgcgtcgatcacgctctgcggcacgccgtctttcagcgcctgggcgatcactgccggatcgttcggatcgaggaacacatccagctgacgctgatagagatctttttcattctcggtgcttgccgcatgttcaatggcgtccgcgtcatacagcagcacgccgagataacggatacggcccacgcaggtttcagaacacaccgtcggcataccggcttcaatacgcgggtagcagaaaatgcacttctcggatttaccgctcttccagttgaagtagatctttttgtacgggcagccggtgatgcacatgcgccaaccgcggcatttatcctggtcgatcagcacaatgccatcttcttcacgcttatagatcgcgccgctcggacaggtcgccacacacgccgggttcaggcagtgctcgcacaggcgcggcaggtacatcatgaaggtgttttcgaactgaccgtacatcgccttctgcatgttctcgaagttctgatctttggcgcgcttttcaaactcgccgccgaggatctcttcccagttcgggccgtgctcgattttgttcatacgctggccggaaatcagcgagcgcggacgggcgatcggctgatgtttgctttccggcgcggtatgcaggtgctgataatcgtaatcaaagggctcgtagtaatcgtcgatgcccggcagatgcgggttagcgaagattttacccagcagcgtcgcacggttacccatgcgcggctggattttgccgttgattttacggatccagccacccttccatttttcctggttttcccagtcattgggatagccgatgccgggtttggattccacgttgttaaaccacgcgtactccatgccttcacggctggtccagacgtttttacaggtgactgaacaggtatggcagccgatgcatttatcaagattcagcaccatgccgacttgtgaacgaattttcattttacgctctcctgtacctggtcgttgccttcgccatccagccagttaatatttttcatcttacgtaccactacgaattcatcgcggttagaaccgaccgtgccgtaatagttaaagccgtaggccagctgtgcatagccgccgatcatatgggtcggtttcgggctgatacgggtgacggagttatgaatgccgccgcgctgaccggtgatttccgatcccggcaggttcacaatacgttcctgcgcgtgatacatcatggtcatgccggacgggacacgctggctcaccaccgcacgcgccgtcagcgcgccattgctgttgaagacttcgatccagtcgttatcctcaatgcccagatctttggcgtcgctctcactcatccagacaatcgggccgccgcgtgacagggtcagcatcagcaggttgtcgctgtaagtggagtgaatgccccatttctggtgcggcgtcaggaagttcagcgctttctccggattaccgttggatttcttgcccatcaccgcttttaccgagcgggtgtcgatcggcggacggtacaccagcaggctttcgccgaagtcacgcatccactgatgatcctgatacagctgctgacggccggacagcgtacgccacgggatcagctcatgaacgttggtgtaacccgcgttataggagacgtgctcgtcttccaggccagaccaggtcgggctggagatgattttgcgcggctgagcctgaatatcgcggaagcggatcttctcttcctctttattggtcgccagatgcgtatgatcacgaccggtaaactcactgagcgctgcccaggcttttaccgccacatgaccgttggtttccggcgcaagtgtgaggatcatttctgcggcgtcaatggccgtattcagcatcggctggcctttggccgggccgtccgctttggtgtaattcagcttacgcagcaaatccatttcgctctgggtattccaggcgatgcctttgccgccgttgccgattttctccatcaacgggccgatagaggtgaagcgctcccaggtggccgggtagtcgcgttcaaccggaataatgtgcggcgcggttttacccgggatgagatcacattcgccttttttccagtccttcacatccagcggctgcgccagttcggcggcagagtcgtgctggattggcagcgtcacaatatctgtctctttaccgagatggccgacgcacacttcagagaaggacatcgcgatgcctttatagatttcccagtcgctttttgactcccacgccggatcgacggccgcagacagcggatgaataaagggatgcatatccgaagtattcatgtcgtctttttcgtaccaggtggcggtcggcagcacgatgtcggaatagaggcaggtgctggacagacggaagtcgagcgtcaccaccagatccagtttgccgtcgagaccgttatccacccattccacttcttccggcttaacgctgccctgctgaccgagatccagcccctgaatgccgtgctcggtacccagcaggtacttcagcatgtattcatggcctttaccggaagagcccagcaggttggagcgccagacaaacaggttgcgcggatggtttttgccgttttccggctgctctgccgcgaaacggatggtgccctctttcagcgccttcacggtgtaatccaccgggttcatcccggctttttccgcttcggcggcgatgcgcagcgggttggtgcctaactgcggtgcagatggcagccagcccatacgctcggcgcgaacgttaaagtcgatcaggttgccgctgtagcgggatttgtccgccagcggtgaaagcagctcctgcgcggtcagcgactcatagcgccactggctggagtggttatagaagtacgaggtgctgttcatatgacgcgccggacgctgccagtcaagggcaaacgccagcggctgccagccggtctgcggacgtagtttttcctggccgacatagtgtgcccagccgccgccgctctgaccgatacagccgcagaaaatcagcatgttgatcaggccacgatagttcatatcgaggtgataccagtggttcagtccggcgccgacgatgatcatagaacgaccatgggttttatcggcgttatcagcaaactcgcgggcggtacggatgatctgcgcgcgcggcacgccggtgatttgctcggcccatgccggggtataagctttgacctcgtcataactggtggcgcagttggcatcgtccaggccacgatcgaggccatagttcgccagcgtcagatcgtaaaccgtggtcaccagcgcggtgctgccgtcggccagttgcagacgtttgaccggcagtttatgggtcagcacgttgtccagcgccacgctgttgaagtgctcggtgccgtcgccgccaaagtacgggaagccaacgtcagcgatgtcatcgtgattgccgagcaggctcagacgcagatgcgcctcgtcaccggttgtgccgtcgcgctgttcgaggttccacttgcctttctcgccccagcggtaaccgatggagccgttcggcgcgatcagttcgtcgttgtcgttaacggcaacggttttccattccgggttattttcctggccgagggcatccaccagatcggcggcgcgcagcatacggcctgcggcgtagtaaccttcacgctcttccagcatcaccagcatcggcatgtcggtgtaacggcgcacgtaatcggtgaagtactggcttgggttatcgaggtggaactcacgcagcatcacgtggcccatcgccagcgccatcgcggcatcggtgccctgtttcggggccagccacaggtcgcacagcttggcgatttccgcgtagtccggggtaatggcgacggttttggtgcctttgtagcgaacttccgtaaagaagtgggcgtccggagtacgggtttgcgggacgttagagccccaggcaatgatatagctggagttataccagtcggcggattctggcacgtcggtctgctcgccccaggtctgcggggacgcaggcggcaggtcgcagtaccagtcgtagaagctcagacaggtgccgccaatcagcgacaggtaacgcgcgccagaggcataagacaccatcgacatcgccgggatcggcgagaagcccgcgacacggtccgggccgtaggttttcacggtatagacgttagaggcggcgatcagctcgttcacttcctgccaggaggagcgcacaaagccgccgcgaccacgcgcctgtttaaaacttttggctttttccgcgtcttcaataatcgatgcccaggcattcaccggatcgctgtgacgggctttcgcttcacgccacatcttcatcagacgtttacgcatcagcgggtatttcaggcggtttgcgctgtagagataccaggagtagctcgcaccacgcgggcagccgcgcggttcgtggttcggcatatccggacgggtacgcgggtaatcggtctgctgggtttcccaggtgaccaggccgtttttaacaaaaatcttccagctgcaagaaccggtacagtttacaccgtgcgtggagcgcaccactttgtcgtgcgaccagcggttacggtatccgtcctcccagtcccggtttgattcatgaatctggccatgcccatcggcaaaggtttcgcccttctgtttgaagtagcgaaaccggtccaggaatttactcatcgggtttctcctgtaaggagcctgtgcggctctctggtaaatcgacattgctgcaagttgcggcgaaggtaacgcgctgaatgatgacgggaattgatggcgatcaaggcacaccggcttagttatggcggtcgttaaacgccataccaccaaagggggataacctggattttcataacactttgaaatataacgtatttttaaattaacccgtaattttactgtcgatattcagccatgcggggtattagggggtagatgatttcaccctgtgacgccgcgcaacgtttttccacggtgcaacgggtgaaaaattaaagtatgttgtaactatatgaggggtaaaaaaagcgcggcgaggccgcgcaaggataatcaacagtacttactttttattagaattacggccatacaccgcccaggtgatgatcacacaggcgacatagaacacgaggaacactttcatggcatcggccggggaaccggtcagcgccagcgaggtgccaaaggctttcgggataaagaagccgccgatcgcgccaatcgccgagataaagcccagcgcggctgcggtgtcggttgccgcttcgcgcagcgcctgggcatcatcgccgccctgcgctttcacgcgctcaacggtcatcttgcggaaaatcaccgaaatcatctggaagctggaaccactccccagcccggccgtcaggaacagcaccataaacacgccgaagaaggcttcgaaatgaccggcgctggtcgccgtcggcagcgtcaggaacagcagcgcgctgaaaatggccataacgatgaagttcaccagcgtgacgcgggtcccgcccagacgatccgacagcgccccgccacaggagcgggcaatggcgccaatcagcgggccaaagaaggcataatgcagcacattaacatccgggaactgggttttcgccagcatcgcaaatccggcagagaaaccaataaaggagccgaaagttgccagatacaggaagccgaggatccacagatgggcgcgttttaataccggtaactgcgcacggagcgaggccttcgaggtcgccagctcgttcatgccgaaccaggccgcgagggtgaagaccaccaggaacggcacccaaatccatgcggcgttttccagatacagacgcgaaccgtcggcctgttcaacgcctgtgccgccaaaggccgcgaaaatggacatggagatcgccagcggtgccaccagctgcatcacgctcacgccgaggttgcccatgccgccgttaatgcccagcgcgccgccctgcttctctttcggatagaagaagctgatgttcgccatgctggaagcaaagtttgccccggcaaaaccgcacagcagcgcaatgatgatgaaagtactgaacggcgtggtcggatcctgcaccacaaaacctaaccatacgcagggtatgatcatgatcccggtgctgaacgccgtccagcggcggccaccaaagatcggcaccataaaggcgtaaggcacacgcagcaacgccccggatacggacggcagcgcggttaacataaacagctgatcggtcgtaaagttaaaacccactttattcaggtttaccgcgaccgcactaaacaacatccacacgcaaaacgccagcagcaggcaaggcacggagatccacaaattgcggctcgccacacgatggcctttttgttgccagaaagcaggatcttccggacgccattcagtaatgacggatccggtagccctttcaggaacggaagagtgactcatagacacctctgataatcaattcaacgcctgccaccttagggtttacagcggcgcttaagttgatataaatcaaaggaaaagttgacggtcagcggcacaaaaattaaccctactccctaatgggcacttaaaagcgtcaaaaatagtgtggtttttcacggcgctgtaggtattcgccgcatgcatggatctttgtcatccggcatgggcaataaagaggtaactctttttaggtatgggtatactccggggtatgtccgacaataccgcctcactcgcacctgtcccaggtctggagctgccctgacgatgttaaaacgcctgttttctcccctcacgctggttaatcaactggcgctgatcatgctgctgtccacccttatcggcgtgacgggcatggcgatttccggctcgctggcgcagggtgtccagggcagcgcccatgccatcaataaagccggttcactgcgaatgcagagctaccgcctgctggcggccatcccgttgactgctgacgatcagccgctgctggatgaaatgtcgaagaccgccttcagcccggagctggcgcaggccgctgtgcgtgacgaccaacaatcacagctgatcgccctgcaaaatttctggcgcagcgatgtcgagccgggcttaaaacgcgcccgcgaaccgcaggaggtttccgcggaaatcgccacctttgttaatcgcattgatatgctggtgaccgcttttgatcacagtaccgaacagcgtattgagcgcgtggtggtgatgcagtgggctatggcggcggtgatgggttgcctgctggtattcactattgtctggctgcgcgcccgcctgctacgtccgtggcaacagctggtgcgcatggcgcgggcggtcagccaccgggatttcacccgccgggcgaatatcagcggacgcaatgaaatggcgacgctgggcatggcgctcaataatatgtccgcggagctggcagaaagctacgccgtgctggagcagcgggtgcaggaaaaaaccgccgggcttgagcaaaaaaatcagatcctctccttcctgtggcaggccaaccgccgcctgcactctcaggtccccatgtgcgagcgtatttcgccggtgctgaacggcctgcaaagtctgacgctactgcatgatatcgaactgcgtatttacgatattgaagatgaggcaaaccaccaggaatttacctgccagtcggacgccagctgcgacaatatcggctgcaatctctgcccacgcagccaggaagcgtcccccgcagggggtataaccctcaagtggcggctggcggatgcccatatgcaatatggcctgctgctggctcagctgccgccgggccgtcatctcagtcacgatcagcaacaactggtggatacgctggtggaacagctcaccgccaccctggcgctggagcgtcatcaggagcgccagcagcagatgatggtgatggaggagcgcgccaccattgcgcgggaactgcatgactccatcgcccagtcgctctcctgtatgaagatacaggtcagctgtctgcaaatgcagggggatacgctgccggaaaacagccgccagctgctgggtcagatccgcaatgagctcaatacttcctgggcgcaactgcgggagttgcttaccaccttccgcttacagctcactgagcccggtctgcgcccggcactgcaggccagctgtcaggaatacagcgcccattttggcttcccggtcacgctggattaccagttgccgccccgctttgtgccctcgcatcaggcgatccatctgctgcaaattgcccgtgaagccctgagcaacgcccttaaacacgccggggccactgaagtaaccgtgtcggtgacccaacaggcgcagcgggtaacgctgtgcgtgacagacaacgggtgcggcatcccggaacatgccgagcgcaccaaccattatggcctgattatcatgcgtgaccgcgcccagagtttgcgcggcgactgtgtgatccgccgccgggaggccggtggaaccgaagtgataatcaccttcatacctgaaaagcttctctcatcacgaccaggagataacgatgactaatccggaacccgccactatcctgctgattgacgatcatccgatgctgcgcaccggcgttaagcagctcatcagcatggcaaacgacatcacggtggctggcgaagccagtaacggcgaacagggcattgaactggccgaggcgttagatccggacctgattttactggatctaaatatgccgggcatgaacggcctggaaaccctcgacaagctgcgggagaaaaccctctccgggcgcatcgtggtattcagcgtgtcgaatcatgaagaagacgtagtgacggcgctgaaacgcggcgcggacggttatctgttaaaagatatggagccggaggatctgctgaaagcgctgcaacaggctgccgcaggagaaatggtgctcagcgaagcgctgacgccggtgctggccgccagcctgcgcgccaaccgcgccacttctgaccgtgacgtcagtcagttaacgccccgcgagcgcgatattctcaaactcatcgcccagggtttgccgaacaaaatgatcgcccgccgtctggacatcaccgaaagcaccgtcaaagttcacgtgaagcatatgctgaagaaaatgaagctgaaatcccgtgtcgaagccgccgtgtgggtacatcaggaccggattttctgatcagggcgcgggcagcagcagccagcgcggatcgctgacaggttcactggtcagcggttgcgtcagcaccagcgtgatttcattggatgaaacgcgctgccccttctcatcttccaccgtcagcgacaacgtccagcgattgctcgcgccttcacgggcatcccaggcaggcataatgatgctccagccttcaggctgatgagcattgaccggcggcgtcaggctcagcgcctgagtatcgccctcccagacaacgttacgaatgccatgaacgctgcgcacctgcactttcagctccaccgtttcgccgggggagagatcccagggcggcgtggcgaggaacactgacagggttttacgctggcgctgttccaccaccggcagattgttgcgcgtcgggctgtcatagcgactgccgcgcagcgagctggtttgcgccacttcgctggcggaaagctgctttttcagcggtacgccgaaacgataattcagcttaagccccagatcgttctggctgtcgccgctctccccctgcttatgctgcgcggtgagcgtgaccagcggcaccggggtatagttcagccccactttcaccgccatcgggttgtgataaccggtgccggagtcaaagagatcgacgctgtcgccaaaatactgttccagactgaggctggtattgagatgctgataaaagggcatccgcgcctgagcggtaatatcgtagccgcgcgccatgcgctgttgcagggtcgcgccgtcatcatgccagccggacagcggctcatagtagttggccgacagccgcaggtattccccccaggcttccgcaccgacgcccgcgcgttgcagatgggtgtcaatctggttgtcgtaaaaggtgttgtagcccagcagccagttgcctgccatccagcgctggccgatgcccgcgttgctgaccagcccatcttcctgctgggtcaaccccagctggctccagcttaaatagcggttattgtcctgccagggaataaaccagctgccggaactgccggtaaagcgcccttcatcattgacctgcacgttgacgctggcgttgccccagggtgacagtaacgactccacctgctcgttcacttcgccactcaccgcatcgcgcaccttatccagcgcaaactgccgcgcttgctgtccggcgctcaacgtactgtcgctctggctggcttcaccgaaggccttcgccatctctgccagatgcttttcgccgttgttggtgggcggcgccatgcccagatcgggcaggccgtctgcatcattatcaaagggattttgcgcctgctggttccagccgggcgtagccgcgtggctgccgcctgtcagcagcagaaataacaggaaaggatgaaatggtcttaacgctttacgcatcaatatcttcagcgacgtctcacctgccgggtagttgagcggttataaaagtcaatgctaacgttttttacccgtggtttcagctttctgacaaattccaggaaaatccttaatcgctcccgcttcgtcaggactacagttatagaaccgcttatgcacgagatctggtcatgaataaaacgctgaaatgggctttatggagttcgttgatgttttatggtgccgccgccagcgccagcgaactctttatgctgcaatcccccgcctttggggataacgccttactggaaaaacgcttcgccggtaaggctgacaataatcctaactgcaccggcgataacgaatcaccggcgctgatctggagtaacccgccggccaataccaaaagctttgcgctgatcgtccacgatccggaaggcgcgaagggtttaggcgtcacccacctggtggcctataacatttcgccgtctgctaccggccttgccgccaacgatctgcgggacggcaaaaactttactggcggaaaaaatacccccggcaccgataaatggcatgggccctgcccgccgccgggcacaggcgcacaccattatacctttacgctgatcgccaccgaacaggcgcccgatctgcctgccggtttaacccgcgaggagttgctggaaaaactgaaaggtaaagcgctgggcgccgccgggttaatcggccgcttcgggcagtaacgccctcgccagcagagcgttaagttcaggaatacaggatccgcaattggtgccgcagcgcaacgttctgccgagcgaggcgacggaatggcagccgttgcggatcgcctcctgaagggtattttcccccacgccgtaacaactgcacacggtgcggcccggcgctgtctgctcgtccgccgcctgaccgcttaacagcgcatgtcgttcaaacgcggtcgcgggggcacgggcaaaggccgcttccacccgcgcgctgtctgtttccggcagatgacgatcgctccagaaggcaagcattaactccccgttgtgccaggcaagcagatgccacgcggttccggcctgcgcctgttgtaattgccagccctgcgcctcgcaaaatgccatcagccacggctgcgccggtttatcgcctgccagcgtatagtgcgtcaccgacgcggccttacgcagccagtgcaccgacggcggtagagtgacgttgtcacgaccgaacagctccccctgccaggcgggttgccagacactgatacgcacggcggtctgtttgctttccggttgccccgactgcggacagcataccggcgcgaccagcgtattgaccttgccctggcgggcgaacaccgcgttccagtgcatggggacaaataatgatctagggcgctgcgcctcgctgacgaaagcccgcgccaccatcaggccccgtggggaactgatgcgcagcagatcgccggtttgaacgccatgcagtgccgcgtctgagggcgcgatctccacccgcggttcggcgatgtgctgcatcagccgcgccaccgtgccggtgcgggtcatggtgtgccactgatcgcgaatgcgaccgctgttgaggatgaaaggatagcgcgcgtcgggccgggcgcgggggcgttccggcaataccggcaacatacgcaaccgcccgctgtcgcgccagccccgggtcagatcgaggggttttcccaccggccactgcaccggcgtcatctcatcccattgttcacgggtgaggtttgccagcggactgatatcaaacgcccgcctgccgttgttttcatagccggagagcgcggcatgctcgctgaacacctcatggacgtgctgccaggcaaaagcctcgccgtagcccagttgccgggcaatttgcgcgacgatccaccagtcggggcgcgcctcgccgggcgacggcaaaaacgcccgctgacgcgaaatgcgccgctcggagttggtcacagtgccgtttttttcaccccacgcctgcgccggaaaccggatatgcgcaaagcggctggtgtcggtatccgccgccacctccgagacgatgaccagcgggcatgtcgccagcgcctggcagaccgcgagactgtccggcagcgataccgccggattagtacccatgatccataccgctttcacctcgccacgtccgatggcctcaaacagctctaccgccatcagccccggcgtctgcgccagccgctccgtaccccagaagcgcgccacgcgggccagatcctcaggttcaaaattcatgtgcgccgccagttgcgtcgccagcccgcccacctcgcgcccgcccatggcattcggctgaccggtcagcgaaaacggcccgcagcccgggcggtgtattttaccgctcgccagatgcacgttaatgatggcgttgcatttgtcgctgccgctggcggactggttaatccccatggtgtaaagcgtgatggcgcgcggcgcggagataaaccagtcaaaaaaggtattgacctccataagcggcagctcgcaaaactgcgccacccgttccggcggccagtcagcggccacggcagctgcctgttccccctcatcaaacgcccctgcctcgccgccgcgctgcataatggcgtgcagcaggccgacaaacagcccgccatcgctgccgggcgccagcgccaggtgcaggtcggcgatgtcgcaggtggcggtgcggcgcggatcgatgaccacaattttcatctgcgggcgttcacgtttcgcctgcgccagccgctgataaagcaccgggtgcgcccaggcggcgttggatcccaccagcaccaccagatcgctctgctccacatccagatagctgcacggcaccacatccgcgccgaacgcccgtttatagccggtcaccgccgaggacatgcacagtcgcgaattggtgtcgatatttgccgcgccgataaagcccttcatcagtttgttggcggcgtaataatcctcggtcagcagctggccggaggcgtaaaacgccaccgcctgcgggccgaattcatcaataatgctgcgcaggcgatcgcccgccgtggccagcgcctgctcccagtcgcagcgctcgccgtccacctgcgggtgcagcaaccgtcccgcaaggccggtggtttcccccagcgccgcgcctttaacacacagccgcccgacatttgccggatggttttcatcgccgcgcacgctgacctcgccctgatccacgcgggcaatgacgccgcagccgacgccgcagtacgggcaggttgtccgggtttccgtcatgatgcctccgcgcgcagcagcagggcctgattgcccacccacactttgccgttttcaatttttaccggccaggcgcgaaccagcggctcgccgttgtccggcgcacgcccgtcccgcagacgaatgcgctgtttgtagagcggcgaaatgacaatcggctcacccgctgcgtcaccgatcagaccgcgtgacaggacgttcgcctcgctgcccggctccagatcgtccagcgcatacaccgagtgcccgcagcggaacagcgcgatctgccgctcgccgatacgcgcgccgatccctgcctgctccgggatttcctcgacgccgcaaattgcctgccagggtttgccgagggcctgagcatcgccattaatggacgttttaaactgcgccagctgttggggatcgttaagcgtggtctgccactcgcactggtaggtttccacgatacgcgccatctcctgctccagttctgcccccagtcccagcgaatcctccaggatcacctcacgcagatagtcgatgccgccctccaggttatccatccatacgctggtgcgctgtaaacggtcggcggtgcgaatgtagaacatcagcagacgatcgacggtacggatcagcgcggcttcatccatatcgctggcaaagagatccgcgtggcgcggcttcatgccgccattaccacagacatacaggttccagcccttttcggtggcgatgaccccgatgtctttactctgcgcttcggcgcattcccgggtacagcccgacaccgccattttgattttgtgcggcgcgcgcaggcccttgtagcggtgctccagcgtcaccgccagcccggtggaatcctgcacgccgtaacggcaccaggtggagccgacgcaggatttcaccgtacgcagagatttgccgtaggcgtgcccggtttcaaaaccggcgtccgccagttcccgccagatgtcaggcagttgatcgagctgcgcgccaaacagatcgatacgctgtccgccggtgactttgctgtacagctggtattttttggcgatctgcccgacggcaatcagcccgtcggcagtgacctccccggcgggcatgcgcggcaccacggaataggtgccgtctttctggatgttggcaaagaagcggtcgttagtgtcctgcaacggcagatgggcaggtttgcgcagataatcgttccagcaggacgccagcaccgagccgaccagcggtttgcagatctcgcagccctgcccctgaccgtagcgggaaatcagctgatcaaaggtgtggatatggttgacgcgtaccaggtggtaaatctcctgccgggaataagcaaagtgttcgcagatgtcttttttcacctccacgccctgggcggcgagctgaaattccatcacctgcttcaccagcgcgctacagccgccgcagccggtcgccgctttggtgcagcttttgattgcccccatatcagacgccccggcgctgaccgcctggcagatgtctgccttgctgacgttatggcaggagcagatctgcgcgctctccggcagcgctgccacgccgaggcctttcgccgggctgcctgccagctgcggtaaaatcaggctttccggctgcgcgggcagcggcagatcgttaagcatcatctgtaacagcgtggcgtagtcgctggcatcgcccaccagcacgccgccgagcagctttttgctgtcctggctgatgacgatctttttgtaggtctggtgcgggccgtcggtccactggtagctgaggcacttcggcgtgcgcccctgcgcatcgccaaaggacgccacgtccacccccagcagcttgagtttggtgctcatgtctgcaccggtaaagatcgcgttttccccggccagctgagcggcggccaccctcgccatctgatagcccggcgcaaccagaccgtagattttgccctcccacagggcgcattcgccgatggcgaaaatgtcgtcatcgctggtgcggcaggcgtcgtcgatgcaaatgccgccgcgctcgccgatggtgagatcgcagccccgcgccagcgcatcctgcggacggatgcctgcggagaacaccaccatatcggtgtccagcgttccgccgtcggcgaactgtaacgccatgccgctgtcggtttcgacaatggcggtggtggatttactggtgtgcacgccgacgcccagcgcagtgattttcctgcgcagcatctccgcgcccggagcgtccagctgcaccgccatcaggctgggggcgaactccacgacatgggtttccaggccaagctgttttaaggcattcgccgcttccagccccagcagaccaccgccgatcaccacgccgcgtgtggcggtggcggcgctttcgcggatacggtccagatcgtcaagggtgcgatagacaaagcagcccggcagatcgcgccccggcactggcggtacaaaaggatacgagccggtggccagcaccagcttgtcgaaatgggtttcatgcccggcggtatcgcgcaccacgcgcagatcgcggtcgatttccgccacccggcagcacaaacgcaattcgatgccgtagcgggcgaagaaatcgtcctccaccagcgacagggatcccgcgctgcgcccggaaaagtattctgacagatgcacacgatcgtaagcggcgtaacgctcctcacacagcaccacgatctgatacgccagatgcagatcgcggctgacgcactgttctaaaaaatggtggccgaccatgccgtgtcctgccactaccagcgttggttttgtcattgtcttatgtccttcagcctgtggccgggttgcgaaacggtcaaagagccagtcagcactggcgggttgcggggtggcgagcagttcggtaagggtggacgcgctccgacagtcgcccatcagcagcacgcccgcgagcctgccgtcgcggatcagcagacggcggtaatgcccggacagcggatcgaagctgtgccaggtttgatccccggcgtcggcgtttacctgaccggcgctgaacagatcgatgccggtgacttttaaacgcgtgccgctgtcgtgccagtgaaaatcgtcgccgggctggtcgcacagacgggccgccagcacgtcggcctgttgcagacagggggccaccagtccccaggtctggccgtcgatttcgcaacattcgccgagggcgctgataccgctcatagtggtgcgcagctgacgatccaccacaataccgcgccggcacgggatgccgctggcctgcgccagcgacgcgttgggtttcacgccggtggcgatgaccacgcgcgacgccggaacggtgcgcccgtcggtcagcgtgacggcctcctgcccgatgtccgtgataccgctgttcagttcgcaggtgataccgcgcgcccgcaggtgtgccgccagcagatcccctgcccggagatccagctgctgctccatcaggcgatcggcgcggtgcaccagcgtgacactgtcaccacggcgggcaaaggccgccgctgcctccacgcccagcacgccgcccccgagcaccaccaccggcccgcgcgttgccagcatggcgttgacatccgccagcgtgcgaaatgcaaaaacgtgcggctgcgcatgaccgggaatgggtggaataaagggcagcgatccggtggcaaacaccagttcgtcccaggagagctggcgctgatcggtttgtagcgttcgcgctgcatgatccaccgccagcacccgttcgccgtagagcacggtaatgcggttcgcgtcgtaccagtcctcaggcagcagccgcgtattggcaaaaggcttttccccgctcagcacgggggaaagctgaatgcggttataggccgcgcaaggctcgtcgccgataagggtgatggcaaagcgcgtcgcatcgcggctgataagcgcctgcgccagccgggtcgccgccataccgttgccgataatgatcagttgccgcatcatcgctgccccttacgccgctttcggctgtttttcgtagaggaaatgcaggatttgctgacgcaggtggtggtagcggctgtcttccgccagcgccacgcggtgtcgcggacgcggcaggtttaccgccagcacttcccccaccgtcgccgccgggccgttggtcatcatcatcacgcgatccgagagcagtaccgcttcatccacatcgtgagtgatcagcacgatggtggtattcagcgactgctggatctgcatcacggtgtcctgcaaatgggcgcgggtcagcgcatccagtgcgccgaagggttcatccatcagcagcacttttggcttcatcgccagcgcacgggcaatgccgacgcgctgcttcatgccgccggacacctcatccgggcgcttgtgcagcgcatggcccatctgcacgcgctcaaggttgtgctcgatccactcgcggcgctcggctttgctcatggtgcggcgaaacacctgatccacagccagcgccacgttgtcaaagcaggtcagccacggcagcagcgagtggttctggaacaccaccgcgcgttccgggccggggccggcgatttcgcggttatcgcagatcagcccgccctctgtgggcagcgtaatgccggcgatcaaattgagcagcgtcgatttgccgcagccggagtgaccaatcagactgacggtctccccttcgtgaatatcaaaagagacgttttgcagcgcgaggaattcaccgctggcggtggcgaaacgctggctgacggcctgcacctgaataatgggtttcatacgcgactccttatttatcctgccagctgaaacggcgggcgatgagcatcagtccctgctccagcagcagacctacgacgccgatgatgacgatggcgatgagaatgttttccacgttgaggttgttccactcgttccagatccagaagccgatacctgcgccgccggtgagcatttcggcagccacaatcaccagccaggcgatgccaatggacagccgcacgccggtgagcaccgcgggcagtaccgccgggaacagaatgcggcgcagcaccgtccattcagaaagctgtaacacgcgggcgacgttgaggtagtccgcaggaatgcgcttcaccccttcggcggtgttgatcaccatcggccagatggagcagataaaaatggtccagctggaggcgggctcggctttctgaaacagcagcaggccaatcggcagccaggccagcgggctgaccggacgcagcagcgcgatcagcggtgtgaacatgcgcgagaaaaagacaaagcggccaatcaaaaagccgagcgggatccccaccagcgccgccagcccgaaacctatcgccacgcgctgcagggaggccagcacgttccagccgatgcccatgtcgttaggcccgtcgttgtaaaagggatcggcaaacaatgtcagggcggaatccagggtggagagcggcgtcgggaagcctttgctgttaatggcggccagctgccaggcgaccaccagcagtcccagaccgagcagcgcggggataatacgctgcgcaacatcgcgcagatggcgattcaggcgcggcgtgcggcggcgcacctgcaccggcggcaggacgatcacttcgccctgggtggtttccggcttaacggtgatttttttctgtgcaagtgtcatgtcatgcccctttacgttgaatggcaaaacggctggcgtacccttccggatcggtgccgttccagacggtgccgtcaataagcgtgctggcgcgcagcggtgaagaaggcagcgaaatccccccgacctgggcggcggcatcgctgaagatgtcggtgcggttgatgcgagccgcgatggcggcatagtccggtgcggttttaagcagtccccagcgtctgaactgggtcaggaaccacatgccgtcggagtgccacggatagttaacctgtccctcattgaagaaacggatggcgtgggcgtcctgccagcggcggcctgcgccgttgtcgtactcccccagcagacggccggtaagaaactgttctttggtattaagccaggcgcgacgggcaagaatgcgcgcggtttcgcgtttgttttccgccgaggcgtcgatccagcgggcggcctccagcaccgccgccaccagcgcccgcgcggtgtgcggattctgctccacccaggcgcggcgggtgccgaggattttttccggatgatcgggccagatctcctgcgaggtcgctgcggtaaagccgatgcgatcgttaatggcgcgggtgttccacggctcgccgacgcaaaacccgaccatattgccgatacgcatgttcatcaccatctgcggcggcggcaccaccacggtgcggatatcgtcaaaggggttgatcccggcgttagccagccagtagtagagccacatggcatgggtgccggtcggaaaggtgtgtgcgaaggtgtagctgcctggcgcgctctggccgatcagggttttcagtccggcggcatcacgaatgcctttctcctgcaactccgccgacagggtgatcgcctggccgttctggttcagcgtcatcaggttcgccatcgcctggggtttggggccgatgcccatctccagcccgtaaagcagcccgtacagcacgtgcgccgcatccagctcgccggaagtaagtttgtcgcgcaccgccgcccaactggcttctttggttggtacaagggtgatgccatattttttatcgaagcctttaagggcggcgatcaccagcggcgcgcagtcggtaagcgggataaaaccgacgcgcacgatctgctgctccggcttgtcagagcctgccgcataagccgcctgcatcacgcccggtaacaacaggctgccgcccataacggcggtggcctgtaacaggcgtcggcgggaaagagaaaaggttgaatcagccatcaccactcctgaagcaaaaaaaagcgcccggcagtgctttcgcaccgcaggacgcctttatcctcaaaacctgcctgccgccattggcgggccggttcagtatgttgtgacaggagtaatgcaaaggggatgccaggtttcaacccctcaccccggccgtctccgcagatcgtaggcccggcaagcctgcgccgccgggcgggacggacggcacgatgtctgttgccgggtggcgctgcgcttacccggcctacactgaatcccgcgcaccgggcatgtgcatcttttgcccgtaaaccgtgcaactactccttttggattactgccagagatttttcaccgttaacagcgcccgggcgatctccaccatgcgctggtttttgtccatcgccattttgcgcaggcactgccatgcctgctcttcggtcatattctggtgtgtcatcagcacgtgcttggcgctgtcgatcaccttgcgctcgtcgagggaggctttcagcgacgccagctgcgtagtgagctgatccagttcgcgcgcctgctggcgcaccagcggcaacagctgatgatcagagcacagcgacagcccctccccggcgggttcaagaaaggcggcgcttagcggcggggcctgatcctcttccgccagtaaggtcgccacggtatgcatcagggcgtcgatcagtgattcttccagcgcgcgtagctgttccagccgctgcgtgtgcagcacaaaccagcgcagcgcgttttccccctgatcctgcggcggctgacgggtacaggccagacgacgcagctgttcgatctccagcgtcgccccgcagcgggcgtgaaaaatgtcgctcagttcgccggtggtgagcgaaaggaaagtatcaaaacagggctgctgaccgtcgatgcgatccaccagccgctggcgcagggcgtcgctgaaatgaccgagggtaaaaccaagcgcccccagcgcccgctcctgccccgccagctctttaccctgcatcaggctgtagagcgccaccagcggctgcacaatgcgcggatcgtcgagggtgtcgttcagctgcggcacaatacttaacagatgacggatggtggcactgaactgttccatggcttccgctgcttctgttcgttgttcgtgcacgcgctgacgtaattcaggcagctgttccagcccccagagcgcggaggcgatacgctggcacagggcgctgctgttcagcggctggtcaaaacgcagcagcggcagcagcgcctgccgttgttcatccaccagcgcgcggctggcgcgacactcggcttcatacaatcgcccctgcgaacagagccagatgttggaagcgccgcgttcgcactgtagcatatgcaccagatggcagatcctgcttgccagctcacccgactgcgccagctggcggagttgttgtttctggatctggcgcgcgtaacgaaaccagtcgatggcgctgttcgcgcggtcagcatttatggtcatgcttattctcccggtcaatgtgtccgctgaataaagcaataatcatgccttgtcgaaggagtgaaaatgcaaaagatagtgatcgtcgccagcggcgcggcgtacggcagtgaatccctgtttaacagtctgcgtctggctatcgccctgcgtgagcaggatcctgcccccgaactgcggctgtttttaatgtccgatgccgtcaccgccgggctgcgcggccagcgtcctgccgaaggctataacattcagcagatgctggagatcctcaccgcgcaaaacgtgccggtgaagctgtgcaaaacctgcaccgatggacgcggcatcagcgcgttgccgctggtagagggtgtggaaatcggcaccctggtggagctggcgcagtggacgctggcggcagacaaagtgctgactttttaataatcacgctgctttaatatatatttcttatagatgtcatacgggcatcaagtttgcctgctgcgttgccgatagcttttttataacaacacagcaggtacaacatcatgatcaggtccattcgcgcgcgcattattgtggcgacagcaggctgtctggctatcgctttgcttcttaacactattattaattatcaggtggcccgtcaggacaaccagcagacccggcaggatattttaaccagcacgagtaacagccacagtctggcaatcgccgactgggtgaacagcaagatgacgatgatcgcctcgttacagagcgtggcggtgcaggacgatccggtgccggtcttcaaacagatcgctcaggcgggcggttttactaacgtttatgtcggcaatgcggcgaaaaccgccaaattctccgatcccaccggcgtgcccgcagattacgatcccactatccgcccctggtatcagcaggtgctgaaagccgatgcgccagtggtcaccgcgccctatgtggacgcgggcaccggtaagttggtggtgacctttgcggtgccggtgaaagtgaacggtacgctgacggcggtggtggccggtgatgtgaccatggacagcgtggtggcgaacgtacagggtattcagcccacgccgcaaagcagcggcctgctgctggacagcgacggcacggtgatcgccgccagcgaccccgcgctgaccttaaaacccttcagcgacgccatccagggcgtggaattcagcgcccttaaagcgggtcacgctgaagacggcacgctggccggtgccgacaaaaccctgctcgcctcgccggtgaaaggcacacagtggctgctggtggtggcgctggatgacaatgatgccaccagcggactgagcgcccagcttaaagcttcggcgctgtcgcttgtcgtgctggtgcttactggcggcgcggtgatgcactggctggtggcgaccctgcttaaacgcctggtcaccatccgcgatgcgatgcacgccatcagcaacggcaccgacgatctgtcccagcgtctgccggaaaacggcaacgatgaggtggcggagatcgcccgtgcctttaacgccttcagcgataagctggcggtggtgatggtcaaactgcgggattccagtacctcggtgaaattcgccgcccgggagatcgccgccggtaaccaggatctctccggacgtactgaacaggccgcctccagtctgcgcggcactgccagcgccatcgagcagatcaccgcctcggtgggccagtccaccgattccgccgccctggccaatacccaggcgcaggccgcctctgaagccgcatcacgcggtggcgacgtggtgaaacaggcgatcaccaccatgcagtctattgaagaggcatcgtccaaaatcggcgacatcaccagcgtcatcgacggcatcgccttccagaccaatattctggcgctgaacgccgcggtggaagcggcgcgggccggggaacagggccgcggtttcgccgtggtggccggggaagtgcgaacccttgccagccgcagcgcgcaggcggcgaaggagatcaaatcgctgatcgaatccaccacccagagcgtgtcgaccggctcacgttatgtgcggctggcaggggaaagcatgggggatattgtatcgggcatcgacagcgtatcggtgatcatgcgtgaaatcaccgtcgccaccagcgagcagatgaaaggcattcaggaaattaaccacgcggtgatcgaccttgaccgcatggtgcagcagaacgctgagctggtagtggaatctgcggcagcggcggatgcgctgcaattgcaggcagcggagctggcggaaaccgccgggcacttccgcatctgagtctacggcagcgcggcgtgcgctgccggtcctgtcaggcaaaacctggctgcatctccgggccgggtttttcgtcgcataataagcggcgtactttacccaccagatcgtttaagcagtcgtcgtgcatgccgagcttaatcagctcctgctccagcgagaaaagatactgcgcgttggtgccgagcgggccgctggcggcggcaatcagcggggcgatcacctgggcgcgggtatcggattcataaagcgcatgtcgcggatccataataaagaccagcgcgttaatggtacggccatcgtcgagggtgagtttgcaccagctcggcagatagcagccggtgatcatctcgcgcttccacagcagcgaaagttcgtcgtgcagggtgtcatcggcgagccggtaggccacgcccgtggtgcgtccgccctctttcagggcaagcatgcgacccggctggcaggcgctgccccgtccggcggtcaggcgcaggcaaaaggcacgatgccagccaaccagggtgccggtacaggattcggtatattccagcgccgggttccacatcagggagccatagccaaaaatccacaccgggccatcgtccgggcggcaggccagggtcgccgccagcgaggctgcccgctgttctgctgaccagagcagggattcttctatctcgccaaaagccgttttacagtcggccttcatcaaaaaatcacgcgttaacatcgtttacctccaccactgcgtgcatccatgcgactacttttttgacgccttccaggcttttttggtgctttttaagaaagcaacccgctacgacgatatgcaattcacgggccgcttgcaagccagacgcaggcgtaagcggctcacttattgttatcgggcggtggaggaaaatctaaagcgtatttatttcagctgattatttccttttgtgccatttgtcgtcatcacccttttcatagtcatgtttcaccgctgcccacgccactttgtgggcggtctcttcacggctggcatcgcccttgcgatcctctttatctttgtactgatcccaggcgctgttgaaggcttctttatagatatcctgcgcatgggcaggtagcacatgttgtacgctgtccggtaagtcggttcgggatttaaacggcatgataagtcctcagtcagggataaaacctaagtgtggacgacaaccggcattgctgccagcgcagaggtatttttgaaaatcaaacgatataaataactgttattaatgggtataaatataatatcttataaatatagccacttcatattgataatatgattttcccgtaaaattaggtaaacataacaccgcttattaacaggatctgttattttaccggtctgctgaattttcaaactaaacttattacgcacctgcaaacacggagatggataatgccgacaacgatcgaggcggttaaaacccgccacaaggagacctccctcattttcccggtagtggccctggcagtgctgctgctgtggggaagcagccagtcactgccagtggtcattggtatcaacctgctggcgctggtcgggatattaagcagcgcatttagtgtggtacgccatgccgatgttctggcacaccgcctcggcgagccttacggttcattaattttaagtctttccgtcgttattctcgaagtgagccttatttccgccctgatggcgaccggcgatgccgcgccgacgctgatgcgcgatacgctctattccatcattatgattgtgaccggcggtctggtgggcttttcactgctgctgggtggtcagaaattcgccacccagtatatgaatctgtttggcattaaacagtatctgatcgccctcttcccgctggcggtgattgtgctggtcttccccatggcgctgccgggcggtaatttcagcacctcgcaagccctgctggtcgcgctgatttccgccgccatgtacggcgttttcctgctgatccagaccaaaacgcaccagagcctgtttgtttacgagcatgaagatgatggcgatgatgacgatccgcaccacggcaagccctccgcgcacagtaatctgtggcacgcgctgtggctgattattcatctggttgcggttatcgccgtcaccaaaatgaacgcgaatccgctggaaacgctgctgacggagcttaacgcccctgtcgcctttaccggtttcctggtggcgctgctgatcctctcgccggaaggcctgggcgcgctgcgcgcggtgctgaataatcaggtgcagcgtgcgatgaacctgttctttggttcggtgctggcgaccatttctctgaccgtaccagtagtgacgctgatcgcctgggcgacgggtaacgatctggtgttcagcctgggcgggccggagatgattgttatgctgtccgcgctgttgctgtgtcagctgtcattctcgaccggtcgcaccaatgtgctgaacggcgcggcgcatctggcgctgtttatcgcctatctgatgacgatattcgcctgacaacggacgggagtgtaggcccggcaagcttgcgccgccgggcacaaaacctggcaaagtgttcgttttatgtcaggtgtcgctgcgctaacctgacctactcaaaataacgcttacataagtgaaaacgtcacgccgggatggcgtgacgtcgggcaggaattagtgctcggtatccagctcagggaagcttttcaccagatcgtcaatggctttgatctgggtgaggaactgttccagcttcgccagcggcagtgcggacgggccgtcacacttcgcgttatccgggtccgggtgcgcttcgataaacagacccgcaagccccgttgccatgccggcgcgtgccagctcggtcacctgaccgcgacggccgcttgacgccgcgccaaagggatcgcggcactgcagggcgtgggtcacgtcgaaaatcaccggggagttgccggagactttcttcatcacgctgaagccgagcatgtccaccaccaggttgtcgtagccgaagttagcgccacggtcgcacaggatcaccttctcgttaccgccttcgcggaatttatccacgatgttgcccatctggccagggcttacgaactgcggtttcttcacgttgatcaccgcaccggttttcgccatggcttccaccaggtcggtctgacgggctaggaaggccggcagttggatcacgtcaaccacttcggataccggctgcgcctggctggcttcgtgcacgtcggtgatcactttcacgccaaaggtctgcttcagctcctggaagattttcatcccttcttcgaggcccgggccacggtaggagtgaatagacgagcggttggctttgtcaaaagaggccttgaacacgtacggaatacccattttctgcgtaacagtcacgtagtgttcacaaatacgcatagcaagatcgcgtgactccagcacgttcataccgccaaacagcacgaacggcaggtcgtttgccacgttaatatcgccaatgctaaccactttttgtttcataggatcgccttatcaggtttggatcgggaggtatcagtgcagcgtgatctgcttgtgcgcgatgttgttaatctgcgcgcggatcatttcgctgatcggatcttccggacattgttctacaaaataacttaaatcattgagcgcgacatggtcgcagtcgagctgggcataaatcaggccgcggtcgcgaatttcatacggatcttcgggattgaactgtaacagcgcttcgctggcgcgcagggccagctccatttgctgctcttccatcagcgccgatttcagcgtatccagcagtttgcggatcacttcggcgttgtcggcctcgtccagatcttcattaaagagttccgcaatggggctgatattacccttgagccacacttcgagggtgtgctcgtccagcgtgtcgccgttgaacggattgatcagccacatttcgctgtccatccattcggcgcgtaaaattaactgcgtcgggaagatcaccggcatcagcggaatatccagcctgtccgcgacccacagcaaaatggcgcccagtgaaacggcgctgccctgacgatttttcagcacgtgatccagccacagagcatctgacaggcggtagacgccgcgcgtgtcccgaaagccccactcaccgtaaaacagctcgatgagtttctccagttgccagtcctgaggcttcgcctcgctaatctcttcccgggccagactgaccagcccttccagctcgtcgtagacatactgtgaggggaaatcatcgcggatcaactccgatacgaggatcatcccgtcacataacggcgctttattaaattcgaaatctgccaacgacttcatcatttaccccagtaacggtatttttgtggtggcgagtttaatgatgatgtacagcaccaccagccccagcagaagcgcgataaacccggcctgctggctgcgagggcaacattacccctgcgcaagaaaacccaaaacgctgtgatgataacgccaaatgacgtctgcgtcagccatgccgctttcatcatcgtgacaacagcgacgagaaaaggcatgccgagacgggttaaagcattcaccgcgcttattcctgtagcgctaaccggccaagcgtgatgcgctcattaccgccataatcgcgacaggtttcgatctgcgcataaccctctgcggcaaaacaggcgcgcacggcggcgccctgctgccagccatgctccagtagcagcgttccgccgggtagtaagaatgattgtgcgtgatggataatccacgccagatccgccatgccctgatcgcccgccaccagcgcggtgcgcggttcaaagcgcacatccccctgcgacaggtgcggatcctgctcatcaatgtagggcgggttactgacgatcatcgcaaaccgctcgccgtccagcgcgctgaaccagtggctttgcagcacactgacgttgcggatatgcagatgctccgcgttgcgccgggcaagggccacagcgtcgggcatcatatcgacggcaatcacatcgcagtccgggcgttcgcttgccagcgccagcgcgattgcgccggtgccggtgcccagatccagaatacgacagggtgagtcaggcagacgcgccagcgcctgttccaccagacattcggtgtccggacggggtatcagcgtggcgggtgagacgaaaagcggcagcgaccagaactcccgtacgcccaccagatgcgccaccggctcgccctgcacgcggcgcgccagcagttcgctgagctgcgcctgttctgcgtccgtcagcagcgtctcgccgaaggcaagaataaaagtgcgggcgcgtccggtgacaaatcccagcaggatctcggcatcgcgccgcgggctgtcgctgcccgcaagctgttcaatggcaaggcgtagccaggcgtggtaatccatcagtcctgctcggaaagcgcggcaagctgatcggcctggtattcctggacgataggctcgatcagcatatccagttttccttccatcacttcatccagacggtagagcgtcaggttgatgcggtggtcggttacgcggccctgcgggaagttataggtgcggttgcgatcgctacggtcgccgctgcccagcaggttacggcgcgtggacgcttcggcctgctggcgtttggcgatttcggcggcgcgaatacgcgaacccagcacggagagcgctttggctttgtttttgtgctgggaacgttcgtcctggcactccaccacgatcccggtcggaatgtgggtgatacggatcgccgaatcggtggtgttaacgtgctgaccgcccgcgccggaggagcggaaggtatcaatacgcagatccgccgggttgatgtccggcagttccgcttccggcaattccggcatcagcgccacggtacaggcggaagtgtgaatgcggccctgggattcggtggccggtacgcgctgtacgcgatgaccgccggattcaaatttcagtcggccatagacgccttcgccgctgattttggcgataatttctttataaccgccatgctcgccttcgttggcgctcatgatctccacgcgccagcggcgggattccgcgtaacggctgtacatgcggaacagatcgccggcaaagagcgcggcttcatcgccgccggttccggcacgcacttctaggtaggcgttacgttcatcatccggatcggtcggcagcaacagcacctgcagatgctgttccagttgttcggttttctctttcagctcgcgcagttcttcctgcgccatgtcgcgcatttccggatcctcgagcatcagctgcgcggtttccatgtcttcctgaacctgtcgccagtcagtaaagcagcgtgagacatcgctcaactgagcgtattcgcgcgataaggcacgaaaacgatcctgatcggcaatggtccccgcgtcgcccagcagcgcctgtacttcttcatgacgctcgtgcagggcttccagtttggcaacgatagaaggcttcataggcgtaaatgcaccctgttctgttattagaggttgttgtgctactccagcccgaggctgttgcgcagaatatgcaggcgttcgtcatccccgttacgggcagcctgctgaagagatttggttggggcgtggatcagcttgttggtcagtttccacgccagatcctgcatgatggcctgcgcatcgccgcccttttccagggctgcgagggcttttgctgtcagttcatcccgcacctgttcggcctggctgcggtattcgcgaatggtctcgctggcgctttgcgcacgcagccaggccataaattcgctggtttcctgctcaacgatggtctccgcttccacggcggcggctttgcgctgcgccaggttgtgggaaatgatgctctgtaaatcatcgacgctgtacagataggcgttcgccagcttgctgacgtccggctcgacgtcgcgcggcacggcgatatccaccagcagcatcggctggttacgacgggctttcagggcgcgttccaccatgcctttgccgatgatcggcagcgggctggccgtggagctgataataatgtcggcgtctttcaggcgctcatcgatatcgctgagcgaaatcacctcggcacccacttcatccgccagcacctgtgcgcgttcgcgggtgcggttggcgatgatcatgttcttcactttatgctcgcgcagatgacgcgccaccagttcgatggtttcacccgcgccgaccagcattaccgtgacggtggataacgattcaaagatttgacgcgccagcgtacaggcggcgaaggcgacagagacggcgctggcaccgatgtcagtttccgtacgcacgcgtttggccaccgagaaggatttctgaaacatgcgctccagttcggtggcgttaaggtgcccgcggctggaatcggcaaaggctttcttgacctggcccaggatctgcggctcgcccagcaccagtgaatccagcccgctggcgacgcgcatcagatggcttacagcgtcgttgtcctgatgccagtagaggcttttacgcagttcttcttcattaagatgatggtaatcgcacagccagcggatcaacgcttcctgtaaatcgtcacgctcttccacgctgaggtaaagctcggtgcggttgcacgtcgagagcaccacgccgccctgcaccattggctgagccagcaggctttccagcgcctggtcgagcgtatccggcgaaaacgaaacacgttctcgcaacgcaacaggcgcagttttgtggttgatgccgagcgctaaaagggtcatgtcagcgggagtagtaccagcgttgataaggttagtctgtgcgcatcatacaggatgcgtgaggtcaataaaagagagcgcccccttttggagtaatcgataatataatgatttaagacaagttgaacgtagacgctgtgccgccgcggcgctagcattaacgatataactgcaacgtattacaaggatttttcctcattatgatgtcagccaatacccgcctgctccgccttctgccgctcgccagccttgtgctgaccgcatgtacactcaccgcgccaaaaggaccgggtaaaagccctgactccccgcagtggcggcagcatcagcaggaagtgcgtaatcttaaccagtatcagacccgcggtgcctttgcctatatttcccctgagcagaaagtttatgcccgttatttttggcagcaaaccggccaggataactaccgtctgctgttgaccaatccgctgggcagcaccgagcttgagctgagcgcccgtccgggtaacgtgcagatcgtcgataataaaggccagcgctataccgcgaccgatgcggaagagaccatcagcaagctgaccggcatgccgatcccgctcaatagcctgcgccagtggatcctgggtctgccgggcgaggcgacagactacaaactcgacagccagtaccgtctgagcgaactgaactactctgaaggcggcaaaacctggaaagtggtttacggcgactatgacgagaaaaccaaaccgagcctgcccgccaatatggagctgacgcaggacggacagcgcatcaaactcaaaatggataactggattgtgaaatgatgacccagtggccctctccggcaaaacttaatctctttttatacattaccggtcagcgcagcgatggttatcacgagcttcagacgctgtttcagtttctggattatggtgacaccctcagtatcgcgccccgtcacgatggcgctatccgcctgctgacgccggtggctggcgtgccggatgaggaaaacctcatcgtgcgcgcggcgcggttattaatggacgccgcccgtcagcgtgattgtctgccagccgggagcggcgctgacatccgcattgaaaaacgtctgcccatgggcggcggtctgggcggcggttcatctaatgccgccaccgtgctggtggcgctgaaccatctctggggctgcggcttgtcggtggatgaactggcggatctgggcctgcaacttggcgcggatgtgccggtatttgtgcgcggtcatgcggccttcgcagagggcgtgggtgagcagttgatcccggtcgatccgccggaaaaatggtatctggtgatgcatcccggcgtcagtattcctaccccggttattttcaaagatcctgatttgccaagagacacgccgaaaaggtcaattaatacgttgctaaattgtgaattcggcaacgattgcgaggttatcgcaagaaaacgttttcgcgaggttgatgccgcgctttcctggctgttagaatacgcgccgtcgcgcctgactggcacaggagcttgtgtctttgctgaatttgacaccgagtcctctgcgcgtcaggtgctggagcaagccccggactggctacatggttttgtcgcgaaaggtgtaaacctttctccactgcaccaggctatgtttgggcaacctgagctccggtgacaacgtcaccctgttccagacgttgcatcgcgctctttaatacaccgctggatagtgttttgcctggcccgcacagtttttggcgacgctatccaccactggacgcatgcctgaggttcttctcgtgcctgatatgaagctttttgctggtaacgccaccccggaactagcacaacgtattgccaaccgcctgtacacttccctcggcgacgccgctgtaggtcgctttagcgacggcgaagtcagcgtacaaattaatgaaaatgtacgcggtggtgatattttcatcatccagtccacttgtgctcccaccaatgacaacctcatggagttggttgttatggttgatgcgctgcgtcgtgcttctgcaggtcgtatcaccgctgttattccttactttggctatgcccgtcaggatcgccgcgtgcgttccgcgcgtgtgcctattaccgcaaaagttgtcgccgatttcctctccagcgtgggcgttgaccgcgtactgaccgttgacctgcatgctgaacagatccagggcttctttgatgtgccggttgataacgtgttcggcagcccgatcctgctggaagacatgctgcaactgaatctggataacccaattgtggtttctccggacatcggcggcgtggtgcgtgcccgtgctatcgccaaactgcttaacgataccgatatggctatcatcgacaaacgtcgcccgcgcgcgaacgtctcccaggtgatgcacattattggtgacgtggccggtcgtgactgcgtgctggttgacgatatgatcgataccggcggtaccctgtgtaaggcggctgaagccctgaaagaacgtggcgccaagcgtgtattcgcctacgcgactcacccgatcttctccggcaatgcggctaacaatctgcgtcattccgtcatcgacgaagtagtggtttgcgacaccattccgctgactgacgaaatcaaatctctgccgaacgtccgtaccctgaccctgtcaggcatgctggcggaagcgattcgtcgtatcagcaacgaagaatccatctctgcgatgttcgagcactaatcggacacagcgtaaaaacccgccgcggcgggtttttttgtctgtgatttttatttgtatgattaatgctttccattttaattattcatgaaataaatggattgcgcctgaatgaaatgaaaacagtgaaaaaattgacgtcttttgatgctcttccttttcgcgcccttatcgacgcctgctggaaagaaaaatactctctgtcgcgctttacccgcgatctgattgccgggatcaccgtcggcattattgccatcccgctggcgatggcgctggcgattggcagcggcgtggccccgcagtatggtctgtacacgtcggcggttgccgggattgtcattgcgctgaccggcggttcgcgcttcagcgtctccggtcctactgccgcttttgtggtgatcctttatccggtatctcaacagttcgggctggcggggctgctggtcgccaccctgatgtccggcgtattcctgatcctgtttggcctcgcccgttttggtcgcctgattgagtatattccgctgtcggtcacacttggctttacctccgggatcggcatcaccatcggcaccatgcagatcaaagattttctcggtttgcatctcacacaggtgcctgaacactatctgcaaaaagtaggcgcgctggcaggcgcgctgccgacactcaatccgggggatgccgccatcggcgtggtgacccttggcacgctgattttctggccccggcttgggatccgcctgcccggccatctgcccgcgctgctggcaggttgcgccgtgatggtggtggttaacctcgcgggcggccatgtggcgaccatcggctcgcagttccattatgtgctggcagacggcacccgcggcaacggtattccgcaactgctgccgcagctggtgctgccctgggatatgccgggatcgcactttaccctgagctgggcctccctgcgcgccctgcttcctgccgctttttctatggcgatgcttggcgccattgagtctctgctttgcgcggtcgtgctcgacggcatgaccggcacgcggcataaagccaacggcgaactcattggccaggggctgggaaacctggtggcgcctttctttggcggcattaccgccaccgccgccatcgcccgttcggcggccaacgtgcgcgccggagcaacctctcctgtttcctctgtcatccacgctttgctggtgatcctcgcgctgctgatcttagccccgctgctctcctggctgccgctgtcggcgatggccgcgctgctgttgatggtggcatggaatatgagcgaagcgcataaagtggtgaacctgctgcgcaccggcccgcaagacgacatcattgtcatgctgctgtgcatgtcgctgacggtgctgttcgatatggtgatcgccatcagcgtcggcatcgttctcgcctcgctgctgtttatgcgccgtattgcgcgcatgacgcggctggcaacggtaaatgtcgaagtgccggaagatgtactggtgctgcgggtgatcggaccgttatttttcgcggcggcagacagcctgtttaccgatctggcgacgcgctgcgtgggcaaacgcatagtggtgctgaaatgtgatgcggtgccggtgctggacgcgggcgggctggatgcgtttaagcgcttggtggaacgtctgccggaagggtgtgaactgcgggtgagtaatctggagttccagccgctgcgcactatggcgcgagcgggtattaagccgattgaagggcgtctgtcattctatccggataaaactgcggcgctggccgatctgtgacgctatggcccggcggcgcaagcttgccgggcctgaaggccagaaccaatgttatcagctgtggcgatgattctggtcgcggcggcagcgtttatcgtagtgacgcacccaccagtacttatcgcatacctgttcatgcccgccgacgcgcgcccccgccagccacaggatcgcaccgacgaagatgcttaaaatagcgccatgggcgaagtattgcggcaggtcaaactgcggaagctggttcagtatggagtagcccacgccaaccaccatcactaccagccctaaccccattaatacgttaccgagcaacgacgcgtttttgcgtttcatctgtcacctccgggatgccgggttgcagggaaaagtccctgttccttgtgtgtaaagtataggcaacaccccgcagaacggttgcggcgacgatcacagttattaacatcagataaacacaactttacatataaaccgctgaactgcttgattttctaatagttcacactctgaattattgggatttcctgataaccgcagcagaactttgtcaaccggccccgcaccacgtaaactacgccccaaaatgtgatcccttcaggaacgaagacgtgacgattaaactcattgtcggcctggccaatccaggcgctgagtatgctgccacccgccacaatgcgggtgcatggtatgttgatttactggccgaacgctttcgcgcgccactgcgtgaagagccgaaattcttcggtttcacctcgcgcattaacgttgccggcgccgatgtgcgcctgctggtgcccaccacctttatgaatctcagcggtaaagcggtggcggcgatggctaccttctatcgcatcaatccggatgagatcctggtggcgcatgatgagctggatctgccgccgggcgtggcaaaattcaaactgggcggcgggcatggcgggcataacggcctgaaagacattatcagcaagctgggcaataaccccaattttcatcgcttacgggtgggaattggtcatccgggcgataaaaacaaagttgtcggcttcgtgctgggcaaaccgcctgtctccgaacagaagctgatcgacgatgcggtagacgaagcggcgcgctgtaccgaaatctggcttacggatgggttaaccaaagcgaccaaccggctgcatacttttaaggcccagtaagcgcggtgcatggcttttttgccccgcacgatgatggttacgtgtataataggcagagttattaacttttctacaatctgttatctctaacgggttgaatatcaagacattaaggtgatttaaaccatgggattcaaatgcggtatcgtcggcttgccgaacgtcggtaaatctaccctgttcaatgcgctcaccaaagcgggcatcgaagcggcgaacttcccgttctgtaccattgagccgaataccggcgttgtgccgatgcctgacccgcgtctggatcagctggctgaaatcgtcaagccgcagcgcattctgccgaccaccatggaattcgtggacatcgcaggcctggtcaaaggcgcttccaaaggtgaaggcctgggcaaccagttcctgaccaacatccgtgaaaccgaagctattggtcacgtggtgcgttgcttcgaaaacgacaacattatccacgtgaataataaagtcgatccggctgaggatatcgacgtcatcaacaccgagctggcgctgtccgatctggatacctgcgaacgtgccctgcaccgcgtgcagaaaaaagccaaaggcggcgataaagacgcgaaggctgaacaggcggcgctggaaaaatgtctgcctcaccttgctgaagcgggcatgctgcgttccctgaacctgaccgacgaagacaaagccgcgatccgctacctgagcttcctgacgctgaaaccgaccatgtacatcgccaacgttaacgaagacggttttgaaaataacccgtacctcgataaagtgcgcgaaatcgccgccaaagaaggttcagtggtggttgccgtttgtgcggcggttgaagcggatatcgctgagctggacgatgccgatcgcgctgaatttatggcggaaatgggtctggaagagccgggcctgaaccgtgtgatccgtgccggttacgaactgctgaacctgcaaacttacttcaccgctggcgtgaaagaagtgcgtgcctggaccatcccggttggcgccactgccccgcaggctgccggtaagatccataccgatttcgaaaaaggctttatccgcgcccagactatcgcgtttgaagacttcatcgcctacaaaggcgaacagggcgcgaaagaagccggtaagatgcgtgcggaaggcaaagactacatcgtgaaagatggcgacgtgatgaacttcctgttcaacgtctgacgatcgcgttatacctgctcaaatccacgctccggcgtggattttttttgcccgcgcttcagggtgcgttccgtgccagtaaggtgataataaacacgccaccgatacccgccgtgataatgccaatcggcaactcctgcggcgccagcattgtccggctgacaatatccccgccgcacagcaggatcgccccccagatgccgcataacggcagcaagcgcagatgctttacccccgcgaaatgccggcacaggtgcggcaccattaatcccacgaagccaattacgccggttaatgccaccagcagtgaggtcgccagtgcacagcagagaaatatctcgatgcgcaggcggctgacgttaatacccagcgagagcgcggtctgttctccggccagtacgccatccagggcgcgccagcggaacaggacaaaaataacgatcaccagcaggctgagcagcgcgaagggaagattactccaggtggctaaccccagcccgcccagtgaccagaacagcacggaactggctgcccgctgatcgccggaaaaaatcaaatagctggtgagcgcgccaaataaaaacgagatggccagcccgcaaagcaccagatgctcagcgccgcgttgttttttaaaatgaaacaggagcagtaccgcgattgccgaacaaagccccccggcaaacgccgcgacgggcagcgtcagggcccccagccgatcgccaaaacgggtgatcaccagaaccgccccggccgacgcgccggatgagaggccaaacaggaagggatccgccaggtcattacgcgtggtggtctgcaatagcgccccgaccatcgccagccccgccccggtcagtgccgcaaggagtgtcctgggtaagcgcaaatccgtgacgatagtggtgaccatagctgttaccggtacatccaccaccttaagcgcccccagcacctgtaacagcgtgagaggaaccgcgccgcgggtaatactgaacagcattaagccgatcaacaccgccagcgcgccccacatcgcccagtgatagcggtaggccatacgcattaatttgccgccgtcgggtacatcgcccgcgccagcttttccaccgcctcaacgttagccggtcccggcgtcagttcggcatactgaagtttaaggtagcgctgatgctgaaccgcgggggtttgtttcattagcggatgattctccagaaaatgacgcagcgcgtccgcgccgctgcccgcctggtaatccagcaaaatgataaagtccggtgccgtcgccgcgacgctttcccatgaggtcgtgccccagctggtctccagcgcgtccagcgcatttttaccgccagccgcctcaatgatcgcttcaggcatggcgtatttgccgctggtaaagggcttatcctcgcctgaatcataaacaaagacctttaaaggtcgggttcccgcggcccgctctggtaaggcattgagtctttttttccagccgctgaccagcgcctgcgcctcttcgcgcttaccaaaaatcttacccagcgtgaggacgtcgttatacaacagatccatagtggctttatttttgtgtgcagtggtgaatacgcagctttcactgagaacaaaggtcctgatgccgtatctggctaaggtatccggcgtcacttcaccgccgggcttcatgccatagttccagccggcaaaaaagaaatcaggttccgcggccagtaagacctcaagcccgggatactttggcgccagttccgggatcgtccccatcgcctgtttaaattgcggcgtcatcttgtaccagccgctgatccccgtcagcccgacaatgcgatcctgcagatgcagcgcaaaggccatttccgccatattcagatcgttgataatcgctcttttcggcgggccggtgaaggtcaccggcgttccgcaactctcaatggtcaccggaaaatctgccgcgctggctgcagaaacagacagcacggccagcagggtgataagcatttttttcatgactgactctcagaattcatttacgcacaatgcggcacttcaaaaatacgcaacgcccttcctgtctcagggtgcggtacggtaaagctggttaatccaaagacgggatacaggtgttctgaaatcagaactttatccggggtgtcgcagattgtggaacgcccctgtgacaggagaagcacccgatcggcaaaggatcccgtaagggtcagatcgtgcaaaaccgccaccaccgccatccccttacttttcaccagcgacagtaattcctcgcgcccggggggatcgagatggttggtcggttcatccagcaggatcagatcaggcgtctgcgccagtacacgtgccagcgccgcccgctgcctttcgccgccagaaagggcaaacagcgatcgcctgcgcaggtgctgcaatccgctttctttaatggcgctggcgataatcgcgtcatcttcatggcgcggcacacgtccggcatgaggaatacgccccagcgccacatagtcttccagggaaagccgtaaatcaggcgtatcattttgcgccagtacagctacctgtctggcccgctgttgaggagatagacaggataaagaccggccccgcagacgaatgtcgccgtgaagggacgtcagttcctgactgatggcccgtaataatgacgatttcccactgccgttaggcccgataatggccaggcattccccggtattaaccgtaaaacggatgtctgaaagtaaccttccgccccccggtcgcccggaagaccggatatcgacactcagaacgcaatcctgtgcatccgcatggcctgtttgcgggatagcgctgttgtttttcacgatgctgtttactgatcaagaaacacatgcaatatgttataacataacattaagcagaaaatccattttctctgctgctgcgatttatgccccccgcccaagacataaagatcaaacgagggttttcttttcagactatcccctgccatacccgccttaccctcttcctgatttatgccaggcttgtactaccttctgttttactggcaccgctaaccatccggggaacgcatgacacagacatcttctctttctgaccatgacattgcactcatcgatcgctactggcgagccgcgaattatctctccgtcgggcaaatttatctgatggataaccccttactgcgcgagccgcttaaaccggaacatatcaaaccgcgcctgctggggcactggggtaccacgcccggcctgaattttatttatgctcacctcaaccgcgccatccgcgagcgcgatctgaatatgatctatatctgcggccccgggcatggcgggccgggcatggtggcgaacacctggcttgaaggcagctacagcgaaatttatccggacgtcagccaggacgccgcagggatgcagaagctgtttaaacagttttccttcccgggcggtattccaagccacgctgccccggaaacgccagggtcgattaacgaaggaggcgagctgggctactcgctgtcgcatgcttttggcgcggtgtttgacaacccttccttgatcgctgcctgcgtcattggcgatggcgaagcggaaaccggcccgctggcgtccagctggtttggcaataaatttatcaatgcggcgcgcgacggcgcggtactgccgatcctgcacctgaatggctataaaattgccaatccgacgatcctcggtcgcgccagcgatgagaatttgcaggatcttttccggggttatggttatgagccgctgctggtaagcggtcacgagccagaaaaaatgcatcgccagatggcggaaaccctcgataacgccctcaatgctatccgcgattatcagcagcaggcgcgagcgggtacggcgtcttccacgctgccccgctggccgatgataatcctgcgcagtccaaaaggctggacgggtccacagagcgtggataataaaaaggtggaagatttctggcgcgcgcatcaggtgcccgtctccgcctgccgggaaaacgacgatcatcgtcacatccttgaacagtggatgcgcagctatcagccggacgatctctttgaccagaaaggcctgctgaaagaagagctgcgcgccctcgccccgtccggtgagaagcgcatgggggcatcgccttgggcaaacggggggctgctgcgccgtgagctgaacacaccgccgctgcgggaatttgccgttgatgtcgcctcacccggcgagacgcaaaccggcaccaccgccgcgctgggggcttatctggcgggaatttttcagcaaaacccggataatttccggctgttcgggccggatgaaaccgaatcgaaccggctgggcaaagttttcgatgtcaccagtcgtacctggctgctgccgaaaaaaagctatgatgagcaactggcggcggatggccgggtaatggaaatcctgagcgagcatcagtgtcagggctggctggaggggtatctgcttaccggccgccacggtctgtttaactgctatgaagcctttatacatattgtcgattcgatgtttaaccagcacgcgaaatggctgaaagtcacgcgcaagcttccctggcgtaaaccggtttcctcgcttaactatctgctttcgtcgcacgtgtggcggcaggatcataatggatacagccatcaggatccgggatttattgatcatgtggcgaataaaaaagccgatattgtgcgcatctatctgccgcctgatgccaataccctgctctgcgtcgccgatcactgcctgaaaacctgggatcgcattaacgtgattgtcgccgggaaacagccttcgcctcagtggttgacgctggaggaagcagaaaaacactgcgcggcgggcatggggatctggcactgggccggtaccgtacaggaaggtgaaaagccggatgtggtgattggttgtgcgggggatgtgccgacaatggaggcgctggcggcggtggatctgctgcgcggctacctgccggagttgcgcattcaggtggtgaacgtggtggatctgatggcattgcagacaaaggatcagcatccgcacggtcttgacgacgacgcttttgaggcgctgttcccgtcggatacgccggtgatttttgcgttccacggttatccgggacttatccaccgcctggcctataagcgcaagaaccagcagcatttccacgtgcatggatttattgaagaaggcaccacaaccacgccgtttgacatgacggtgctcaatgaactggaccgcttccatctggcgcaggatgccattcagcatatcccttcgctggaaggaaaagcggatgccattcttgatgcgctggcggaaaaaattgccgaccatcaccgttatgtgcgggaatacggcgaggatctgccggaggtacagggatggaaatggccgtcacagcaggatggcgcaaatattcctgaataaaaaaacggctgcatcagttactgatgcagccgtttgtcctgcgccttaaaaccagcccggcccctgcgccagctctttacgctcaggcggccgggtgtcaatcggacgggcggcgagatgcttcgcccacagatccgcgacccacttcacccctttttgcgtaaagcgcgcctgtgaccaggtatgccggttctcaccggtaccgccatgcagagtaaaatagcctgcctggatatgatgcagcggcggcgtcagcgtgccgttggtgcgcatcataatgttgcgctccagcaggaaattacgaaaatccacttctttcgccttcagcattttgcacagctgacgaaaacccagcgactcatttacctgcacaaactcatcgaaaaaggccgccttaggggcaaatagctcaagctgcttttccgcacgctggcaccgctcatactgttcggcccaggcacgcgccgccgcagccggattagtgaaatccggcaggctgatgtctttttcacgctcctgccagcgatccagcatctctgcggtataggctggagaaatgcgtgccaccgtcagcagcgagtcccgtttattcaacaagaactcttcgcgcatctcaccgtcggattcgtactggttgcccgtgacaggcgatgagagacgttgcgcggtttccaggcttttgaccatacgcttcacttcagtgtgggcaacgcccatcaacttcgccagctcacggctgctcattgtcacggcccgattctgcgcctggagagtatctacagaaatcatcatagggttcaccactcacttcattgacacaataaccaccaaactgaggaaataataaacaattgctgtgtatttatccagtattatttttgttcacctgagattaatggcctcaggaaaatttcctgtcgcctgtgacaatggtcacctttctgccaggattaaaatatgtggattaatcaatcaggtaacacatcacaggagaaagaatgtctattcgcggtatcgaacacattggcatcacggtttctgatttagcccaggcagaacaattttttatcggcgcgctgggggcttctgtactgtacagaatgatcccgcccggggatgacagtaaacgggtggaaggtgaaaatatgaatcctctgaatggttttccgcctgaaatgaacgtgattggcctgtcgatgctgcgcctggcaaatggcagcaatgttgagttgttccagactgcgcctgcggtcaacgatcgccctgcacatcctggcctgccgggtattaatcatttttccgtatacgtcgacgatattcagaaagcgggcgtacagatgcgcgcccacggggctaagatgttcgacgggccttcagactgctttggtcaggaagaaggccagggaaatcagacctggtttggcatgacgccgtttggcgtgttaatcgaactgatttccctgcctgccggggtgaattgtgacgacggcacaacgcagcagcgctggatcccggcaccataaataaaaaatccacgcggctgcgtggatttttctttgtaagcgatcagttgagtttaaatacggccacggtttcttccagaacttttgactgctcctggagagaatgcgcggccgcagaagcctcttccaccagcgcggcgttttgttgcgtcaccgtatccatctgcgccaccgcctgattgatctgctcaatgccgcggctttgctcgccggttgacagggcaatttcagacatcagctcggaaacctgcctcaccgaggtaataatacgctgcatgcttgcccccgcgctggtcacgcgttcgctgcccagcagtacctgcttaccagattgctcaataagctctttgatctcttttgccgccacggatgagcgctgcgccaggttacgcacttcactcgccaccaccgcaaaaccacgcccctgctcccctgcgcgggccgcttccaccgccgcgttaagcgccaggatattggtctggaaggcgatgtcttcaatgatgccaatgatggtgtcgattttgccggagctggattcgatttccttcatggataccacggcttcttcaacaatggcgttgccttcctgcgcggcgctgcgcatgttgctggcgagcgtgttagcctggagggtgttttctgacgtatgtttcaccgttgaggtaagctgttccatgctggctgccgtctgccccagcgacgcggcctgttcctcagtacgcgccgacagatcggtattcccggcggcaatttcttcggctgcatgggccacgctctgactggagtgacgcacctgggcaatgatctccaccagcgcaagacgcatctgatccagcgacgacaacatgtcaccaatttcatcccgtgcatgggaaatcaccgggacatgcagttcgcccgccgccattttctgacagtgcagacgcgccctgtccagcggcgacaacactcggcggcgcagcaggacgtaaatggcagcgatgatcagcgtaaataccagcgcaaaaataccaatcgtcagcatgctgttcataaagcgattctgtgcttcattattcagacgctgagcgtatttttcgcggaacgccagcaggttatccagcgtaatttcaaactgacgatcgagctgcggaatagaggtgctgaccagctgattaaagcgagcgctatcgttgcggcttgcggcgtccatcagcgggcgcagtccctcatcaacataggtctgccaggcgagacggtaaggcgcggcgaattcttcttcgccagccacgcgcggcgcggcctgatagttattaaacgccgctgtcgctttttgcattgtctcattcgcgctggtcagcgacgcctgcgctttctggttatcgcccagggacgcgttaatcatcgcctccattaaacgcacccgcagcgtgcggctgtggttaataggatcgataacggaaaggacgacacgaatttccttgttcacattatcaagcgactgattactacgggtgagtgaccagagactggaggccgcgctggcgagaaaaatacagagtaaaaaagtgaaaacgagtactgaaaaacgccttactgacatgatatacccttgcataatagtgctatgtaaaaactaacgcctcagaatgaagagcgtcatcagcagttatcggcaaatggtatggttaacttagtaaaaataaggagatttacagaccagtccgccctgaccggcctgcgtcttttaccccggacttagctgcgatgagtattgactacctgaccaatacccttaccttccagcgtttcctgcggatcggcaaagaaatcaatattaaagtacgtatcgtcggtcagcagttcgacgtgatgccagtattccggtgggctgatgccaaaatgcccggcctcgataaccacttcgatttccggcgtggcgtcatgttcgctggcgaagccatagtacttcaccgcgccctgcatcacggataaccggccataaacgccttttttggtgttatggtgcgttaacagcgcctgcggcaccgtctctttagtccagaacggggtggaacgggtgtgacgaaaatgaacgggaatttgtaaagccataacgggaacctccgattttagtcgtgttaccagccacaaacattagtctcttcatctgactcgtagccacgaacgatattaatcaggtctttaacggcatcagcaacaacaaggggatccctgagttcgtcaatgctgtcaaaatctttatccacggatacgccattattattattggtaacagtcagcacaaaatccttatcgttttctttgctatcagataatcctgcaaccaattctgttaccgcctgcacggcaatatccggaacatataacgccatcggtttgagatagattttttcctgaatctctttactgcggcgattttccactgctaaagaatagcctttattatcaggtgccatcatactttccttaactttcaatcaaaatttgcggatcgacgtaaaaatccacgcagaacagggtgtcatcggttagcgcttcgatgttatgccatttctcgggcggaaataccccaaactcaccggcgttaattgttaacgtctcaatgggttgcgggctggtttcatcggcgtaaccgtaataacgaataatgccgcgcatcacgctcagacggggatagacgccctgtcgcgttccggcatccagatgccgacgccagatagaagaaggtgcggtctctttagtccagaaaggcgtactgcgggtgtgaatataattagcgggtataacgatacgttgcatgtttcaacctcgttcatttcgttaagcgcggcttaacgggaggggaaaaccttatgttgcatatcatatacctgttttataatttgtggactactttttagaaataattttccgctcttaatgttaaatatttacagcgtttattaacacgtgctgtcatttgtcctgccgctgagcataaatggataattaatataaaatgctgctatataccccttattaactattgcaataaggcaagccagtaacttgagtagaaaaatattactccttaataattacgcgcaaaaaacttgatgaattcctaaaagtaaggtgaagggtcaggaggtaacaaatttctggtggggggaaggtaaactgccggtgggtgcttgaggctttctggctttgagcatttgcaaggttcagaaagacgaaagccccaggcgatgttaatcaacctgaggccaacgtatgaacctagacaattcagatgttagtctcttcttcgcacggaggcaagacatgctgacaaagtacgccctggtggcgatcattgtgctgtgtttgacagcgctgggattcacgctgatggtgcgcgattcactctgtgaactgagcatcaaagagcgtggtatggagtttagggccgttctcgcttacgaaccgaagaagtagcctgaacgcgggggctcagtccccgcgtgtctggttgccgggttgaattctcaatgcacccgtttcttttctgttactgccccacctttatatattcctaaaagcaaataacgaccttcaatcgtgatagctttcacaatatcgccatgtaggatcgcgggtgggtgcttgaggctttctggctttgagcatttgcaaggttcagaaagacgaaagccccaggagatgttaatcaacctgaggccaacgtatgaacctaagcaattcagatgttagtctcttcttcgcacggaggcaagacatgctgacaaagtacgccctggtggcgatcattgtgctgtgtttgacagcgctgggattcacgctgatggtgcgcgattcactctgtgaactgagcatcaaagagcgtggtatggagtttaaggccgttctcgcttacgaaccgaagaagtagcctgaacgcgggggctcagtccccgcgtgtctggttgccgggttgaattctcaatgcacccgtttcttttctctcttccagccatacccatattgacttattttgttatcagcgtacttttcaggacatgaaaacttttttgattattgttcccgatggcggcatgttgttcgaagctgccggtatcgccgatatcctgatgcaggccaaccgcgtgcaggcagagcagcacgcgccgccgcgctatcagatcaccattgccaccactcagccgcaccaggtgatccacgggcagtcggggttgaacctgctggcggattatcgtctgccgcagctcgatccgcgtgagctccgcgacaccattatgatcaccgggcgcggcacaaatgaagatgaaggcgtggcggtggtcgactggctacgtcttgccgccccgcacgccaggcgggtagtgtctgtttgcggcggcgcgatgctactggcgcaggctggcctgctgaacggacgacgtgccacgacacactggaagctgctggaggagatgaaatcccgctatccactggtggcagtggaaagcggcccactctatgttcaggacggccctatctggacctccggcggcgtgagttccgggtttgatctgacgcttgcgctggtagaggatgattacggatttaccctcgcccgtgaagtggcccaggatctggtgatgtatctgcgtcgccctggcgggcagatgcagttcagccgtttccagctgcaaaactgcgatcttcccggcccgataggtgaattacaacgctggatcctcaataacctctctgctgatttatccgttgaaaatctggcggatcgggtggcaatgagcccgcgcaatttcacccgtgtctttacccgcgacgcgggtgtgtctcccgcgcgcttcgtggcggaagcgcggctggccgcagcacgccaccagctggagcagacccgcgacaccctggagcgggtcgccatcagcacgggctttggctccagcatcaatctgcgccgcattttcgagaagcagctcaagctgacgcccggcgaataccggcagcgatttcacagccgcaatctggcgtaatgtgatccatttttgtcatttacgccactcctgacccggcctactctgaatgcagaaaccgcataacaggaggcaatcatggttaagatcggtattaatggcttcggcaggatcggacgcaatatgctgcgtgccgcgctgggtagcgacgacattcaggtcgtggcgatcaacgacctcaccgacagcaaaaccctcgcgcatctgctgaaatacgacaccctgcttggcacccttgccgcgccggtggaagccagcgaaggcgagctgaaagtagacggaaactccatccgcgtcttctccgagcgcgatccggcgaacattccgtggagcagcgtgggtgttgagatagtgattgaagccactggtttcttcaccgagcgtgaaaaagccgaagtgcatatcacccacggcggcgcgaaacgcgtgatcatctccgccccggcgaaaaacgacgacctgaccgtggtgctgggcgttaaccacgaaaattacgatccagaaaaacactttgtggtcagcaatggcagctgcaccaccaacggcctcgcccctgccgcccaggttttacatcagcattttggtatcgagcacgggctgatgaataccacccacgcttacaccaacagccaggcgctgcacgatcagccggagaaagatctgcgcggcgcacgagcagcggcagagtcgattgtgccttactccagcggcgcggcgaaagccctcggcaaagtgatccctgaactggacggtcgcctgaccgggtactcgctgcgcgttccggtgccggtggtgtccattgtcgatttgaccgtcaccctgaaacgcgacgtcaccgttgaagaagtgaacgccgccttccgcgaggctgccgcatccggtccgctacaaggtattctgggttacagcgacgaaccgctggtatcgagcgattaccgtggcgatccccgttcatccattatcgacgggctgtccacgctggtgattggcggcaatctggtgaaaattctcgcctggtatgataacgaatggggcttctcgaaccggctggtggatctggcgcggttgatggcgaaacgcgggttgtgattgatacgttaatgccgggtggcggctgcgccttacccggcctacatcaccacaatgttcatcgttcatgtaggcccggcaagcgcagcgccgccgggcatttagattttaaaacaggcccagcggctttccgctgtagctgaccagcaggtttttgatctgttgatactgactcagcgccattttgtgcgtttcacgtccgacgccggaatttttatacccgccgaaggccgcatgcgccggatacagatggtagcagttggtccacacacgaccggctttgatcgcccgtcccatacgccacgcgcggttaatatccagcgtccacaaccccgctcccagcccgtactccgtatcgttggcaatgcgcagcgcttcttcttcatccttaaaggtcgtaatacccagcaccggtccaaaaatctcctcctggaagcagcgcatactgttgtggcctttgatcagcgtcggctggatatagaagccgttttgcagggtgtcgccatgatcgatatgcgccccgccggtgatgatctcgccgccctcttccctggcgatctcaatgtaggagaggatcttgtcgtactgctcgcgggaagcctgcgcgccgatcatggtgtccgtatcaaagggatcgcccttgcggatggtttccatgcgggcgatgactttctccacaaactgcggatagatcgactcctgcaccagcacgcgcgacggacaggtacagacttctccctggttgaagaagccgagcaccgcgccctcaacggctttgtcgataaactccgcgtcgccgttcatgatgtcttcaaagaaaatattcggcgatttcccacccagctcaacggtgctgggaataatattttccgccgcacaggagagaatatgccgcccgatagaggtggatccggtgaaagcgattttctcgatacgcttgctgcgcgccagcggctcacccgcttcggtaccgaaaccgtgcaccacgttaagcacgcctttcggtagcagatcgccaatcagttccatcagcacgctgatgccgagcggcgtctgctccgccggtttcagcaccacgcagttgcccgccgccagcgccgggccgagtttccacgccgccatgagcagcggaaagttccacggaatgatctgaccgaccacgccgagcggttcataaatatggtacgcgaccgtggtgctgtcgatttctgccgcggtaccctcctgggcgcggatacaaccggcaaaatagcggaaatgatccaccgccagcggtaaatccgcccccagggtttcgcggatcggtttgccgttatcccaggtctccgtcagcgccagcagctccagattttcctcaatgcgatcggcgatcgccagcagcacatttgcgcgctcctgcgcgctggttttaccccaggcgtcggcggcggcatgagcggcgtccagcgctttttcaatatccgccgcgcccgaacggggaaactgtgcgatagcttcacccgtcaccggcgtggtgttatcgaaccagcgcccttcgaccggatcgacaaattcgccgccaatatagttgccataacgttttttaaacgagactttcgcgccgttcaggccaggatgagcgtagagcataagatgttcctctgtttttataagtaggggtgaggcgtctcgccggtggcggacaatatggaataagcagttcttatgccagttcagcggcataagaactgctgtttatttttttattaattattaaatacatacgcttattccttctcatatcgccgtgcgccgatccagacacctgttgcggaagtgtgttgcacgtcgctacacgtgagacacctttatgctacacattcttaacattcctttttccggagtcagcgatgccgcaacccgtaccctgccaggtggaagcctcctggcaacgcagcctgaattatggcctgcaacgtgacgacgacagccagccgtgggtcgcatccggacagctgaaagaggcgcgagcggaaaacacctggatcagccgcctggcggatccgctgctggcgcggctgcatccggaactcgccagccatccgtcgataatggtgctttccgacgccagcgggctggtgctggaaacgcacggcaacagcgattttctgcataaagcccagcgctatgccctttctcccggcaatttgtggggcgagcacgcccgcggcactaacgccatcggcacggcgctggcgctgcaacagcactgcgaagtctccggcggcgagcactacctcagccgtaacgccgggcttttctgctccgcctcaccggtgttccgcccggatgggctggtcgccggagtgctggatctctcgacgcccgcccacgcaccgcgccccgatgcggcggcaattgtgcgacgcgccgtttgtcagatcgaacacgcctggaccaccagcgccgcgggtacacagcgctggctgctgagtctgcacgcggatgccgccctgcccggcagcgccggggaattgctgtttatcgttgaagataatgtcctgctcggcgcgaatagcctggcaatgaaagagttcgccctgctgccggcgcattttggcagcaccgccatcagcacactgctgccgcagatcgccctgaccggcgggaccacccgcaccgtcgcctgcaaccagcggcattacaccctgcgccagacgccgcccacccgccgttatcccggacgcggcatcgctgcgccacaggccgtggtcgatccgcaaaaagccaaagcgctgcgcgtactgaacgccgggatcgccctgtgcgtgaccggggaaaccggctgcggcaaagaacatctgagccgcgagctgcacgccagcagccagtggcgcactggcccgtttgtggcgatcaactgcgccgccctgccggaaaatctgatcgaatccgagctgttcggctatgcgcctggcgcctttaccggcgcaagtccgcgcggttacagcggtaagctgtgcgaggccaatggcggcgtgctgtttctggatgagatcggcgatatgccactgacgctgcaaacgcggctgctgcgggtgttgcaggagaaaaaagtcaccccgctcggggccagcaccagccgtgacgtgaatttcgcgctgatttgcgccacacatcaggatctggttgcccgcgcggcagccggggcgttccgcgaagatctgctttatcgcattcaggaatatcacctgcgtatgccgccactacgggagtggcctgaccgcgaagcctttatcctcaggctgtggaatgaactgggggccgcaaaacgtcagctgacgctgagcgaagcggtggtcagtgagctggcggcgcgcccatggccgggcaacgtacgccagctgataagccagctgcgggtgctgatggcgctggctgatgatggtgagcacattgggctggcggatctgccggaaagcacgcctgcacccgcttatagcgatgagcttgccattgccgaagcgcagggcaacatgagtctcgccgcccgtaaattaggcatctcgcgcagtactctgtatcgccgccgcgaaaaacgccagccggtttaaccggggcgcatcccccggcggcgcaggcttgccgggcctacaaatgaacgctgacccgcaggccgggtaaggcgcagccgccacccggcatcccgcaccacgctaccgccgaacctcatactccggctcatccgccagcagtttcgccatatacacccggtcaatcgccccggtatcgtaatgcgccagcgtcagcacccgcgccttactcaactccagcgccagttccggcgtgatggaaaaactggcggcgacttcgtgcttttccagccccggacggcggcggcggcgctcgacgcgaaaacggtgctgattatatttcgcccagccaatcagcacggcgccgatcagtaatgccacagccatatacagcatcaccgtaccgtaagtgctgtaaaaaggccgcaccccgctgtcaggcgactccgccagcgcgaccatcagcccggtatagatcagatacgaaaagcccagccaggccaccagcgtcagcacggcgtccatcacccgcgggaagacccgctgttcagtaaaaatcagaggttcattcatgattcaattctcccgataccgcgatccgggctgacccagcgtgccctgctgcgcttacgcgccagcatgaccttagggaaagccaccagggtggtaaataaactcaacatccagtagaccaccgggaaccagatgatccagaacagcgacgccgcaatgcccttttcgtaacgccgctcaatcagcaaactgaccataaactgcaacagacacaccacgccgagcatcagcccggtaaacgccggtggaaacagatgttgaacatgtaaggaatccggcataggcagcaccatgccgaagaggaacagcaaaatgctgatcgcataggcgaaggcccaaatcgtcgataagcaaaactccagaaacagcggccacatgcggcgatattcccaggcccacaggcgacgcatgttgacgataaacacttcggcgccgccctgcgcccagcgcaaccgctgcttccacaggcctttcagcgtctccggcatcaggatccagcacagcgcccgcggctcaaaaaatactgaccagtgacgcagttgcagcttccagctgatgtcgatgtcctcggtgatcatgtccggactccagtagcccacttccgccagcgcccggcggcggaaagcggcgatcacgccggagacggtaaacacctgaccgtagatccgctgggtgcgtttgataagcccgatgatcgacgtgaattcccccacctggacgcggccaatcagcgtggagcgggtacggatgcgcggattgcccgtcaccgccccgacccgcgggtaaagcagcaacggcgtcaccagataagccgcggcgtcgcgatccagcagcgcatcgccatcaatacagacgaggaaatcgctgtttgccgccgccgcgcccgcctgtagcgccaccgccttgccctggttttccgccagatggatcacccgcaggcgcggaaactcttccgccagtccatccagcaccgccccggtgttatctttcgaaccgtcattaatggcgatcacctcgatgttctgatagcgctgcgccagcgccgcctcgatggtttcccgcgcgttcagcccttcgttataacaggggataagaatggagatcagcgggttgcccggcagttccggcgcgggcgtccctttcccccagggccagtgccgctcgcggtagaaccagaaatacagcccgccgctgatccacagtgcggacataaacagcggccagaaaaacacgaaattgaggatcacttcacccgtgaaaatggcagccacgcccagcgggaagctgaacatcaggcaaaggatcagaaacgcgacgatgcgatcggtcatttttgcgggtaccagtaagaggaaaaggtggggcgtattgccgacatttcagggtgatcgttaatgaaatcgtcggggtaatagccatagttttttgcgccgctgagtttcagctgacgcatccagtgagccagctgttcaccgctgatatcggcatgttcgccgcttttacgccagtcgcgggcctgcagctcaaagacggttttatccagcgcgccggggatctgcgccacgcggttaacaaggctgtcgagccaggcatcgtcctgtccggcgggcacgttttccatcagcggcatcgccattggcgcggtccagtcgtacgcgccgaggaaatcgttcaggttttgcgcaaaccaggcttcgctggcgggatcgagcaccggcatggcgtagatattgcgcgcggttttcacctgcgggccacggatggcgcgcacggtttccgtcagctgtttcgtgaagtcgatcagcgcccggctcttgaagcgcgtccagcgctccatcgtttgcggattgctgcggatctccgcaatgctggcggggaatccggcggcctgataggcgcgcatcgcgtccggtgacgcatcctcgaaatcagtcagcatggcgtcatcgtggaacaaaatgccgtggaaggaggcgtgccgggccagatcctcgtagatatccttaatgcgctggcgcgccaccgggctccagggcgacagccgcacataatgctgacgatccaccgccgcccggccgctctccggcgaccaggcctcaacgcgcggcaccgaggcatccagatcgaaggccagcaccggcatccaggcataaacgttcaccccgccacgggtctgcaattgccaggcgataaagttgaacagatcagcgcgcatcggcagccagcggttagggaaatagagctcacgaatattgccatcaccctcgggatcggcgtacgcctgcaaaaagacgtgggagatgcgcatgtcgtaaacgcgctggatcagcttgtcgatgttcttgcgctgctgcaccggatccttgtcatagacataatccagatcgatatgcatcacgcgcattgtctgctcctcgcgcacctgcgcgacctggctggcaaagttacgcagcgacgggttatcagagatcagaatgcgcggcacatcgtcgagactggcggcattggcaaggccagggttcagggtaaaggccatctgataaccatgctggcgcgccagtttcagcgtcgtgccgttggccgcgccgtaaggccagacccaggcgcgcggcggcttaccggtcacctcggcgatctttttggtgacgcgttcgagatcggcattgatgcgcgcttcatactgcgcatcggtttcgtactgcccggtatttttgtcatataaccggttcgccaccgccggttctttactgccctgtggattcgcctgcacgccgtagtgcgatgcccaggtatgcgcgccgatctccactaaaggcgacttgctgacttcgcgcaccatctcccaggtggcgaacttatcgcgcgcggttttcaggccgccaaaatccaccggctgattggctggcgcgtccacccagctgccgacgggcgcccataacgccgggaacttatagcgctccagcagcggccagacgcgggtgtaaaaactgctgtaaccgtcatcgaaggttaacagcaccgctttttccggcaggacgatcttcccggcgtgagcatccgctatctgctgtacgctgatcgggtgatagccgttgtcacgcagccaggccagctgatcgttcagcgcgctggtacgcactgacagatagcgctgatccgcggcgtcatcttccacatcgtgataccccagaacgaggaaactgtttttcggccaggcgtgatccgcattaagcggtacccggtcggcggggggaatatagcggggcgtctcggcgctcccgcacgcggtgatcatcagcaatcccgcgaaaatgatcccggcgtgcagccatcgtctaaacatgaaacgtcctcaaaacctgacattcaaatcaaaagcgagggcaatgttgcgctcccgcttaccatcgtagggacgcttatcccaggtgagcatcaccccggtatccaccacgttattccattgcacccgctgcccgtaaccgaactgcgttatcgcgccgctggactggcctttctgccagtagcgccccgccccggcctgaaactgctgtttccataccgtgtcgtaatggcgataaatcacatgctccgcgctcagacccggcgccagcgagaaatcccgctgcgggttgtaatagggcacgtcttctttagtgttgtgactgccgctcagccccggcgtgaaatccagcgtgaagcgtggcgtggtccacagccgctctttaccgctcaggctgtattccaggcgatcgttgccatcggagaaatgcgcggcggacaccgaaactgaatattcgcggcgttcgttcttgtaccagcgcagccacagatcgccgccgtcggcgctgacgccattacgcagagcgcgcagcggggtattgcgcgacagccgttcggcggagccgccgatgcgccagttgtcgttaaagtcgtgccagccggaaaagcgtgcgccgatcttttgtccgtcgccatagttgcgcccggagatctccagttccgcccagttattgcgtgaggtccactcgacgcctgcggcaatatcccggctgatgcccttcccttcttcgaactcgccggtggcaaagttgaagccggtgaacaagcgccagttatcgttgatcggcgggctgtagagcgcagagttaagcgtgaaatcgtgctggccgctgatcgggctgtcggagtcgatgccctgcccgccgctgatgcgcagctcggctttttcgtgcacatcgatgatgcgtttgagccgcagactggcggcatcgtccgggctgcgggaaataacatccgccgtcagctctttcgcctgccgccactcctgtagttccagcgcagtggcggcctgctgacgttcaagggaaaggttgctcggctcgatcacttccgccagcttcagttcccgttccgactcacgcggcaggccgcgcgccagcagcaccgcggcgtaggtaatgcgcagcgcctggttgccggacccggtacgcgccagcctttcggcatggctttccgcggcgggcagatcgttggtggcgatctcatattcggtcagcagcgtctgcccgagcagccagttatcgttcggctgcggcgtcggcgagccgtagacccgtttcagataagggctgtctttgatcagcgtatcgacctgcgctttggcttcttcaaaatggttattatcaagacgagcgtaaaacagctcctgctcatcgtcgctggtcagcggcgttaccggcagcgggccgcgcgggaaatacagctgctccagcatggcttccgctttatcgggctgttcttccgtcagccaggccgaggcgatccaacgcttcgcatagtcgggaaccggcttgtcatcggcggtgagcgactcatattcacgaatggcttcggcggtgcgtttgcggatcaccagcgcgcccagacggtcaatacgggcgcggcgcagatcggctgccgcctgcggattatcctgccacgcggcgatcagccggtcgtagcgggccagcgctttatccgccaccagaaagcgctcctcttcgttgcgcgtcggcgtgaacgcggtgcgtaccgtctgcgcggcggcatcaagctccagcctgcgcgccagcgcgtcaggggttttgctggtttccgacagttcgagcgccggtccggcaatacggttcgctgacatcgccgccagcagcgtcggctgcacgcttttattctgcggatccagcgcctgggcgcggctggcggccagcagcgcgtcccagtttttgccctgcgcgtgataaacgtaagccagcaccgcatcgctctccggccccggcgtgctttttgcccaggcggtggcctgggtgatggcctcctggttacgacgggcgtccgccagcgtcatgatccagcccgcgcgcgcatctttgtcgtccggcatttcccgcagcacgttgtcccataccgccagcgactcatcccatttcttctggttgcgcagcgcccgcgccaccgccagctgaccacgtgccgggatcgccatgctgccctgataacgcgaccagatggccagggtttgcgcgtcgttatccgaccaggccgagacctgtagccagtcggcgacctgacccggcgtcagacgcgtttgggtttcctgctgtttgagataattgagtaagggcgcactgtctccgctgcgagcctgaataatcagttgatcgtagaccggggtttcagcccaggcgaaaaccggaaacagaatacttgctgtaaataaacaggttccgggactaaagcgctttacgcaattttcacgtcgtcgaatactgaacataactgtccttatatccttataccagagatgagcttttcattaatttattgcggcaatatgaccggctttaattcaatacaccagacttaaaattcttctcaaaaataaataaatatcatactttagtcgtatttaaatttatttcagcatcatctaaagcgggtaaaataattatcatgacgctaatccaacgttagcctttatatataattactgcactactacatgcgtattttttacataaaaaaagccacgcattagcgtggcttttgtaggaaggctgcgagttatctgccgctgtggtgatccacccggagatggtcgacaatcagcgcgcgggtgctggtttgctcatcatcataaggcgtgcgggtttcttcaatcagacgcccggcgttatattttttcaccgtctcaacattgtgcttttcagcagcctgagtaacggatttcacttcccctttttcattgaatgccagcgccgtttcagtgctgcttctgtcatcaatctgatgatagctatagttttgcgacgaggcttcaagggttaacgccagcggaacggttttatcaatcgcctgatgataactggcctgcaaatgcgcagtggttttctgcgtcagcctgccggcattttcgcgttctgtgcgctgagaagaggaataagcaaagctatcgcgctcatctttacggaatggatttggtgatttatcggcctgtttaaaattcgcagaataatctgccagaccgcttaaattttcctgcacgacattatcgttagtacgcgtaataatattaaggcgattatccacttcatttgagccgtactgactgttcagcgccataaagctatttttaaacatatcaataaggtttttatcaccctgaccgcgtgctcgggcgctgtcgagctgactggcccagctggcgagcgcctgctgttgctgcccgtagctgcccaccgtttccgggtgcgacagatcggtgctcagatcgaacgccaccttgtcggtttgataactcatcgcgcgggcgctgctgtcggcatggaatttcagcgactgcagcgaatccgcatcttttcgcacatccgtttgcagatcgacggctttcagcagcgtgctgtcaaaattcatcagcccctgcaggttaagcgacggcgtgtcagccgacaggccatcgagcgtgctctggaaagcatccgctaaaccggcgatggcggcggtttcatcttcagttaattcacccccggcggttttcagttccacgaccaggccgttctggttgcgcgtcataccgaggctgacgttgataccggaggcggtggtgatattcagcgccaccgcacgatccggctgacgctcctgcgcgccctgcgtgtcaaccgtcgccgacagggtgatgccctgcggatgatcttttagcccttcgagcagcgcttttccgaggccctggaaggcatccgcctgcgcgccgcgcacgttggtgccgatcaaaatgctcagctggctgtgatcaagccctgcggtgttgacggttttcgccggattcaggctgtataccgccggcagcgtggtggtgttattcagcgagacgatagcggacggctgagccgccgcggaggatttgttctgcgtggcctggggaggctgcacgcgcggcgccagcaggctgttgatggtggtggacaatggtgaccggacttgcatgatattccctcatttcatgacgttattcggttatcggcggggaatggtgaaacattaagcttatatatcgagcacttgatgcagataacatttggcagggtgcagggacaggtccagtggtaggttcagtggtagtgttccgttcactttgcgtttcgtgtcaggcgtgacgccgctgacggtgaacgtgctaagggggccaccgcggcccccttagcaatccccgcggccccgcaaagaaaccggtgctgcgcattgcgctcacctcccggccgtctgcccgcggtcggctcgattcggcatcctgcctcatttcgcctctggccgccatccatggcgtccagcccttgtcatccggcctccggctcgccggtttcagcggggactcaacccctcgcgttaattacgatgacggtttgttacgactgagtggctttgtgtttgtctgaacttacaggaagctgtgaatggtgttttttagaaatcatgaagtgtggggagtccggctgaaaatcgctgaggcgttcccttacggccggggcagcccgcatggatgcgggatgagggcgcgacttgcagggacgctgcatcgcgcccgacccgaagccggaagggataagccgaaggcaccgcgcagcggcgattttcctgccgggagcccgggggtgcagggggcggcggcgactggccgccccttgcgcgctctgtgcgcccactgttaaagccttacaaaaaagccagtaagagcgcaacctacccggtaccaaacataatactcataagagcgcaccttaccccgtacaaaatgcaaccttaagcttcaagccggaactgcgccaccgtctgtgccagctgccccgcctgatcctccagcgagctggctgccgctgacatctgctgcaccagcgcggcgttctgctgggtcacgccgtccatctcattcaccgcgatggtcacctggctgataccgcgcgactgctcttccgaggcattaacgatctcgccgataatactctgcaccgagctcaccgcctgggtcatctcctgcatggttttaccggcgtcctgcaccagctgcacgccgctttccacgcgctgggtcgactcctcaatcagggtggcgatctctttcaccgcgctggcgctgcgctgcgccaggttacgcacctcggtcgccaccaccgcaaagccacgcccctgctcccctgcgcgcgccgcttcgacggcggcgttgagcgcgaggatattggtctggaaggcaatactgttgatcatggtggtaatgtcgcttattttgcgggaactctcgtcaatctgcgccatattctgcaccacctgcccaaccagtttttcaccgcgactggcgatgcgggtggcgttcgccgtcagctcggtggcctgatgggcgttgctggtattgtgtttaacggtagcggtgatctgctccatgctggccgccgtctgctccagcgccgcagcctgttgctcagtacgggaagccagattcaggttgccgctggcgatctcctccgccccctggcgcaccgacaggctggcgtctttgatctgcccgacaatctcccgcagttgcgtctgcatggtattgagcgcgtagaacaggctgctgcgatcgttgccgtgcacggtaatcgcgttgcttaggcgtccatcggcgaccgccagcgcgaagcttgccgcctgacggggttcgccacccagcggtttgagcactttacggctgaacaccagccccagtaaggcgctgacaatgacgatgcttaacaccatcaacgcaatggcccacatcaactggcggttagccgcctccatcaccagactgacaggcgcgaccacgcccagcagccagtgctcatcgctgttgccgacggtaatcggctgccaggtgaccagcgcgtcttcgccgaggatcggatcgtggcgttcagccatggtgctgctcaggccacccaccggttcggaccaggctttgctggtcagggatttatccggataagcgacaattttgcctttactggaaagcagcactgcataacctgcgccatgccagggtttgatctgcgcgattttgtcctgtagcgaggcgagtgaaatatcggccgtcactaccgcccacaatttcccttcctcgacaatgggcgcggccacggaggtgagcagcgtatcgacgccgttataggcgtaagtgtacggctcggtaacggtgtctttgcgggatttttgcggcagcagatagtaatccccctgccccggcgtcagataactggtcagcgggtgcatgctgtatttaccgcccgcgtctttatcaacgaaccaggcgtagcgaccaccgggcgcctggcccggcagcgcggcaaactcggcgtcacgtccgtcgagggcgttctcttcgaaaatcacggacattgaaagatattcaggattggcgcgcagggtgtattccgccattttgtcagcaatggcgcggtctgccttgcctgccgccggtagcgcgatcaggttatgaccgagattgcgcgctacatcgcgggcatagctcagttcatgctgcactttcaatgcattcgtttgcgcgatttgttgcaaatactcttcggccagttgtttttgctgacggctggattgccagctcagcacgccgatggtcaccgcaaagcccagcgtaatggtcaatgcgccggtcagcagcatttgtgcgcgtgtacttaatgttttcttattgtgttgtgttgccattacggctctccccggagttgcagattctgtgtggcacagcctgtgcagcaacatccctcacaggatctatcggcgtggggagagataacttcatcgcaaaacgaaattattccatttacatataaattacatccctgtaaacatctgaagtccttagtgttctgcgatcaccaccacacactgaccggcgcgcaccggggatccgggctgcacgcgcacctgctccaccacgccatccgcgcttgccaccagcgggatctccattttcatcgactccagcaccaccagtacgtcgccttcacgcacctgcgcgccgggttcgacgttaacctgccacagatttccggcaatgggactgtcgatgccgcgctgaccgggcttcagtgccgcatcgtcgctttcatccgctgtcgcctcgtggctgtcaaaatgcgcctgaccggaggcttcccagcgctggcgctcggcgttaaaagcggcctgttgatggcgacgggcggcagcgatgctgtcggcttccgccgccagaaactgctggtactccgccagacgcagggttgtggtttcaatgcgcagcggataacgtcctgtcgggaaatcccggcggatgtcgagcagttcctctgccgaaaccggatagaaacggatctgatcgaaaaaacgcagcagccagggcttgccgccgaagtccggcagctcatgatagcgatcccacatttgcagcgtgcgtccgacgaactgatagcctcccggtccttccatgccgtaaacgcacatataggccccgccaatacccaccgagttttccgccgtccaggtgcgcgccgggttgtatttggtggtcaccagccggtgccgcggatcgagcggcgtggccacaggcgcgccgaggtagacatcccccagccccatcaccagatagctggcgtcgaagacggttttatacaccgcgtcgatattttcgaggtcgttaatacggcggataaactccaggttgctcggacaccagggcgcatcacgccgcacggtggtcatgtatttgtcgatggctttctggcacgccggatcgtcccaggagagcggcagccagacgatgcgcgatggcacctgtaaatcctcctgctgacagaccccgcgccaggcttccgccaccgtcttcagcaaggtggcgagtggcatggcgtccggctggtagtgaatttgcagcgagcgaatgccgggggtcaggtcaataaccccaggcaacaccagcgcctccagcgcctgcatcagcccgtgaccgcgaaaacgcagcaccagatccagctccgcgtcgccgatttccagcagcaaatgcgtatcgcctgacagccgcgccaccagacgcttgtcgccatgaccggtctccatcatcaccggcgaggtgagcggttccggatgccagttgatactgaccggcgcaagcgacaccagctcctgcgcccgggcgtgggccagcagtcgcgcagtctcaatactcaccggcacaaagcgcaccttatccccggcgttaagctgcccgagctgatacagatccgcttcaataatagtgaccgggcagacaaatccgccgaggctcgggccgtccggccccaggatcaccggcatgtcgccggtaaaatccaccgcgcctatggcgtaagggttgtcgtgtatattcgacggatgcagacccgcctcgccgccgctttcgcgcacccactccggtttggggccgattaaacgcacgccggtacggctggagttgaaatgcacttcccagtcggtggcgaaaaaggtgtccatgtagccgggtgtgaaatattccggtgcgccgtgcgggccgtagatcacccgcagttcgcgcaccgccggcagccgggtgtgcagcgcatcgggcagcgccgccccggtgcgggtatcggtgagcggcgtcaggtgcagcacatcgccggtgcgcagcgcgcgcccggcatggccgccgaactgcccgagcgtaaaggtgcttttgctgccgagatactccggcaccgcaaagccgccgcgcaggcagagatagctgcgcacgccctgcgccgtcagatcacccagccgcagcgtcgcccctgccggaatggcaaatacgcggttcatcgcctgcggctcgccgtccagcgtgatcgccagcgccgcgccggtaacaacggccacggcggcagtattaaacttcagcgtcgggccgctcagggtgatctccagcgccgcctcgccgggcgcgttacccagtaagcggttgccaagccgcagcgcgcgatcgtccatcgggccggacggcggcacccccactgcccagtaaccgaggcggcccggataatcctgcaccgtggtctgggtgccggggtttaacacttccagggtatcagcctgataatgcagattttccaggcagcgcgtccacggctggccgcaggcaaaaggcgcgtccgcgataatttgccgcagatagtggcggttggtctccacgccgtacagccgggtctgcgccagcgcctcatccagcgcggcgatggcctggtcacgggtgggctgatgggtgatgattttagcgagcatcggatcgaaaaacggcggcacctcgcagccggactccacccaggtgtcgatacgcagcgcctggcgatcctgcagcgggaacaccacttcggtcagcagaccgggggacggctgaaaatgacgtcccggatcttcggcgtacagccgcgcctgcaccgcatgcccgcgcggcgtgagggtggcggcgatgtcgcgcagcggcggcagatcccctgccgccagttcgatcatcatgcgcaccagatccacaccccatacctgctcggtgacgccgtgctccacctgcaaacgggtattcacttcgaggaagtaaaactgcccggcgtcgctgtcataaacaaattccaccgtaccggcgctgcgatactgcaccgcctgcccgagacgcacggcggcggcgcacagggcatccgccatgccgtcaggcaaaccgggcgcgggggtttcttccagcaccttctggttacggcgctgcacggagcagtcgcgcacgccgagggcgatcacctcgccgtgaccatcgccaaaaatctgtacttccagatgacgcgcgcgctggatgtatttctcaataaacacacccgcgtcgctgaagttgtttttgccgaggcgttgcactgcatcaaaggcatcagccagctcctccggggtctggcagacgcgcatgccgatcccgccgccgcccgcggtgcttttcagcatcaccggatagccaacctgttccgccgccgccagcgccgcgtcgctgtccgccagcagatcggtaccttcgagcatcggcacgccgtgctgttttgccagggcgcgggcggtatgtttcaggccaaagacgcgcagctgctctgccgtcgggccgataaaggcaatgcccgcggcgtcgcaggcatcggcaaaggcggcgttttccgagagaaagccataacccggatggatggcctgcgcgccggtctcacgcgcagcggcaagaattttatccacctggagataggtttgcgccgccgggccgctgccgaggcagatcgcttcgtccgcctcacggatatgcaggctgctggcatccgattcagaccagacggcgacgccctggacgttgatgtcgcgcagggtgcgcagaatgcggcaggcaatggccccgcggttggcaataaggagtttcgtgaacatgatccagccccgaaccgtggcgggtcgtcccgccggaaaagtgtcgccgcctggtcgtccagggggaaaatttatttggattatccgtttacgcccggcggcgcaggcttgccgggcctacaaacttacaatcatcatcgatccgtaggtcgggtaagcgcagagccacccgacaaaagcccgcctcatttcagccggttggcacgcacttcgaacaggcggaaaatcgcgcggcgcagtttttgtaagcgcgtcagttccataccagcacctccgccggcgtcgggttccagccgttgcagggattattcagctgcgggcagttggaaatcagtacgatgacattgcattcggcgcgcagctcgacgtatttgcccggcgcagaaatgccatcggcaaaggtcaggccgccctccggcgtcaccggcacgttcataaagaaattgatgttcgcgccgatgtcgtgcttgtgcagacgaccatcgtgcaggcaggcgcagagaaagttgtcgcggcagctgtgcatatagcgcacctccggcgagtagcgcacggtgttgctctcctgggcgcaggcgccgccgagggtgtcgtgacgcccgcaggtatcggcgacgatggtcagcagcggattgcccagccccgaccagagtacgctgccggtagtcaggtaagcatttcgctgacggcgcagcgtgcgctggggatcgtagcgctcgcgcgggttatcggcgttatagaacagcgtatcgatcgcctgattgccttccagatcgaccaggcgcagcgtctgcccgcgtttaacatcaaacagataatgctcccctgccgggatcacatggcggaacaccgcctgctgcggatttttttggctttcgaccagcgtcatgatgcgtctccttacagggcaaacaggtgagtgttatccagtgcgcgaccgttttccgggcgcgttaacagcgcgtgctccgcagccaggggatcgtccgccgtgaaccagctgagcgccaccgggcgcggcgcgtactccgggtctggatccaaaggatgttgtaacgaagtgagcacgatcagcgtatccatcgccgcatacagttcgacgacgcttcccggcgcggaaaaatcccgctgaaaatggaaacgcccgtcttcatccacgctgaccttgctgaaaaagttgaccaccatcagcagatcttcgaggttcagatcccacttgcccatctccaccagcaggttatccatgccattgcggtaaaaaccgttgcgtcgctcctgatagcgcccttcgccgtatttctccagggtttccgccgcgttcagcacgccgccgaagggatcgtgccagccgcagctgtctgtcagaatgccggtcagcacacggcccatatccgagtaaaagcagtgcccggcggtcagccgcgcggtgtgctgacctttcagcgtgtccggcagattcaggcgttcacttttttcatgtgcgttaagcatcatcatgctgacgttggccccgccgtgcagatcggtcatgcgcaggatctgcccacgcttgagaataaaagagagatggccgccgccggggacggtttcctcccgcagcgcgggggcggaatgatactgttgcgtcatcagatgtactccttcatggatacgacgttaaccggggccgcggccatcacttccgccatgcgcgcttcgttaagcggaatgtcgtaggtgatgcgcgcgccatacgcattaggttcgtggggatcaattcgcactttgtcgaacaccagcagacgggtgccaaggttgaagccctcggacaggtcatgagtgaccataaacaccgtcatgcgggtttcgctccacagctgtaaaagcaggctgtgcatgtctttgcggataccgggatcaagcgcgccaaagggctcatcgaggagcagcacgcgcggctgcataatgaacgcctgggcgatggccagccgctgttgcatcccgccggagagctgcgccgggtatttatgcagcgcctgtcccagccccactttgtgcagcatctgcgccgcctgttcccgggcggcttttttacggttgccgaagagccgcccgagcagcggcgcatggggcagttcaaggccaatggccacgttatccagcacgttgagatgcggaaacacggaataacgctggaacaccaccccacggctgcgatccggctcggcggtaaggggtttgccgtcaagggtgatagtgccgcggctgggcgcttcctggccgagcagcagacgcaggaaagtggatttgccgcagccggacgcgccgaccatcgagcagaactccccttcccggatttgcaggttaacccgctccagcaccacatgatcgccgtactcctgccagatattgttgatattgataaaactcatgctttgcccccttccgcccacgggaaacagacgctgtgcagtttgcgcagggccagatccatcagccacgccagcagcgtgatccacaccacgtaagggatgatcacgtccatcgccatgtagcggcgcacaaggaaaatgcggtagcccagcccggcggtggacgaaatcgcttcggcggaaatcaggaacagccaggccgagcccagcagcagccgcagcgaggtcagcaggcgtgacagcagttgcggcagcaccacgcgcagcaccagcgtccagctgttcgcgccgagggtctgggctttgataatgatctcctgcggaatttcacgggcgcggtgctccagatcccgcgccagcatcggcgtgatgccaataactatcagcatgattttcgacagctcatccagcccgaagacgataaacagcaccggcaagattgccagcggcgggatcatcgacagcacggtcatcagcggcgacaacgatgcccgccacagcggaaaaacaccggcggtaatgccgatgcacagcccgagcagcgaggcaatcagcagcccggtcagcagacgcgccagactgaccagggtgtccatccagaacaggtagtcaccgctgcggcggtctggcgtaaaagccatgcggtcgagggcgctcagcatctgatccagccctggcagcagcttgtcgtgcggattagcgtccaggcgcaccgcggagccaatgaagtacacccccagcagcaggaaaaacggcagcagcatcagcatgatgtgcatcccccgggacggatggcggttaatctggcgcatcagagcgtcccggccacggccattttcaggaagctgtcgtcaaagcgcagcttaatgttgccggcatcgccctgagtgacgttgccggggaaagccatgccgatgaaatccgcgctctgtgcgccatcgccgagcagccctttatcaaaggagaactgcgccacgcgctgcatggtttttgccagatcggccgaggtggtgaacgtgaggttatccgccggggtatagaacaggtgagtggttttgagctgcgcctggtagcccgccagatcggtgccggaggccgccgccatcgcattaagggctttcgcatcctgcgctttcatcaggcccatcatttcataccaggcgccggtcagggctttgccgagcgcgggattgtctttcagggtggcggtgttcaccaccatcatgtcgataagctcgcctggcaccgcagcagagctgaacacttccgtcgcctgcggcgtactcttgatcactgacaactgcgggttccaggccaccgccgcttcgacgtccggcgtactaaaagcagagacaatatccgcatcggaggtattcaccaccgttacgtcacgctcggcaagcccggctttctccagcccgcgcaccagcagatagtgggacaccgacagctccggcaggtagatcttcatgcccttcagatccgccagcgttttgccttcgcctttcatcaccacgccgtcgttgccttccgagtagctgccaaggatcagcgcggtggtatcgacgccgcccgcagccggaatcgtcagcgcatccatattggtcatggtgcaaccatcaaactggcccgcagtgtactgattaatggattcgatatagtcgttaagctgcacaacattgattttaatgccgtatttgctggcccatttgtcgatgattttgtcacccgcaatggtgccccagggcatccagccggcgtagatggtccagcagacgttgaactcttttttggcggcagcaagggctggcaggctggtcagcatcacaagtgacagcgcgagggtgcggatcaagggaaatgtcttcatggttcgacctctggttggacaaaaagggggcagcgcgacaccatctggtgctgctgtctcccgggtttttgtcccgccgtgtaacctcacagaggtcgcgtgctctcggaccagcattcacctgggtgaaccggaaccctagcccgctattttttacagataattgtctgatgcgctgccttctgaaatgaataaagcaagcgctgtgccagttttacctttccccggcggcggggattttcactggcgataaggaggcggtgagcaaaaatagcgacccaaaatggggcagtgccgcaaagcggtgcaggcctatttttcagtggcaggcttaaggcgtgttttgatgcgctgatttaacctaagaaaaatctctttttttagtcgattgtcacgtgcgaaataacgcaatatagcctttactcaacaccataagataagctgggattaacccctgtcaggtaagggataagaatcaacttaatctcatacttatgcatgatggcggtttattcagcattgtgagaggcgggctggcaaacgccattgaattgttaatcagtcaatgtaaaatcataaagatgatgctaatccatgttaattgctttaccgttttgcgttggcagatttgccggtgcaccggttatccaggcagcatggcatatttcacgtcgggttcaactttattgcagggaaagttacgatgaatttgcgaagcttgttactccttttagtggtcagcaccgtcgtggggtgtaaagcgccgccgccgaaaatcaccgacgataccatcgtgaccagtcaggtaaatggtgtaacgctgacccaccgtcatattgtggtcccgcctaaagaatttaacccggttaacgatgaataccgggcgatgtaccccggctccatcctcagcaagcccgatttcagcggcaaggtgctgggcgagctgaaaaccggcgaaacctatatggtgttaggttttgttgaacaatcctggctggccatcagcaccacggataaccctcagctgctgggctacgtgccgcagcgcgccatggtggtcagcgagcgttacgagcaggcgctgaaaagcgaccgtccgcgtccgaaacgcgcggcgaaaaaatccacctgcgtggccgtggatgacagcagcaaagcctgtcagaaaggcgacagcggtacctggatcatcgactgaattcataacggggagcagatgcaacgtcgctcccccttctcataagataattctgaactaaaatacgtatccagggtgatgaagtcgcaacttcatttttcacaggctaacaaggatttttatgaaactctggctctccggtctggcattgcttctggcaaccactaccgcgtcagctgggaattatcgcatcgtgcaatccccttcgcagaagctggatgtctggatagacgatataaaggataactccccgcaaagctggtgcgccgctgaactcccgctgcgtattaccacgatgggcgataaaaacccgttcattctcagtaactttatgccacgcctcggcaaactgctgttgagtcagtgcagcaccctgacgcagattagctggcagctggtggatccgcaggatcatgtgctggcgaccggcaccgccagtaaagagagtgactgggcgctggatatcgcgccgcaaacgctggagccggaaggcgcaccggcgcaggccaccctctccgccccggccgatcgcaccccctggctggaatttaccctgcaggatggctgccatctgcgcaccttctggcgcggcgatgccaatgcctcggcgctgtttattccggccaaagcgcaggatcagtgtgagaaaggcggctggctgaacggccgcagcgagatggtgcaaagcggcgtcaatggcgataagcgcatgatgatgacctttgtgcacggtttcccggtcagcggattaagcagcgcggtgaatgccgatacgctccttatcaccagcgtcaataatgaacgcatggtggtcagcaacgagcaggccccgcagagctggatgattttgccttacagcccggagattaacggctggaaaagtaacggcacggtggccgtcgaagtgtcccgtgaactggcgctggacgaagcgcgattacagacgcgcctgaatgcggtacgcaaggtctggtcgcaatggctggagccgggcacaccgctgacgctgctgttaatcgataatttgcatccgcaacttcgcgacccggccgccggttcgtggcgcacgcaaaaatgatcacgtccgtctggaacagagaagccgcataatgacaaccagcgattacactccagcgatagccgacgctctgccgccgggctatcgttttgacgaatttgaaatacaggacgttttgcagaccacgccgtgcgagattgtctatcgtgcgtgggatcatcagctggaacgcgccgttatcattcgcgaatatatgccgcgcgcgatggtggtgcgcagcgatgacatgcacctcgcgctacgcagccagcaggatcatccggcatacagcgcaggtcttaccgcctttattcaggacgcccgccgcctggcgaagtttaactatccggaactggtgcaggtgctgcgcttctggacggaaaatgacacggcctacacggtgacgcgctattacagcggcatcaccctggcggaactgcatcagcaacagccggacgtgctggacgaagagtgggtgcgtcgtatcctgccgatgctgtgcggcgcgctggcggcgctgcatgcagaaggcgtgatccatcgcgatttatcgcagaaaagcattcagatccaggacaacggcgtgccgctgctgctgacctttggcgtctcgcgtccgcagggcgacgaggtgcgcgatctcaataccactatgctgcatgcgggctatgcgccgctggagcagtacagcagcgatctggaaaatcagatcggaccctggaccgatatttacgccctgggcgcggtgctctatacgctgatcacaggcgttgcgcccccagccagcgtgacgcgcagcattcaggataactgtattcgtctgacggaaaatccaccggcaggctggtcaccggcgctgttacgggccgtggatcaggcgctggcgctgaaaccggaagcccgtccgcagtccattgaagcctttgcggcgctggcggagatcaatacccatcgcagcacggaaattggcgggctgaaaaaaaccggcacgatgctggtgccggtagaagaagccgcggcggcaaaaccgctgtgggcgcgcgttaaatcgccgttgcaaatcgccgcaggcgtgctggtcggggtgatcgtcggggctttattgttccgcggcgagcctgcggaggttcctgatgcgccaccaaccgcgacggccaccccaacggccacgccggtgacgcctacgcctgcgggcgggcttatcgcgcgggtgtatatccgcatgagcgatgcggatcatctgctggtaaacggcaagccgcagaaggcggtggccgcgtcgagcgggttcgcgtttattcagctcccggccgggaagtatgatattacgctgcaaagcggcagccagacgcatacgcagtcgctggcgatcgccacgccgggtacctggctgattaatccgcaggggtgattcgtttcgtagtaaattgcgctcttactggcttctgagtacggctcagactccaggcgcacagagcgcgcaaggggcggtcagtcgccgccgccccctgccccccgggctccccacacttcacgatttctaaaaaacaccactcacagattcctgtaagttaaaaaaaattaacgccactcagtcgtcttataaagaataaaaataatgacgcgaggggttgagtccccgctgaaaccggcgagccgtaggccggatgacaagggctggacgccatggatggcggccagaggcgaaatgaggcaggatgccgaatcgagccgaccgcgggcagacggccgggaggtgagcgcagtgcgcagcaccggtttctgtgcggggccgcggggattgctaagggggccgcggtggcccccttagcacgttcaccgtcagcggcgtcacgcctgactcaaaacgcaaagtgaacggaacattccaccaaaccaaacattccacagaaccaaacatccctccaaaccaaacattccacagatccgcctgcccccctcaaaatttgccttccattgcgcaaaaagttaaatccaccacgcaccctgcccgatattcgtctactgttttctcaaggttgattgcagcggtttcgctgttcacccctcaaggagaataattaatgaccaaaccttttatgcgccgtccccacacgctgtttttcgccatgcaactcgcgattggtggcgcactgctgtccctttccgccccgctgctggccgatgaagtgcagaacaaaggccagccgcagtcgccggatgtcctgcttggcccgctgtttaccgatgtgcagaccgccaaactcttcccggatcaaaaaaccttcgccgatgcggtgccgaaaggcgatccgctgatggtgctggcggattaccgcatgcagcgcaaccagtccggcttcgatctgcgccactttgttgacgtgaactttattgtgccgggcgaaggcaaaaaatatgtgccgcctgccggacaaagcctgcgcgagcatatcgacggcctgtggtccgagctgacgcgcaccaccgataccgccggaaaatgggactccctgctgccgctgccgaaaccttatgtcgtgcctggcggccgtttccgcgaggtctattactgggacagctatttcaccatgctggggctggctgagagcgaccactgggacaaagtgcaggatatggtcgacaacttcgcccatgaactggacgcctggggccatatccccaacggcaaccgcagctactacctgagccgttcgcagccgcccttcttcccgtttatggttgagttgttagccacccacgaaggggatgatgcgctgaagcagtatctgccgcagatggaaaaagagtatcagtactggatggagggcgcagacgccctgcaaccgggagaagccagtaagcgcgtggttaaacttccggatggctcgctgctcaaccgctactgggacgatcgcgacaccccgcgcccggaatcctggctggctgacgtgaccacggcgaaaaacaaccctaaccgcccggcgacggaaatctatcgcgatttgcgtgcggcagcggcctccggctgggacttcagctcccgctggatggacgatcccgaacagctcggcactatccgcaccaccagcattgtgccggtggatctgaacgcgctgatgtacaagatggaaaaaatgatcgcccgcgccagccaggcggccggcgatacgggcaaagcgcagaagtttgaagcgctggcgaatgcgcgccagaaggcgatggaagccaatctgtggaatgacaaggacggctggtacgctgattacgatctgaaaaccaaaaaggtgcgtaatcaactgaccgccgccgccctgttcccgctgtatgttaacgcggcggcgaaagatcgcgcggataaagtggccgcagcgaccgaggcccggctgatcaagccaggcgggctcaccaccaccacagtgaacagcggtcagcagtgggatgcgccgaacggctgggcgccgttgcagtgggtcgccaccgctggtctgaaaaactatgaccatgagaaggccgcaatggatgtcacctggcgcttcctgaaaaacgtccagcatacttatgacagcaagcaaaaattggtggagaagtatgacgtcagcagcaccggcaccggtggtggcggcggtgaatacccgctacaggacggctttggctggaccaacggcgtgacgctgatgatgctggatctggtctgtccgaaagcgcaaccctgcgataacgtaccggagacgcagcccgctgcgcaatccaccgcgcaaccggctaccgcgcagtcatctgctcctgccccgacggcagaaaaagtcgcacaataagcggttcgcctgctaccagatttggtagcaggttttaatgtgcgaaatcaacacattgcccggcggcgcaggcttgccgggcctacagcaatctcctcactctcccctcggttaatcccacactgattttccgttgtattctttaacgttaacgataataattcgcattccttttacatttgttaatacaaatttcctgtttgtggcggaggcttgttccgcgcacaacggtactcaggatcccggaatgaccacgacattatccctgaaacgttcgtccctgctgtgcgctcttgcgctggcgcttcctcatgcggtgctcgcggaagataccgtggtggttaccgccaccgcgcctcagtcagccattgcgccgaccgaaggctataccgtgcaaagcacccgcggcgcgaccaagaccgatgaaccgctgatcactaccggtcagtcggtgtccgtcgttacccgccagcagatggaagatcagggcgtggcgacggtgtcccaggcgctggcctatacgccgggggtttattccagcttcggcggcggcgctacccgcttcgataccgtttccctgcgcggcttccacggcggcgacgtggataacctgttcctcgacgggatgcgtctgatgagcgacggcggcagccacagtgtgttgcaggtggatccgtggtttattgagcgtgtcgatgtggtgaaaggcccgtcatcggcgctgtacggtcagagcgtgccgggcgggctggtgaatctcacctccaaacgcccgcagtttaaacaggaaggccatttccgtctcagcggcggtacccataacaccaaaggcggcgccttcgattacaccgacgcgatcaacgagcagctggcgttccgcattatcgggatgacgcgcagcagcgatacccagtatgacaacacccgcgaagagcgctacgccatctccccgtcgctgttgtggcagccggattcggataccagcctgctgttgcgcgcttatctgcaaaaagatccgaccggcggctatcacggctccctgcctctcgacggcacgcgctttgcccacaatggccgcaagctcgacaccagtacgaatgaaggcgaaagcgaagacggctaccgtcgtcgtgagcagatctacagcctggagttcgatcaccagttcaacgatatctggtcagtacactccagcggcagctatacccatgccaatgtatcactggatcaggtgtatcagaccggctggatcgacggcggcgatacgctgtctcgcggctatagcggcaaccgtggctcactggatgcgtggtctacggataaccgcgtgcaggcggatttcaataccggcgaggtggcgcatacgctgatcctcggcggcgaataccatcgctatcgcaacaatctgtggacaggcgcgggcagcgcttcgccgctcaacccgtacaccggttacactgcgcagcatggccacgttgtgacctacagcgatgacaacaaccgccgctattaccagaccggcatctatttgcaggatgagatggtgtgggatcgctggcatatggatctctccggccgctatgaccgcatcgtctctgagcaggtgagcgacagcaatgccacctcgaatcgtcgccaggatgatcatatcagcggcagagcgtcactgctgtatgcctttgaaaacggtctttccccctacatgagctacagccaggcgatcaccccggcctcgctgccaggtgcggacggtacgctgctgaaaccgaccaccgccgagcagtatgaagcgggtctgaaattccagccgccgggcacctcggatatgtacagcattgccctttacgacctgacgcagaaagacgtcgccacccgcgatattaatatcgccactgcgagctatctgcctgccgggaaagtgcattcccagggagtggaaatcgaagcccgtaaccagttaacgccacgcctgagcaccattgcgggctatacctggaatcgcctgaagtatcaggattcgctcgatggtaacaacggtaatacgccgcagctgacgccggaccagatggcctccttctgggcaaactataagtttgattacggcctgagcgtcggcgcgggcgtgcgttacatcggcaagcagtgggcggatgatacaaactcatcgcgcctgccgtcggctacggtgtttgatgcctcggtgcgtgcggatctgggcgagtggtcagcgccgctgaaaggggcgttcgtgcaggtgaatgccaataacctcggcgatcgtgagtacgtggcgggatgctacggaaccaataactgctattacgcggcggagcgcagcgtggtggcgaccgtgggatatgacttctgatcgcgttgcgtatttcctgtcgaacagggtttagtggaatgttccgttcactttgcgtttcgcatcaaacgtaacaccgctgatggtgaacgtgctaagggggccaccgcggcccccttagcaatccccgcggccccgcacagaaaccggtgctgcgcactgcgctcacctcccgaccgtctgcccgcggtcggctcgattcggcatcctgcctcatttcgcctctggccgccatccatggcgtccagcccttgtcatccggcctccggctcaccggtttcagcggggactcaatccctcgcgttaattacgatgacggtttgttacgactgagtggctgtgtgtttgtctgaacttacaggaagctgtgagtggtgttttttagaaatcatgaagtgtggggagtccggctgaaaatcgctgaggcgttcccttacggccggggcagcccgcatggatgcgggctgagggcgcgacttgcagggacgctgcatcacgcccgacccgaagccggaagggataagccgaaggcaccgcgaagcggcgattttcctgccgggagcccgggggtgcagggggcggcggcgactggccgccccttgcgcgctctgtgcgcctgaagtctgagccatactcagaagtcagtaagagcgcaacagaccacaatactaatagctaatttacccgcgacgcagcaaacggaacagcgccagtaccacaatcgcacctaccaccgcgaccaggaagctgtgcagatcaaaacctgtcacgtcgccgccaaagccgaacatcgtcgccagccagccgccgaccacggcacccaccaccccaagaatacaggtcagaatgaaaccaccgccatcacgtcctggcatgattaatttagcgataacaccggcaataagaccaaaaatgatccacgcaataatgcccattttgcatttcctctttttgttgtgacttgatattgcaagattgatttcctgcccacgacgctaagtataggcaaccacagcaaaagggttagttgtcacagacttaattcagtttaatcgcaaaaaatatttggtcgtttgtattaagtttcccgccgccatgccgatatattcccgacaggcgatacgctattaaggagccatccggcgtgagtaattatagtgagcagtttctgaagcagaccccactggccgtactgggggtattgcgcgatctgcaaaaaggccaggtgccactgcgcatctcatgggccagcggtcagttcatcagtaagatcctcgatgttacgccggaagggctggtgatggactatggcagccaggaatacgataacaaagccgttcagcgtgccgaaaatatcgccatcacggcggaaacccgtggcgcaaaagttgaatttacgctgccccgtttacagagcggtcagtaccaggcactgccagcctttaccacgccactgcctgctgaactctggtttatccagcgccgggaatatttccgcatttccgccccgctctatccggcctattactgcaaagccagaatgccggataaatccatgctgcgtttccgtttgtttgatttgtcccttggcggcatgggcgcgctgctggaaggtaacgcgccggaagcgctgaaggaaggtctgcgctttacgcagattgaactggatatggcgggatggggtcagttctatttcgatgcccagttactgtcgatcagcgagcgcaccgtggtggacggcaaaaacgaaaccgtcaccacgccgcgcctgagcttccgctttctgaatgtgaatccggcagttgagcgcgagctccagcgcattattttctcgctggagcgcgaagcgcatcaacgggcgaacaacgttcgctaggcgttacatggcatccatcgcctgctggactttccagatatagcggggtgcctggggtgcagggtgattgtcggccacatggtcgacaaactcatccgggctgagcgagttgatctctttgatggcctttttacgatccgatgagaaggtgcgcaacagcgcccccgccccgttcacataagacaccaccagcgcgtactgcatcacttccggatcttcgatccctgccagcacgccgtgttccagtatgctcaggtaagcggttcccatagagatattacgctccgggtttttcagctcgctggtggaaggttgccccttccagcccatatgccggtacacttcacgtccggcggttgaggctttcagctgcatcaggccaaccgcgttggatttgctgaccagcgtcggattaccgccggattccaccgcaatgatcgcagtgatgagtcgtgggctgacgccccatgccgctcccgctttctcggtgatcggcatccactgcatggcgcgttttaccggtacttccgggttccatggtggatttttatagtcctgttttgaactgcatcccgccagtaacacaatcaaaaaagcaaaccatcttaatttcacgccaacgatccttataccggtatgtaatgttcagtcgcccgccagccagcagatgccgcttgaagtgtgacgggcgtaagcggcatgataaacgtttcaccttatatgtcagcaaggaattgccatgtcagtgtttcatttgattgcgccttcgggctactgcatcaatcagcaggcagccgcccgcggggtcgcgcgtctggaggccgccggtcatgaggtacgtaatcgcgaggtgatcgcccgtcgctggcagcgcttcgccgggagcgatgccgagcgtctggcggatctcaacggacttgcccggctggccggtaaaaacactatcgtgatgccggtacgcggcggctacggggccagccgtctgctggcgtcggtggactggcacgggctggcgcagcgccagcagcaggatccgctgctaatttgcggacacagcgatttcaccgcttttcagatgggactgcttaagcacggcgtgatgagcttcagcgggccgatgctggcgggcaacgtcggcgcggaaaccgtagacgctttcaccgaacgccacttctggctggcactgcgcaacgaaaccttcacagtggaatggcacggcgacggccagccctgccaggcacaggggacgctgtggggcggaaatctggcgatgctggtgtcgcttatcggcacgccctggctacctgttatcgacaacggcattctggtgctggaagacattaacgagcatccgttccgcgtggagcgcatgctgttgcagctgcaccatgccggtattttatcccgccagcgggcggtgatcctcggcagcttcagcggcagcgccccgaacgattacgacgcgggttacacgcttgaggcgatgatcgactatatgcgcacgcaaattcctattccgttaatcgccgggctggccttcggccatgagccgcaaaccgtcaccctgccccttggcgcgcaggcgacgctggatcacgatggcagccataccgggttaaccctgacagggcattctgtgctgcatgcgtaaaaaaaccattcatcgcacttatcaaatctgacctcctgccgttaatataaagaagcgtattgagatgcacggtcaccgatcgtgcatgttgtctggcagtaacggtgttttaaggagtaattcgacattggaagcagaggcgataatcggtctttttatcctgggttctgttcttgtaacctgtagcatcttattaagttctttctcctctcgtctcggtattcctatcctggtcatttttcttgccatcggcatgcttgccggggtggatggtgttggcggtatccctttcgataactatccctttgcctatatggtgagtaacctggcgctggcggtgatcctgctggatggcgggatgcgcacccaggccagttcgtttcgtgtggcgctgggcccggcgctgtcgctggcgacggtgggcgtgctgatcacctccggcctgaccgggatgatggcggcctggctgtttcatctggacataatggaaggcctgctggtgggcgcgattgtcggctcaacggacgccgcagcggtcttttccctgcttggcggcaaagggcttaacgagcgcgtgggctcgacgctggagatcgaatccggcagcaacgacccgatggcggtctttctgaccattaccttaattgagatgatccagcagcacgaaagcgggctgagctggatgtttgcagtgcacattattcagcagtttggtctgggtatcgtgctcgggctggccgggggttatctgctccagcagatgatcaaccgtatcgcgctgcccgccggtctgtatccgctgctggcgttaagcggcggcattatggtgtttgctatcaccacggcgctggaaggcagcgggatcctggcggtctatctgtgcggctttttactgggcaaccgcccgctgcgcaaccgctacagcatccagcaaaactttgacggactggcgtggctggcgcaaatcgccatgttcctggtgctcggcctgctggtgacgccatcggatctgctgccgatcgccattccggcgctgatcctctcagcatggatgattttcttcgcccgtccgctgtcggtctttgccgggctgctgccgttccgcggctttaacctccgcgagcgggtgtttatcagctgggtgggtctgcgcggcgcggtgccgatcattctggcagtcttcccgatgatggccgggcttgataatgcgcggctgttcttcaacatcgccttcttcgtggtgctgatttcgctgcttttccagggcacttcactcggctgggcggcgaaaaaagcgaaagtggtggtaccgccggtgggctggccggaatcccgcgtcgggctggatattcatccggaaaatccctgggagcagtttatttatcagctcagcgatgacaaatggtgtgtcggcgcggcgctgcgcgatttacacatgcccgcggaaacgcgcattgccgcgttgttccgtgataacgccctgctgcaccccaccggcagcacccggctgcgtgaaggggatgtgctgtgcgtaattggccgtgagaaagatctgccggcgctcggcaagctgttcagccattcgccgccggtggcgctggatcagcgcttctttggcgactttatcctcgaagccagcgcgaaattcgcggatgtggcgctgatctacggcattgacgtcggcgcggattaccgcgacaagcagcagacgctgggggaaatcattcagaaactgctgggcgcggcgccggtcgtcggtgaccaggtggaatttgccggtatgatctggacggtagccgagaaggaagacaatgccgtgcgtaaggtaggggtgcgcccgatggaagacgaggcggaataaccgccccgttaaaagttacaccgtcacgacaggcacgcgcggggctaaggcgcacatcagttcatagcccaccgtgcctgcggcagcagccacatcatcaattttgatctcctgcccccacagctccaccggcgtacctattcccgcctgcggacagggagtgagatccaccgccagcatgtccatggacaccgtgcctaccgtacgggtgcgcacgccgtccaccagcaccggcgtgccgtccggcgcgacgcgcggataaccgtcggcataaccacaggcaacaatgccgatacgctgctcgccccgtgcctgataacgctggccgtaacccacacgatcgcccgcctttaacgtctgaatgccgatgatctggctgctcagggtcatcaccggtttcaggccgctggtggccacgtcctgccactggccagacggcgatgcgccgtaaagtatgatacccggtctgacccagtcgaaatgcgccgccggatgccagagcgtggccgccgagttggacagcgagcgcgggcaatccagcccttctgccgcctgttcgatttttaccatcgcctcatcaatgccatccggccgttccgcaacggcgaaatgcgacatcagcgtcatatcgccgacgttgctcatcgcccgtagttgctgccagacggtatggatccgctccggctgaaagccgaggcggttcataccgctgttcaccttgagataaatatccagcggcgcctgcaggcgtgcattttgcagcgctttcagttgccagttgctgtgcacgctggtggtcaggcgatactgatcgaacagcgccagttcatcggcgtgaaagaacccttccagcatcaggatcggccctttccagccgcgttcgcgcagcgcaatggcctcctccagattaagcatcgcaaagccatcggtgctgctgagcgcattccagacccgctcaatcccgtgaccataggcgttggctttcaccaccgaccagacgcgggacaccggcgcggccagccggacgacctgcaggttgtgccgcagcgcctgagtgtcgatggtggccagtacaggacgagacatgactgctcctttttagttttgcacaccgtgcaggtgttgcgcgcgggccggggtaaaaccgggctggtagcgcgccacgctcagatcctcgaacggaatggccggagtacggccggagagtaaatcgcttaacaactgcccggaaccgcaggccatggtccagcccagggtgccgtgacccgtgttaagccacaggtttttaaacggcgtgcgccccaccagcggcgtaccgtccggcgtcatcggccgcagcccggtccagaaggttgcctgctccacatggccgccgcgcgggaagagatcgcgcaccaccatctccagggtttcgcgccgcggctgtaacagttcggtgttaaagccgacaatttccgccatcccgccgacgcgaatgcgctggtcaaaacgggtgatggcgattttgtagctttcatccagtatggtcgaaactggcgcgccgtcatcttcggccaccggaatggtgagtgaatagcctttgagaggataaaccggaatatcgacaatatttttcagcatcgccgtggagtaagagccaaaagccatcacataagcgtcggctttgatcacctcatcgccgcacttcacgccatagattttttcgccttcatacagcagttgctccaccggcgtgttatagcggaacaccacacccgcctgttccgccatcgccgccagacgttgggtaaacagctggcagtcgccggtttcatcgttcggcaggcgcaggccgccggtcagtttgtgtgccacttccgccagcgccggttcgacttcggcaaggcgggaagattccagcagctgatacggaacgcctgcgtcttccagcaccgcgatatcgcgggtggcgttttcatattgctgcgcggtgcggaacagttgcagcgtgccgccctgccgcccttcgtactggatgccggtgctgtcgcgcagggctttcaggcagtcgcggctgtactccgccagacgcaccatgcggcctttgttttccatgtagtgacgggtgtcgcagttgcgcagcatttgccacatccatttcagctgtgacggggaaccatcaaggctgatggccagcggcgcatggcgctcaaacatccatttgatggccttcagcggcacgccgggcgcggcccagggggcggcgtaaccgggggagatctgcccggcattggcggcgctggtttgcagcgccgggcccggctcccgttcgatcaccgtgacctcgtgtccggcctgattcagataccaggcgctggtgacgcctactacgccacttcccagtacaacaatgcgcataaccactccctttgagaaagaacaatgttctgattacaaattgataacccagatgaaaatgttattcaacatatggcttttttatggtgacttacctcacatcttcgcccgcgcggcctgtgatggcggatttaggatctcctgctgaccggcgattttagtcagcatttaatgctgcaaacaggcgcttttaccccgtcaccacaaggcgaaatggcgaagaaaaaaatttaccaggcagaccctttgtgacaccttgatctatgcttgaaatgaggctctccatacagagagatccgccaacaatgagggcgcgctaatggctacgattgattccatgaataaggatacgacacgtctcagcgatggacctgactggacgtttgagctgctcgatacctatcttgctgaaattgaccgcgtggcaaagctctaccgtctggatacctatccgcaccagattgaggtgatcacctctgaacagatgatggatgcctattccagcgtcgggatgccgatcaattatcctcactggtctttcggtaagaagtttatcgagacagaacggctctacaaacacggccagcaggggctggcgtatgaaatcgttatcaactcaagcccctgtattgcttatctgatggaagagaacaccatcaccatgcaggcgctggtgatggcgcatgcctgttacggacataactctttctttaaaaataactatcttttccgcagctggaccgatgccagctccattgtcgattacctgatcttcgcccggaaatacattaccgactgcgaagagcgctatggcgtggacgaggtggaaaaactgctcgactcctgccatgccctgatgaattacggcgttgaccgctataaacgtccgcagaaaatttcgttgcaggaagaaaaagcgcggcaaaaaagccgtgaggagtatctgcaaagccaggtgaatacgctgtggcgcacgctgccgaaacgcgaagaggtggaaaccgtggcgcaagcgcgccgctatccgtccgaaccgcaggaaaatctgctctattttatggaaaaaaatgccccgctgctggagtcctggcagcgcgaaatcctgcgtattgtgcgtaaggttagccagtatttttatccgcaaaaacaaacccaggtgatgaacgaaggctgggccacgttctggcattacaccatcctcaatcacctgtatgacgagggtaaagtcaccgaacgttttatgctggagtttttgcacagccacaccaatgtggtattccagccgccctataacagcccctggtacagcggtattaacccttatgcgctgggcttcgccatgttccaggatattaaacgcatttgtcagtcgcccactgaagaagatcgctactggttcccggatattgccggatcggactggctggaaacgttgcatttcgccatgcgcgattttaaggacgagagttttatcagccagttcctgtcgccaaaggtgatgcgcgatttccgtctgttcagcgtactggatgacgatcgtaataattatctggaaatttcggctattcataacgaagacggttaccgggagctacgcgccaggctttcggctcagtacaacctgagcaatctggagccgaatattcaggtctggaacgtggatctgcgcggggatcgttcgctgacgctgcgttatattccgcacaaccgcgcgccgctggataagggccgtcgggaagtgttaaagcatgtgcatcgtctgtggggttttgacgtcgcgctggagcagcaaaatgaagatggcagcgtggagctgttggatcgttgcccgccacggccaaacaatctgtaaaacaaaaagccctctccggtgagagggctttttcttagcgtccgtgcattgagataccgccgggcagcgtcttttgcatgcggtgccagatttcgccgctctcgcgaccgtaacgacgcacggtgtcatatacctgatcaagctcgccccgctcacacacctgcgccagctggtgataaaagccgagcgccaggctgcgcgcttccggattagcaaagtaatgacggccaatacgcgtatataaacctttcatgccgttgatgatcaggccataaatcgggttacctgatgcaaacgccagcccgcggaagatgttgtaatccagctcggcaaaggcatccgcatgatcttcaatagcgctggcggtggccagcaccttcagcgcatcttccgggtgctggcggaaggcggtacggataaaaatggtggcgatgttggtgcgcacggaaagcaggttatcgatcagctgaggaacgctttcgtgatcgaggcgtgccagcgtttcaagaatattcagcccggacgtttcccagaaattatttactctggtgggtttgccgtgctgaatggtcagccagccgtcgcgggccagacgctgtaacacttcacgcagggttgtgcgagtgacaccaatcagttcagaaagctcacgctcggctggcaggatggttccaggggcgaagcggttattccagatactttcgatgatgtattcttcagcgaaacccgccgggctttgcgccttaatgaccatagtgagatttccattacacagcttaacaaagacactcatcataccagagcgatacaggcgcagatagcgccaggcatgaagaaaaagggatcgggacttcatttttaagattttgtcagacgcatttttctggtgaataaaaccagcaaactgacttaagggacaggcttatcctggcgacgattcaggtaaaataatccattacttattatttttattgtggctagtggcgcaggaagtgaattcgtttacactgcgttgtccacgcttgtcttagggaaatgattatgttgcgatttttgaacaagtgctcacacggacgcggtgcctggctgttaatggcactcaccgcgctggcgcttgaaatggtggcgttgtggttccagcatgtgatgctgcttaaaccctgcgtactctgtatttatgaacgaagcgcgctgtttggcgtgatgggtgcggggttggtgggagccatcgcgcctaaaacgccactgcgctatgtggcgatggcgatctggttgtacagcgcctttcgggggatccagctggcctgggaacatactgacattatgttgcacccgaatccgtttgcgacctgtgattttgccgcccgcttcccgagctggctgccgctggataagtggctgccgcaggtgtttgtggcgtccggcgactgcgcggaacgtcagtggtcgttcctgtcactggaaatgccgcagtggttgctgggcatttttatcgcctacttcgcggttgcggtactggtggtgattgcccaggcgttcaaaccgaaaaaacgcgatctgttcgggcggtaatcttttagcccggctttacagaaatccggaaatacttaatgtttccggatttttttatgccctccatctcatatcctcgaaataaacaacaaaatatatccacgcacaccagaccttctcaatcgtatctgattgaattcattgacaataaatacttgttccaatgttttgtatttttaatgaatttatttatttctcagtagacaaattttgtctatgagattatgctcaataaaaatttatcatttggtaagattatgtttcgatcgattcagatgcttagagctttggctgtctggcttgtcgtgctacatcatgtcaagcagattgtcttttctgatgccattggaataccattcattgaccaaattgctcataaaggcgcagcaggggttgatcttttctttatcatcagcggctttatcatttatcagtcaatatattcccgccatataagtgctcaacaatttgccatcaaccgcataatgcgaatagtaccggcatactggctgtttacaggcctcgttgcgctgctggcagtatattttgatggcctaatgtttgctacttctacaaatcctgagttactgatacgcagtctgcttttcattcctacagagcgtgctgacataatgggttatatccccttcctgacggtaggctggactttaaactatgagatgtttttctacctgctggcctgtctggtcattttaatctctcgtgagaggtttatagtcttaatttcgttagtgataatttttagttatgaattcctgaaaccttccctggcgcaaatgcctttttatggcaacggtatgatgctggaatttttgctggggatttttatagctgattttcacaagaacgggatgctggaccgaattaacccaatgattctggcaagtctgttgctggcctcaatgatatttatttataacaggaaggaagaccacgatatactattcataggtatcccgtgcgctatcattgttgcaacagctattggcctggaagcacagataagtgaaagcaaagtggttaaatttattataagattaggcgattattcctactctacttatctttgccacgtcatcatcatttgcagtctcctgtacatattcagcgattataaatattgcaagtatatcgtatctgcactttgtgttccctttacaatagttacttcatacataagctataagtatatcgaacggccaataggtagtttatctaaggttatgctcaggaaaagaacaccagcggtcgcctgagatcataaagaggcagttcgcagtgaactgcctctttatgccatgatgctttcaatggcgaattgtcagtaatcccatttaattccggttaacgaagcgtgggtaattccctcgggtaatgatccgtcctttgtcctcacggtatccatgatagagcatgggaaagatacaagcttccccgatacaatacccatcattgtcctcctgacgggaaaagagggccggagagataatggaagcgaaaccattgcggcagaagtacctgaagatataaaacctttaactacggccctgtatcccttaaggcaaaactcaaagttttcatttccttcgctttgcacccaccctcctgtcagcgccggagccgagccgccgagggtagcagtatcaaattttgggccagtgagggctgagtatttctcatcacccacataaattttaccaagttgcgtcatataataaaggttgcctacagaccacgcatccagaacatcaatatttacacacgcatgatcaagactacgaataactgcgccagtgatgtttactgcatacagcgaagttatgtgagtctgctgggggttcatctcgggagtagcaatataaaccgcatgtgcgcaattactgacattcattgagccgatattaattctggatgctgtagttgaaccttccactatataagagtattcgcccactattgtaccatcgagtcccatgccatctgtagatatactggcaatttgcacatcttttaatgggactagtcccccaatatgcacatgccacctggcaccggatgcgccagtaaagcctatgaatatgggaccagtgaatggctttgcgttcgtatcaagatcgataccgtgaagtgccaccgcagggataaaccagggcgaagttccgcgcggcttttgcctgcaataatggtcgatgactttcacattgccacaatcggagaaattatctgctttaataatcaaaccattctggctttgcgaataagtataaataccggtagcggtaacatcgcaggccttgatgataatgccatgatacccaccaatccctgtaatattatcaagtcgtccacctgtatatccttcagtaagaactgcgtgtccgcgtgcttcactgttataaagtaaacctgtcacattttgtaaaataaaattgcgcttttgtgcagtgcctttatgtggggcagcaaatgcaaaagcatcccagtcacccccgtcgggatgagaagatgtagtgatatcggctccggggtatttttcatcgatataatctttgccgttatcaaatccgacatttaaggcattaaaattgtttgcataaactttgaatcttccacatagcactgaaccgcctgttaaacgactgagagtgttattccagacaggagctcgttcaccaagaatacgaacattatctgtccccatgtaatcggttgtggtattccagcttccggattcccaacggccagccggaacgtagactgttccgccatttgttaaagccgcaatagccgctttaagggaaggataattcgctatattaacagtgggtagcctgccgtaaaggtcattaagagcagtccctaccgttttcggtccataggatagttcagagctgtagccgaataaacccgcaccgctgtcactgctcagttcagatcgcagcgatgcgtcactaacttgatcccaggcttcattatgtatgcccccatccctttcatgtgctggaacggggcgaacaactttggggaactggttgttccacctgggagattctctgttgaattcgcagagcgagcgctggtcagcagggccaacggcgctgccattttcagaaggatccttcgggatatagccatatttcagtattaccgggatgtcatttatcttaattcccgaaattttactgactatgtacccatttttcccttatccaggtcaaggtaatcatggctatatgaaacaaatttcagttaaggcgctatccagagtgccagcaacagtcgaactgaagaagtaaatactttgatgagtaaccgtttaatccgcccactccggcttattcaaaatatgatcctgccagtcattcacttctgactctttaaccgcaatgtgacgcacggagatacgttcggcgtgcattgcggctttggagccggtacgcagcggatgccagaccggcaggctcttcccttcagcgaggagtcgataggcgcagctcggcggcagccattcgaaggttggcagattatcgcgggtcagcttgatgcagtccggttcaaattcgaaacggcgctcatagttgcggcactgacaggttttgatattcagttggcgacaggcgacgttggtgaaatagatttcatccgtgtcttcatccatcagtttgtgcaggcagcattgcccgcagccatcacacagcgattcccactcggcgtcggtcatctgctcaagtgttttgctttgccagaaaggagtgtcagtcataagcggatccgccagtaggaaatcaagctgcaccttataaccagtcaggctcgttgatgcaagctttgccgcccttgcggacggcatttcgcatttaaagtacgcgggtattgatggttaacccgttgaggctcacttccagcgcatcgccgctgtgcagcgggccgacgccttccggcgtgccggtgaggataatatccccggcgcgtaaggtgaaaaaccggctcatgtaggcgatgagcggcacgattttgtggatcatgtcggccgtcgttccctgctggcgcacgtcaccgtttactttcaggctgagcggggtgttttgcggatcgccctggaattctgccgccgggataaaaccggaaatcgggcaggaattatcaaagcctttcgctttttcccacggctgccccgctttcttcatctgcccctgaatatcacgcaatgtcagatcgagcgccacgccgtacccggcgatcgcctgttcgacgtgcgcttcgctcgcctgacgcagcgtggcgccaatcagcactgccagttcaacttcatgatgcaccgatcccagtccctgcggcagcgccagcggctggcgcagatcgcaaagcgcggtttccggtttgataaacaacaccggctccgtcggggtggcgctgcccatctcctggatgtgctttgcgtaattgctgccgacgcagacaactttactgaccggcatttccagcagtgcgccctgccagtgatgatgttgatacatgagttccccctgagtaacaccctgaacgcgtaagaaattaaccttttccgttgctcgccagatgttgtttcagcaaatcttccggcggcggtggcaactgcaaataatagccctgcgtcttcagcgcttctttcactttttccagatcggcgttgaccagttttttacgcccgtcgaggggtaagagcatcgccagttgcggtttaccgaacccctgcatcagggcttcaggcacgcgggaaaaatcgtcttttttttcaacgtaaaggtaggtctgttcacgccgtgggcttttgtagatcacacaaaacattcttttgctcttatttgtcgggaggtcacttgcctcaatataatcctgactataacatgccttctggtcttcggaatattacccgctgtacgggtgataatagcaaattgagtaaggtcaggatgtcaaacacgcccatcgagctaaaaggcagtagcttcaccttatcagtggttcatttgcatgatgcaaagcccgaggttattcgtcaggcgttgaaagacaaaatcgctcaggctcccgcgtttttacaacatgcgccggttgtaattaacgtcgctgatgtggaaggcaatatttcctgggccacgctgcaaaaggtgatcgccagtaccggtttgcgcgtggtggggatcagcggctgcaaagatgccgccctgaaagccgaaatcgaacaagcaggcctgccgttactgacggaaggcaaggagcaggcggtacgtcaggcccctgcccccgttgcagtggtggaagaacctgctgttgcgccccacaccatttcacggttgatagatacgccggtgcgttccgggcaacgtatttatgcacctaactctgatttgattgttaccagtcatgtcagcgcaggtgcagaactgattgccgatggcaatattcatatctacggcatgatgcgtggacgcgcgctggcaggcgccagcggcgatcgtgaggcacaaattttctgtacccatctcaccgcggaactggtttctatcgcgggggaatactggctgagcgagaacatcccggccgaattttatggcaaagcggcgcgtctgttgattgcagataacgctttgactgttcaaccattgaactaagccctttttaacaaggaactcctatggcacgcattattgttgttacttcgggtaaagggggcgtcggcaagaccacctccagcgcggccatcgcgacaggtttagcccagaagggaaagaaaaccgtcgttatcgattttgatatcggcctgcgtaaccttgatctgatcatgggttgcgaacgccgcgttgtatacgatttcgttaacgttattcagggcgatgcgacgttaaatcaggcacttatcaaagataagcgtactgaaaacctgttcatcctgccggcatcgcagacgcgtgataaagacgcgctgacccgtgaaggcgtggaaaaagtgctcgacgatctgcagaaaatggacttcgattttatcgtctgtgattcaccggcaggtatcgaaaccggcgcgctgatggcgctttatttcgctgatgaagccattatcaccaccaacccggaagtctcttccgtgcgcgactctgaccgtattctgggcattctggcgtcaaaatcgcgccgtgcggaacagggcaaggagccaatcaaggagcatttgttgctgacccgctacaatccgggccgcgtcagcaaaggcgatatgttgagcatggaagacgtgctggaaattctgcgtatcaagctggttggcgtgatcccggaagaccagtcggtgctgcgcgcctccaaccagggcgagccggtgatcctggatgccgcgtcagacgcgggcaaggcctatgcagatacggtggaacgtctgttgggagaagatcgtcctttccgcttcatagaagaagagaagaaaggtttcctcaaacgcctgttcggaggataaattatggctttactcgacttttttctctcacgaaagaaaagtaccgccaacatcgcgaaagaacgtttacagattatcgttgccgagcgtcgccgtagcgatgctgaacctcactacttaccgcagctgagaaaggacattctcgaagtcatttgccgctatgtgcagatcgatccggaaatggtctcggtgcaactggaacagcgtgatggcgatatttctattctggagctgaacgtgacgctaccggaaacagaagacagtaaataaatctctcttactggttaaaatatcagagataaaaaaggcagccttaacgctgcctttttatttatctgccaaaaaaccctgtaattaattacaggggtaatgaaagatcaccgcggatattcttttagcagcacgttaagttttggcgccattaaatcgccgcgccagccggaaattaattcaggctgcacgctttgcggttttaactgccagtgccagttgagcagctgattaatctggcgacgggaagccagcagttcggcgctgacgccgctttccgtactgacctcctgtaccagcgctttgatggctttaaacgccttgcggtagcccggcatatccaccagattcaccagcggctcaggtagcgcctcctccggcaattcctgcgctttcgccaccagcgccagcagggttttaccgtggaagcggatctcgctgcctgacaagccaatgctgtccagctcgcccatgctaccgggcatataacgcgccacggcccacaggtgctcttcacgtaccacgaagtttaccgccagatcgcgctcacgcgctttacgcagacgccagtccgccagcagacgcagacaggccagttgacgggtgcgcagctgccaggcgttgctgatgtcgcgccatgcctcctcaggggccagcacttcctggcggcgctgctgcatcaggcggcactcgtccagcgcggcgggcagccagcctgcggtttcggcttccgccatcagtttgtgggcgatgggtaacaggtaccagacatccgccgccgcatagatgcactgacgctccgttaacggacgcgccagccagtcagtgcgggattcgcttttatccagcgccgtgccggtatactcctctaccatcgcggcaaagccccatgacatcgggcgtccgctgaaggcagcgaggatctgcgtgtcgatcagcggttccggcagttcgccaaagacgttgaggaacacttccagatcttcgctacccgcatgcaggaatttggtgatgctgcgatcctgtaacagcgcgcggaacggcgtccagtcggtgatggtcagcggatcgatcagcgatacctgctcgccgtcaaacatttggatcaggccaagctgcggatagtaggtacgggtacggacaaattcggtatcaagggcgatagcgggaaacgcacgcgcggcgtcgctcatggcggccagcgcgtcgttggtggtaatcatctggtaattcaaatcaggttctctcaggtttgcgcccataaaaaacgccggctaaccggcgtcgggcgacttactcaaagctcagactttattgtccactttggcgcgggcttcgtcacgcaattctcgtcgcaaaatcttgccaacgttggatttcggcagttcatcgcggaattccaccagttttggcactttgtagccggtaagctgacgacggcagaaggttatcagcgcctcaccggtgagcgccggatctttcctgaccacaaagagtttgaccgtttcaccgctgttgccggagggtactcccaccgccgccacttccagcacgccgggatgctgcatgaccacgtcttcaatttcgttagggtaaacgttgaagccggagaccaggatcatatcttttttacgatcgacaatacgcaggaagccttcgtcgtccatcaccgcaatgtcgccggtgagtaaccagccgtctttgaggatctgatcggtatcggcaggacgctgccagtaaccaagcatcacctgcgggcctttaatgcacagctcgccaggctgaccgtgctcgacttcgttgccttcatcgtcgatcagtttggcttcggtggacggcaccggcagaccaatgctgccgctgtgataatcaatgtcgtgcgggttgacgctcaccagcggcgagcactcggtcagcccgtagccttccagcaggtattgtccggtcagcttcacccagcgctcggccaccgcctgttgtaccggcatgccgccgcccgcggagagatgcagagaggagaagtccagctgctggaactctttgttattgagcagcgcgttaaacagcgtattgacgccggtcatcgcggtgaagggatatttcgccagctctttcaccagccccggaatatcgcgcgggttggtgatcagcaggttctggccgcccagctcgataaacagcaggcagttcatggtcagcgcaaagatgtggtacagcggcagcgccgttacgaccagctctttaccgcgatgcagcagcgggccgtaggtggcattcacctgttcgaggttggcgagcatattgcggtgcgtcagcatcgcgcctttcgccacgccggtggtgccgccggtgtactgtaaaaacgccagatcgtcagtcaccacttccggcttgatgtactgcatccggtagccgttgtgcagcgcctggcgaaacgaaatcgcatccggcaggtgatatttcggcaccagctttttgatgtatttgaccacgaaattcaccagcgtgcccttcgccggggagagctgatcgcccatacgcgtcaggatgacgtgctggacctgggttttttccaccactttttccagcgtgtgagcaaagttggagacgataacaatcgccgccgcgccgctgtcattaagctgatgctccagctcgcgcggggtgtacagcgggttgacgttcaccaccaccataccggcgcgcagaatgccgaacagcgccaccggatattgcagcaggttaggcatcatcagcgccacgcgatcgcccttcttcagccccagcccctgctggagataagcggcaaacgcccggctacgctcttcgagtttgcggaaggtcatcacctcccccatattcacgaaggcaggttgatcggcataacgcgccgtggagtgttcaaacagctctaccagtgactggtagcggtcggggttgatctctgctggcacatcggcgggataacggttaagccaaaccttcttcaatgcatcacctctgaaatgagtatttgtcgtcatcgcaaccccggataataaacaagtcgttaacattatattaactcagcgtaccagtttaataattaaacggatttaaggttgcgaagcgcgtcactatttatttttcttatgatcctgaaaacgcagaaacagcggaccggccgctgtttcttttgttgcattaacaggagtttactcggttactatggtctgaacctgcgccgggccgggattgtaccagccgccataaccgtagcgccacgggtgaggccccggtccccagaaccacgggtcgatgggctgcggcggcatcatcacctgctgggtaatacgccagcgtttatagccgttcgcctgcatcaccatgtatttatatggcgtgtcgccgactttgccttcggcggtgccggtaatcggcccgacaacggtgaccagctgaccgcggaagtcgaccggatcgaggaagccgctgacatcggcataaatacgtccgcgggacggctcgcccagcaccggacgggcagcgctgtccagcggcacggcggcgatctcaaggcgggttttgccctgctcgtttttcacgtcgatcactttgccgccaaaacgcgcttcctgacccacatagagctgcggcgcgttcatcacccgcaccagatcctgctgcggcgtcgggctggtgcccttaatggcatccggtacgctgacgcaaccgctcagggcgacggccaccagcgcggcgactgcgccgtttacaactcgtttattcagtgccatgttgcgactcccgttatgaacatcctgtatctaagattcactcgcgaccaggaagtttcttccatgccacttcgtttcgcaaataaacaggttcggcggtatcggcggtcacggtgttgcccgccgccagcagctggcaggccagcggcagcatatcttccgctgcggggagcagaatgtcgccgtccgtcagcgtgagatcgcagccttgcgccagatccggccaggcgggccagccggtgcccacggtagcccaggcgccgtccagctgcgccagacgcgcgcgcacggcttccggtttcaggacggcttccgtctcttcgccgtgccagacaccctgcgcatcgcgctcgtactgcgcccagtagacttcgcccatgcgggcgtcgatggcggccagcacgcgggtggcgccggttttacggtaagcgccctgcgccatggtggcgagggttgagacgccgatcatcggcagctctgcgcccagcgccagcccctgggcaatgccgatgccgatacgcacgccggtaaaacttccagggccgcggccaaaggccagcgcgtcaagatcgcgcagcgccacgccgccttcgttcaggatctgctgaaccagcggcagaatgcgctgcgtgtgctcacgcgggcagagttcaaaatgggaatggatggtgtcgttttgcagtagcgcaactgaacaggcttcagttgcggtatcgatagccagaattcgcatgggtcttcgcgcgctctctttaataaatggcgcgcataatatcacagactgcgattactgtgtcggcgggacggcgagaaagcgcacggcgcgggagatgtcgcgggtgcgcggcgtcggcggcaggctggcgaggaaggtcgcgccatagggccgcatcaccagccggttatcgcagatcaccagcacgccgcgatcgtcaatatcgcggatcaggcggccgacgccctgtttcagggtgatcaccgcatccggcagctggacttcatcgaagggatcgccgccgcgcagacggcagtcttccatgcgcgctttcagcagcggatcgtccggggaagtaaacggcagtttgtcgatgatcaccagcgacagcgtgtcgccacgcacgtccaccccttcccagaaactgctggtcgccaccagcagcgcattaccggcggtgacgaactgctgcaacagctgccctttgctggtttcgccctgcaacagcaccggcagcgtcagggtggcgcggaactgttccgccagatcgcgcatcatggcgtgggaggtgcagagcataaaacagcggccattgttggcttcgatcaatggacgcagcatcgccgccagttgccgcgccgcgcccggttgattggtctgcggcagattgcgcggcacgcacaacagcgcctgacgggcatagtcaaacggactcggcagcagcagcgagtgcgcctcttcaatgcccagccgggcggtgaagtggtgcagatcatcattcaccgacagggtggcggaggtaaagacccagctgcccggcttctgcgccatcacttctttgaatttatcggctaccgacagcggcgtcagcgcgagggtgaagtgccgcgaggtgcattcgtaccagtagctgtagccgggctggttgatctctttcaggcgttttaagcgtgcgcggtacagggtggcgcgttcaaaggcggcatccagcagggctgaacgcccgagggagagttttgccacgtcgtagcacagctcaagggtgtcatcgagcagcaaaaaagcgcgctgaatgtggctgtccgccagcagttcgcgcagattcccgcgatagcccggctcgccgagctgcaaccgaaaatcctgggcgctctgcgccagccggtcggcgcatttttgcagctgctgggtgtcgcgcagttcggtgcgataggcgatggtgaaatcttttgccaggtcgagcaactgacggctggaaagcgactgaccaaaatactggctggcgatatccggcaactgatgcgcttcgtcgaaaatcatcacctcggcttcggggatcagttcgccaaagccgctgtctttcaccaccatatccgccaggaacaggtgatggttaaccaccaccacgtcggcatccatggcttttttacgcgccttcaccacaaaacagtctttgtactgcgggcagtcgctgccgaggcagttatcgttggtgctggtgaccagcggccaggcgggagagtcttccgccacgctggcgcaggtgctgatatcgccgtcgacggtctggtttgaccatgagcgcagcagaataacgtcgctcagggtctgcacgggtagatcgccccccgccagcgcctgctgttccagacgttcgatgcacagatagttggagcggcctttcagcagcgccagtttcccgctgtactccagcgcgcgggagacggtgggcagatcgcggctgtaaagttgatcctgaagcgctttcgatccggttgagataatgacttttttcccggcgcgcagtgcaggtgcaagataggcgtatgttttcccggtgccggttcccgcttccactaccagcggctgcgttttcgcgatggcctcagccacagcctgcgccatctgccgctgcggttcacgcgggttaaatcccggtatcgcttttgctaactgaccgtcgatcgcaaaatcgtccgtctcactgtttttcgccacactaccccctggttaaatcgccagtgattatgtcaggggcgatggcttttagccagccgaagtcgtgacagggtaaaaactctgtggcagtcttggcgcgccaatggaaattaaggagatggtcatgacaatcgtgcgtattgatgccgcagcccgctggtctgatgcggtgatccacaatcagacgttgtattacaccggcgtgccggagaatttgcaggcggatgcctttgaacaaaccgccaacacgctggcgcagattgatgcgatgctgataagccagggcagcgacaaatcacgcattctggatgccaccatttttctggcggacagcaaggattttgccgcgatgaataaagcgtgggatgcatgggtggttgcgggtcatgcgccggtgcgctgtacagtgcaggccacgctgatgaacccgcaatataaagtggaaattaaaattatcgccgccgtttaaaggcgattattcttcctcgtcttcttcgtcaaagcgtgccagaacccgttcgcctttatggctggcgcgcagttccgcagcaaccagggcaatggcttcgccgctgctcatgccttcagccatcaacgcatgaatgcgatcgacggcctcttgttgttgctcgtgcgtaagggaaggtaaacctgcaaacatagtgaactcctgctaaattgttcgcgctgatcaaacatgctaccccataagccggttaccggatagcaaagagtctggattaatgaagacgttatcacccgccgttatttcgctgccgtggcgccccgacgccgccagccactggtttaccccactcaacacgcagccatgggccatgctgttgcattccggccatgcggagcatgcccataaccgttttgatattctggtggcgcagccctgttgcacgctggtaacgcacggcgacaataccaccgtgacccgcgagggtgtccgtacagcgtccacagcggatccgctggcgctgttacagtgtgaactggacgccatgcagcttgccccgccctgcgatcctgatttgccgtttaccggcggcgcgctgggtctgtttggttatgacctgggtcgccgctttgaaacgctgccatcgcaggccgaacaggatcttcccctgccggatatggccgtcgggctgtacgactgggcgctgattgtcgatcatcatcagcaaaaagtcaccctgcttagctatggcgatatagcgcaacgtctggcctggctggaagcgcaacgggccgaagagacgcaatcgtttagcttaacctcgccctggcgttcaaatataacccgcgagcagtatggcgagaagtttcgcgcggtgcaggcgtttttacacagcggcgactgctatcaggttaaccttgcccagcgctttcaggcacattaccgcggcgatgagtggcaggcgtttatgcagctgaaccgcgccaaccgtgcgccgttcagtgcgtttctgcgtctgccgcagggggtggtgctcagcctgtcgccggagcgctttattcagctgaataacgggaccattcagacccgccccattaaaggtacgctgccgcggttaagcgatgcgcaggcggatgctcatcaggccgcgcggctggcgcagtcgcccaaagatcgcgccgaaaacctgatgattgtcgatctgatgcgcaacgatctgggccgcgtcgccgaaccgggatccgtacgcgtgccggagctgttcgtcgtcgaaccgttcccggcggtgcatcatctggtgagcaccatcaccgcccggcttcctgcctcgcgtaccgcctgcgacgtattacgcgccgcttttccggggggatcgatcactggcgcgccgaaagtgcgggcgatggaaattatcgatgcgctggagccgcaccgccgtaacgcctggtgcggcagcatcggctatatcagtctgtgcggcaatatggacaccagcatcactatccgcaccctgagcgcctgtaacgggcagctatactgttcggcgggcggcggcatcgtcgccgacagcgaggagcaggcggaatatcaggaaacctttgataaggttaatcgtattctgcatcaactggagagctgattttggatttacaggcgctgacactggatgattttttatcgcgatttcaacttttacgtccgcaggcgagccgcgcgtcgctgaacgccagacaggcggcggtgctgatcccggtggttcgccgtgaacagcccggtctgttgctgacccagcgttcggcgcagttgcgtaaacatgccggtcaggtggccttccccggcggcgcggtggacagcagcgatgcgtcgctcatcgccgccgccctgcgtgaggcgcaggaagaagtggcgatcccgccggagacggtggaggtgatcggcgtgctgccgccggtggacagcgtgacgggatttcaggtgacgccggtggtcggcattatcccccctgacctgcactatcacgccagtgaagatgaagtggcggcggtttttgagatgccgctggcggaagctctgcgtctggggcgctatcatcctttagacatccatcgtcgcggcaacgatcaccgcgtatggctgtcgtggtatgagcactatttcgtctgggggatgacggcgggtatcattcgtgaactggcgttgcagattggcatcaaaccctgaatattctttatgcaataacccttctgccaggagtgggatccgcgtctcgccattagaaaattaatgttcacgcattaatttaattcatgcgaatactccagccgatcccgcagttccctcatacactatgcgcaattattacatcgttatcggaaagtccggtaaccctgtcaggagtgttaatgtgattagtctattcgacatgtttaaggtggggattggtccctcatcttcccacactgtaggcccgatgaaggccggcaaacagttcgtcgatgacctggtcgaaaagggattgcttgagagcgtaacccgcgtggcggttgacgtgtacggttcgctgtcactgaccggtaaaggtcaccatacggacatcgccattattatgggtctggcgggcaatgcgccggccaccgtcgatattgacgccattccggcgtttatccgcgacgttgaaacccgcggtcgtctgctgctggcgcagggtcgtcatgaggtggatttcccgaaagataacggcatgcgcttccagagtaataacctgccgctgcatgaaaacgccatgcagatccatgcttacaacggcgacaccaccgtttacagcaaaacttactattccatcggcggcggttttatcgtcgacgaagagcatttcggcaaagaagccagcaatgaagtgagcgtgccttatccgttcacctcggcaaaagagatgcttgattactgccatgaaaccggcctgtcgttatccggtatggtgatgcagaacgaactggcgctgcacagcaagcaggagatcgaagattacttcgctgatgtctggcagaccatgcgcgcctgtatcgatcgcggtatgaacactgaaggcgtgctgcctggcccgctgcgcgtgccgcgtcgcgcctcggcgctgcgccgcctgctggtggccagcgataagctgtccagcgatccgatgaacgttatcgactgggtgaatatgtttgccctggcggtaaacgaagaaaacgccgccggtggccgcgtggtcaccgcgcccactaacggcgcatgcggtatcgttccggcggtgctggcctactacgatcactttattgagccggtgacgccggatatttatatccgctactttatggcgtccggcgctattggcgcgctgtacaagatgaacgcctctatttccggcgcggaagtgggctgtcagggcgaagtgggcgtggcctgttcaatggcggcggccggtctggcggaactgctgggcgcaagcccggagcaggtgtgcgtggcggccgaaatcggcatggagcataacctgggtctgacctgcgatccggtggccggacaggtacaggtgccgtgcattgagcgtaacgccatcgcctcggtgaaagcgatcaacgcctcacgcatggcgatgcgccgtaccagcgcgccgcgcgtgtcgctggataaggttattgaaaccatgtacgaaaccggtaaagacatgaacgccaaataccgcgaaacctcccgcggtggtctggcaatcaaggtgcagtgcgactaatacttctcatagcccttctgcgacagaagggctaaatctcctccaattctcgtccgattattttttccacactacacttgctgtggtgccgttgccttttgcgatcaacggtatacttaccggacgatgacttcatgcagactgcgcaacggatcattagcgactaccggcgaaaacgcattatcgtctgcgtgcttgcggccgtttccatgctgctgttgaccctcggcgcgcgatttatttcggagcggaatttaaatcagcagcgtctgttatctttcacttctcatgctgtttcctcactggaaaaagtactctccgcccttgaacgcgggcgtcccctgctgttgccgctggtaggtaaaccctgcgacgacgtgcatctggcgctgcgtattgaagcggcttctttgcagactatccgctccattggcctggtggagaacgggatgctgtactgttcaagcatttttggttttcgcaatgtgcaggtgcgtcaacttcagcctttgctgcccgccagcgaagcacagctgatcctgtccaccgataaatcgttactcaaaggcagcccgatactgatccaatggtttccttctgcgcaaggggatgacagcggggtgatgaccattgtcaatattacgctgctgaccgacctgatgctggagccgcaaaaaccgctgatcaccggcgccagtctgtcggtcaataaccggcatctactgtatggcggtggggtggcggacgccctgcccgcgctgacggatgaaaaacgcttttcgcaaacgtcacagcgctacccttttacggttaacgtccgcgggccgggcgcaacggagctggcgctgcggcatctgccctcccagtttccgctggcgctgctgctcagcctgctggtgggttatatcgcgtgggtggcgaccgccagccgcatgagctttgcgtgggagatccatatggggctggcggaaaatgagtttgagctgttttgtcagccgttgctggacgcacaatcccagcagtgcgtgggagtggaaattctgctgcgctggaataatcgccgtcagggctggatctcgccggatgtgtttattcctatagccgaaaaccagggtttgatcgccccgctgacgcgctacgtgctgacggaaacccatcgccagctcgccctcttcccgccctcgccgcactttcatatcggcattaacgtcgccgccagccatttcggccacggagagctgattgccgatctgaaccagcactggtttaacatccgtccggtgcagcaactggtgatagaactcaccgagcgggacagcctgagcgaggcggatttccgcatggtgcgtgaactgcatcgtatgggcgtgaaagtggcgattgatgattttggcaccggcaacacgtccctctcgtggctggaaaagcttagcccggacattcttaagatcgacaaatcctatattgcggccattggtacggatgcggtgaattcgacggtgacggacatgatcattgcgctgggcaaacgtcttgcgctggaaatggtggcagagggggtggaaaccccgctgcaggcggcacatctgcgccagcgcggggtgcatgtgttacaggggtttctctatgcgaagccgatgccgctgaaagatttccccggctggctggcgggaagtaccccgccgccagcccggcataacgggcggatgatgccgtcaatgccgttacagtagccttactcttcttcgtcgtgctccggacgctctttaacaacccgaaccagatcgacccggtagtcgttggcttccagcacggtaatggtcagcggcgccagttgcagcacgtcacccgcgcgtgggatctgaccgttaatggcaatcaccagaccggcaacggtcgcgatatcttcgctgtcgttaaccaggttatccagccccagcgcatgttgcagggcatgcagatcggtggtgccttttaccagccagccatcggcatcggcgatgatttccggcgtttcgtcggcatccgggaattcaccggcaatggcttccagcacgtcgagcggcgtcaccaggccctgcaccacaccaaattcattggtgacgataacaaagctgccgcgggcgcggcgcagcacgccaagcagtttgatcggatccagggtttccggcaccacaatcgccggggacgcagacgctatcgccgccacatcgccgccctcttccagcgctaccagcatctctttggcgcgcacgataccgatcacttcatccagctcgccacggcagaccgggaacaggctgtgcggcgacgagagcaattgctggcggatagtgtccttatccaggctggcatccacccaactgatgtcgccgcgcggcgtcataatgctgcgcagcgagcgcgacgccagcgtcagtacgccgttgatcatataacgctcttcatcggcgaaggccccttccggcacctgcaccggcgcttcgctgtccggctcatgctgttgattatctttgcggcgaccgcccatcagacgcagaatggcgtccgcggtacgggcacgcagcggcagcgttgactgatggcgaataaagttgcggcgagcaatctggttaaagaactcaataatgattgagaaaccaatcgcggcatacaggtagcctttcggaatatgaaagccgaagccttccgccaccagactcagaccaatcatcaacaggaagctcagacagagcaccaccaccgtcggatgctgattgacgaatcgcgtcaacggttttgaagccagcagcatcaccgccatggcgatcactaccgccgccatcatgaccggcagatggttcaccataccgaccgccgtgatcaccgcatcgagtgagaagaccgcatcaaggatgacgatctgtaccaccacgacccagaagctggcatagcctttcgtctgtccggtgtcatgttcacggttttcaagtcgctcgtgtaattctgttgtcgctttgaacagcaagaatagtcccccgagcagcatgattaagtcacggccggagaagcttaaatccatcacggtaaacagcggctttgtcagcgttaccatccacgagatcaccgacagcaggccgagtcgcatgatcagcgccagtgacaggccgatcaggcgggctttatcacgctgtttaggcgggagtttatccgcaaggatggcaatgaacaccaggttgtcgataccgagaacgatttcaagaacaacaagcgtcaacaaccccacccagatcgaggggtccattaagaattccatgacaggctcctgtttacggaatggcaaaacggtgcgttaagcacaggcgtgatgacagcagatgaaaatgaaaggtggcggaaaacgccggattgcgaggcacgaaacggccaatgggttaactgacgtcggtgacggtccatacacggggctactgccctatactccttgataattaaacggatggtaaacatagcagagagaattaatgttttgcaaagatttaccggaatttgcaattggaattttgtggttatttcgcgggccgaaatttctgatcgacgaaagctaaattacggatgcgcatcacaaaaattattttttcgatgtctaaaataattcacggaagttttaacttttctttcaaacccttatctgaatcgattcgctggtaaagattgattcacaacacatctgttacagaggtgttaacgataataacggaggtagcaagtgaccattgctattgtaataggcacacatggctgggctgcagaacaattgctcaaaacagccgaaatgctgttgggtgagcaggaaaacgtcggctggatcgatttcgttcccggcgagaacgccgaaacgctcatcgaaaaatacaacgcccggctggcaaatctcgacaccagtcaaggggtgctgtttctcgtcgatacatggggcggcagtccgtttaacgccgccagtcgaattgtcgtcgataaagagcattatgaagtggttgccggggtcaacattcctatgctggttgaaacgctcatggggcgtgatgacgatccgagttttgacgatctggttgccgtggcggttgaggcgggacgtgagggggtgaaagccctgaaggcaaaagcgccggaagcggtaacgcctgcgcctgctgctgtggcaaaacccgccgcaccggttaagcccatgggcgcggatgattacatggtgatcggtcttgcgcgtatcgatgaccgtttgatccacggccaggtggcaacacgctggaccaaagaaaccaacgtgcagcgcattatcgtggtcagtgacgaagtggccgctgataccgtgcgtaagaccttgctgacgcaggttgcgccgcctggcgtgacggcgcacgtagtggatgtcgcgaagatgatccgcgtttataacaacccgaaatacgcgggtgaacgcatcatgctgctgtttaccaaccctaccgatgttgaacgtctggtggaggccggggtgaagatcacctccgtcaatatcggcggtatggcttatcgtcagggcaaaacccaggtaaacaacgccgtttcggtggatgaacaggatattgaggccttcaaaaaactcaatgcccgcggtattgagctggaagtccgtaaagtctcaaacgatccgaaactgaaaatgatggacttgatcggcaaagtggcgaagtagccggcacgagctgatttactcagttttcacaactacgtcttagttataggagaagtacaatggagatcacccttcttcagattgtgctggtgtttgtcgttgcctgtatcgccggtatggagtcggtactggatgaatttcagttccaccgtccgctggtggcctgtacgttaattggcatggtgctgggtgatatgcaaaaaggcatcatcatcggcggtaccctggaaatgatcgccctcggctggatgaacatcggggccgccgtggcgccggatgccgcgctggcgtcgatcatctccaccgtgctggtcattgccgggggccagagcatcggcgccgggattgcgctggctattccgctggcggcggcaggccaggtgttaaccatcatcgttcgtaccattaccgtggcattccagcacgcggcggataaggcggccgacaacggcaaccttacggcgctgtcctggatccacgtttcttccctgttcctgcaggcgatgcgtatcgcgatcccggccgtcatcgttgcggtttctgtgggcaccagcgaagtgcagaatatgcttaacgccattcctgaagtggtaaccagcggtctgaacatcgccgggggcatgatcgtggtagtgggttatgcgatggtcatcaacatgatgcgcgcgggctacctgatgccgttcttctacctgggcttcgtcactgccgccttcaccaacttcaacctggtggcgctgggcgtgattggcgcggtaatggccatcctttatatccagctgagcccgaaatacaaccgttcagcaggtggcccggtaccggccgcgggtgcaaacgatcttgataacgaactggactagcaggtgagcgacatggttgatatgacaaaaactaccgcagtgaaaaaactcactccgggtgatattcgtggcgtgttcattcgttcaaacctgttccaggggtcgtggaacttcgaacgtatgcaggcgctgggtttctgcttctcaatggtgccggcgatcaaacgcctctatccggaaaacaacgaagcgcgccgtcaggccatcaagcgccatctggagttcttcaatacccatccttacgtggcggctccagtactgggcgtgacgctggcgatggaagagcagcgtgctaacggtgcggagatcgacgacggcgccatcaacgggatcaaggttggtctgatggggccgctggcaggcgtgggtgacccgattttctggggtacggtgcgtccggtgtttgccgcgctgggtgccgggatcgcgatgagcggttctctgctcgggccgctgctgttcttcatcctgtttaacgccgtgcgcctggcaacccgttattacggtgtggcctacggttaccgtaaaggcgtggacatcgtaaaagacatgggtggcggcttcctgcaaaaactgaccgagggggcgtcaattctcggcctgtttgtcatgggggcgctggttaacaagtggacgcacgtgaatatcccgctggtggtgtcggaaattaccgaccagaccgggaaaaccaacgtcaccaccgtacagaccatcctcgatcagctgatgccggggctggtgccgctgctgctgaccttcgcctgtatgtggctgctgcgtaagaaagtgaacccgctgtggatcatcgtcggcttctttgttatcggtattgccggttacgccgtcggcctgctgggtctgtaaagggtagttattgcgccggggcctttgccccggctttttttcgggaggatgaatgacgatcacggatatcgtgttgattttgtttgttgctgcactgctggcttacgcactttatgatgaattcatcatgccccgccgccatggacaaacgctgctcagcgtacccctgttgcgccgcagccgggtcgacggcttcatttttgccgggttgctggtgatccttatttataacaacgtgaccaataatggtgcggttttaaccacatggttattatgcgcactggcgctgatggctatttatctgttctgggttcgcgcgccgaaaatcatcttcaaacaggatggttttttcttcgccaatgtctggattgcttataaccgcattaaagagatgaatttatctgaagatggtgtgctggtaatgcaattagagcagcgccgcctgcttatccgggtgcgcaatatcgatgacctggaaaagatctacaaagttatggttaaaactcaatgagttaaaatatagcgaaggctatatttctgcacataaaatcaccgcagttatagccactgctatattattttctacggaataacttatattttttaacctgattattaccaataaagacaaatgcaaatcgttatcagcctgacaaaaaagtaatgaatttctgtgattgttctcaccttgcgaaatatggtaaggttgcgcccgtcgttggggagtagccgatttccattcaccccggaaatgtgcgcgtcaacatactcgttgaaaaacgtggcgcgtacgaatcaaaccgcatagccgtttgatttggcgagaccattgacacatcaactgctgattactgggggcagtgatgtgttatatggataccccggtcaggacgctcttatgaatttatctgccactctcctgctcgcttttggcatgtcgatggatgccttcgccgcttccatcgggaaaggcgctaccctgcacaaacccagattctccgaggccctgcgcaccggtctgatctttggcgcgattgaaaccctgacgccgctgataggctggggactgggcatgctcgccagccagttcgtactggagtggaatcactggatcgcctttttgctgctggtttttctgggcggacgcatggtgctggaaggggtacggggaaatgatgatgaagatacgcccctgcagcgtcacggcttctggctactggtaacaaccgcgattgccaccagcctggatgccatggcggttggcgtcgggctggccttcctgcaggtcaatattatcaccaccgcgctcaccattggctgcgcgaccctggtgatgtcgacgctcgggatcatgattggccgctttattggcccgctgttaggaaaacgggctgaaattctcggcgggatcgtgctgatcggtattggttcgcagatcctctggagccacttcgccggttaaggattacgctgccagcactggatgctgaaatccgtctgacagctgaactgttccatatccgccagcgcttcccataccgccggtttcgcccgccacgcgaagggcgtcatctgcaacagcgccaccgcttccgccccgctcagggtcatgcggtaccccagcgcatgctgctctgccagcgtaaaaccttcgatctgctcactttgcggcgcgtgaagctgaacttcatcgtagatcagccctttcagctcctgtaagtgatgcgggccgggagcggcggtgatcacccagccaccggctttcactacccttgccagctcctgcgctttacagggcgcgtagatacgtacaatcgcatccagcgtactggcttcaaacggcagccggtggcttgacgccacacagaacatcacctgcggataacgctttgccgcggcgcgtattgcgggctttgacacatccagcccgaaagtctgcgccccgtgctgcgcggcgatctgcgcgaacgcatcggtgtaataaccctcgccgcagccaatatccagcagcgcactggcctgcgccggtaagcgtgcgtccagttgctcgctgatggcatcccgcaacggctgatagtgccccgcatccagaaaggcgcggcgcgcctgcatcatctctgcgctgtcccccggctcgcgggagcgtttatgctgaacgggcagcaaattgacgtagccctctttcgccagatcaaactgatgccgttgcgggcagacgaggctattttcctgacggcgcaacggcgcatggcaaagggggcaactgaaggacatatcaactccgggcgataataaagggcgaaagtgtaacgccaatcgcccctgcgggaaatgatttagcgcgttgccgccacgccggaagaagaattgagcaccagcagatgatcgtcgccggggcgcaaaccgtcgggttcgatattttcgacacgcagtacacgggtcatgatctcgctgaataccggcgccgacacggcaccgccgtaataggcaccgtttttgggatcgtcgatcaccaccaccagcgcatattgcggatgactggctggcgcgacgcctgccgtgtaggcgacgtatttatcgacatatttcccgtcatcgccgattttcttcgccgtgccggttttgaccgccacccggtaatcgcgtaccgccgctttggtgccgccgccgcccggtagcgcgacgctctccatcatatgctccacctgatgaacaatgtcagcgggcatcacctgcgtacccatcaccggcggatcgacacgggtaatagaaagcggccgcgccagaccaaaactgccgatagtggcgtagacatgcgccagctgtagcggcgtgaccatcaggccatagccaaatgagaaggtggcgcgatctaactgcccccagtaacggcgcaccggcaggctgccacggctttcgccggtcagacccagcccggtggggataccaaagccaaagcttttataagtatccaatagcttctggatgggcatcgccagcgacagtctggacacgccggtatcgctcgatttctgcagaatgccggtcagcgtgagttccgggtaatagcccacgtcgcgaatacggtgtccgtcaatgacatacgggtgggtatccaccacgctgtcaggtttgactatcccctgctgtagcgcagtcatcagcaccatcggcttaacggtcgagccgggttcaaaggtatcgctgatggcgcggttacggaaatcatccagggtcgcgccgctgcgattattgggattaaaatcgggataattggccatcgccagaatttcaccggtgtctatttttatcagcaccgccgcgcctgactccgccttattccaggtaacggcgttattcagcgcatcttccgccagggtttgcagccgtttatcgatgctcagcgccagggtttgtgccggtaccgcgggcgtttcggtgatattttcaatcacgtgcccatagcgatctttacgcacctcgcgcagaccgggcttgccggtcagctgcgcgttaaagcttttctcaacgccttcgatcccctgcccgtcgatattagtaaaaccgatcagattggcggcaacatgcccgccgggataaaagcgccgtgattccgtttgcagattaatgcccggcagattgaggcgatctatccactgcgcctgttggggatcaagctgccgcgccagatagacaaagcgcgacgatgcatgttgccggagcatggcggccagatcgctcagcggcattcccagcgctttcgtcagcgcctgccagcgtccgttatccaccgggccgcccttttcacggataaccttcggatcggcccagacagcatcaacgggcacgctgaccgccagcggtgatccattgcgatcgacaatcatgccgcgcggcgacgacactttcacttcgcgcaaagaacgcctgtcctcctgcctgaccagtttgtccggggcaataatctgcagccaggcggtgcggcccagcagtatgcccagcgagaaaagaatggcgatgcaaagcagggtaaaacgcagaggggtaaaattgagggtaaggctgttctttttcaccgtggctcctgtaatgaattaacccgctgatttaacgggaaacaggcgcagaaagggaaaaaactgtgctaataacggtatggctttgctacaaaaggataatgaggaagcaggaggtaacactttgaaatgaaggcattaaaaagccccgcaccgggcgaggctttatgctgacattgaccgcctgtggcgttcaagtcggtggcagaaatcagatagcggtaacgttaactgctgccgggcctttctggccgtcctgaatttcgaactcaacgttctggccttcagccagagttttgaagccgttaccctggattgcagagaagtgtacgaacacatctttgctgccgtcagcaggagtaatgaagccaaaacctttagactcgttgaaccacttaacttgacctttaatctttgccatttgcaaaattccttagagtgttttcttagcccgcaggcattaactgagataaaactgagacattactgcttgaggcactaatataaggttcggcagagaagcggtattcaacgacaacgtgtttactcaggacttctttactgaaaatgccacacataaacagaactgtacctcgttcgactcacgacgtgttatcacatacaacatgaaatatggcaagccatttttaaacatgtctggatccgccgcacaaattctgcaaatgccttcactacccgccttcgataagacctgacgttgcagatcagggcgctttaacggtagttatgggcacgtgcggatcctgtgaaaaacacgactttataaccatagcttaatatgatggattgatccagcctaagctaagcgattgatataatataaaatatatccttataactttttcttctggcttataaagttaacaaaagaaccatcaataaagcgtaattttacctggttatacaaaggtgctgagtgagtgaataaaagttgcacaaataataatgtgcctgcaccaaaataatgaaagtttaatgacattgcatcatcgtaaagcaataaaaacgtttcgctggtgcaaaaaataatagcatttgctgttaatgcgggaataaggaaaagcttatgcgaataatttcgctggaaaggataaatactgaccgattttcaggatgcgaaagttatcacgccgccctcccgcttcgtttaattcctgcaccagttcccggacaggttcatcgagcccttcatccgccagctcaaacacgccccagtgcaccggaaaagccagcggttccccggcctgctgccagagtcgcaccgcctgctgaggatccatatgatgtgaggccataaaccagcgtggtgcataagcgccagccggcagcgccaccatatcgaatggccccagacgctgcgggatgtcggccagcgtcggcgtgtagcctgtatcgccggtaaaccagaaacgctggtgcggggatgtcactacccagccacaccaaagcgaccgattgcgatcccacagggtgcgcatactccagtgctgggcgggaacggcagttatcgtcaacccatggaagctgcggtgatcccaccagtcgagctcaacgatatgctgtacaccgcgacggcgacaccagtcgcccagaccgagcggtacgaagagggtgacataaggaaaacgctttagcagcgcacgcagggtacgcttatcaagatgatcataatggttgtgggaaatcaggatggcgtcgagggcgggcagatcgttgatgttcagcgccaggggcgttttgcgccgcggcccgctgaaactcaccggtgaggcgcgatctgaaaataccgggtcaatcagcagatgcttgccgtcaagtcgcaacagcatactggtatgaccgagccaccagacgcgatcgtcttccccggaaataacggcgcgttgccaccatttgtcgataaaagcgtcataaccaccctgtggtgctaaaggtaacccggcggcacgacgttctttacgccagcgctccacgtcgccaggtttatgtccggtttcagacaggttacgaaaaccttcaggggaatgatgcggcagatcaggattataccagggatttttccatgccatgctgcaccctcccctgacgatcagcgctcggcgaccagacgaataaaatcgtcgccatcggcctgaacgttcaccgctttctcgggcgcttctttttcaggttcgtttgcttcgcacaggcggcgcagcaaggccgtctgccgcttttgctgatcgagcagcgcttcaagcagttcgatctgttcacgggtacgtgagctcagacgattgacaaaaaaccacaggatcagacctgcgaccagcaccaccagcgatacgatcaaagacgcaagattaaacacgcctgaattcagtacttcgttcatttcaccacctcaatgttaacgcgctatcttaccactggcattaaggaaggaaatcattcactgaaaaaatgccgtcaccagggaataaatttattgataacgcagataccgctgaaaaactgcacatcctgatcgcacataacattcagcatctgggtccacatcaacaggcagacaaccagcgcggcgatcacgataagccaccgaaattttctcactacactctccgaattaataccctgtctcaaggttatcacgcgcttgttaaaccgcggctaactgtagcgctatccggcctttttaggaatgcgtgacttgtttcattgcgtaaaaaccgccaggattttacgcacaggataataaaaggagtttatatgcgcatgacagttcgcacgattatgatcatcgctctgctgtggattggcgtattactgagtggttacggcgtactggttggcagcaaagaaaatgccgccggactcggtttgcagtgtcgctatctgacggcgcagggcttcagcacagcgcaatatattcataccgacagtggaattattggttttacgaattgcccggtactgcgcaaaagcaatacggtaattgattaagtgattgcccggtcagcagcggctaccgggcaacgatttctattcagaacgggtagtcgttgtagcccatctgctcagagattttacgcgcggcagtgtgcagcatggccacgtaatcgtgcaaatgctcctcagagaaacgcagcgtagggaacgaaatactcagacccgcaatcaccacgccaaaacggtcaaataccggtacgccaatgcagcgcaggccttcttcctgttcttcgttatcttcgccgtagccctgctcacgtacgatatccagcatcggcagcagatcttgagttgtggtaatggtgcgatcggtactgcgcttatactcaacgccttccaggatctgcttcacttcttcacgatcgcgccacgccagcagcactttgccaatcgccgtgctgtacagcggattgcgacgcccgatacgggaatacatgcgcaggttgtacatggaatcgattttgtgaatgtagacgatactgtcttcatccagcgcgcccaggtggatcgtctctttggtcagacgggacagttcgcgcatctgaatatccgcgctgcggatcagatccacattctgtagcgcacgcgcgccaagttcaaaaagcttcagcgtcagcgaatacttttctgactcaccttcctgcgccacataacccagcgatttcatggtctgcaaaaagcgataaacagtgctttttgacatcatgacccgctgcgacagttcggtgataccaatttcacgctcttcgccgagcgcctgcaggatgccaaaaactttcagaactgaagagacagaatctggctgcttatccaaatctgcgattgccattaatcacctcatcgccagtgttttataaaaattagaaccggtttttattataaattcgcggcgggctgcccgcaatgcgcgtttggcatcttctttacaaatctgcgacataaaaccgaatatcctgccggacggcataaaaaaagcgcgccgggtggcgcgcctgatgtatcaaatgacggcttatttcagataagcgccgctacgcaacgcttcaatgcgtttatccagcggcgggtgagtcataaacagctcgctgagcgatttggacttaccgttgatgcaaaaggccatcatgctgctggcttcctgcggctcatagctggttttcagacgctggagcgccgcgatcattttctcacgcccgaccagacgcgcagaaccggcgtcggcgtggaattcacggtggcgggagaaccacatggtaataatgctggccaggataccgaacaccagttccagcaccatcgccaccacgaaatagatcatcgggttgccgttgctctcttcgccctcttcgcggttaccgccaaggaagcccgccgccagctgcgccaggatacgggagatgaagataacgaaggtgttcaccaccccctgcaccagcgtcatggtaaccatgtcaccgttggcaacgtggctgatttcatgggcgataaccgcttccgcttcgtcgcggctcatgttctgcaacagcccggtgctcaccgccaccagcgaagcgttacggctggcgcccgtggcgaaggcgttaatatccggcgcgtggtaaatagcgacctgcggcatggcgatcccggcctggcgggactgctgctcgacggtctgcatcagccagcgttccatatcgttacgcggctgctcaatgacttcgccacccacggatttcagcgccatccatttcgacatcatcagtgaaatgatggatccgccaaaaccgaaaagcagcgccatgattaacaagccctgaatactgctggactgaatgcctgtcaggctgagcaccagcccgaaaaccaccatcacggccaggttggtcagcaggaaaagcgctatccgcatcataattttcttttaaccccagtttaacaaaacgcactatgcgattacccacatcgtatgggtatacgcggcattttcaaggatccaggcttcgtaagtcaccagaaagacacaactttacattgagaatgacattgctgacgtgaatacgcgtttgttaaaaaaaacaggcacaatttcttgtgcctgtggtttttattttgcaggagcgggcttcgccgccggttgatcttttgtgagatgggcaagatcaagggcgatatgcaccgtttcatccagatacggatccggctccttgtaatcttttggcaggtcatccagcttcttgagtaacggcttgccttcgcgcttaaagcgatcgttcagacgcgccagacgaatggcatcgtcttcggcgttctctttctcgcgctgcgcctcattcagcgacacgatgtcccgtttttccttcatggcgttgaaacgggcaatgtccttcatgatgtactggaactcaggatcttttgcgatacgctcgttatgatctttcagcaactgcggcccgtgcggcgttaaatcgccatacttcacaaaggtcgcggcgttgatgctgtcccacggcagggcgttatcctcgaacttctcgccggtttccgtctcttcattacctgtcggcatgatgatgtccggcgtgacgcctttacgctgcgtactgccgccgttaacgcggtaaaatttctggatggtgtactgcaccgagcccagcgctggccattccggacgcagcatctgatcgtaaatacggttcagcgagcgatactgctgcacggtacctttaccgaaggttggttccccgacaatcagcgcacggccataatcctgcatggcggcggcgaaaatctccgatgccgaggcgctgaagcggtcaaccagtaccaccagcgggcctttgtagtacacaatgccgtcgttatcgctgtcttcgcgcactttaccgttgttatcacgcacctgcaccatcgggccggacgggataaacagacccgagagcgataccgcttcggtcagcgcgccgccgccgttggtacgcagatcgataatcacgctgctgacgttctgtttttccagcttctgcagctgcaccttgacgtcatccgtcaggccaacgtagaagcccggaatatccagcacgccgactttttctttgcccacggttttcacggacattttcaccgcgcgatcttccaggcgaatgcgttcacgggtcagggtaacaatgcgcgttttggtgcccttacctgccggcaggatctccagacgcactttgctgcccttcggccctttaatcagcgcgacgacgtcgtccagacgccagccgatcacgtccaccatgttctgcccggtctgaccaacgccaacaatgcgatcgccaacggtaatggctttgcttttcgccgccggaccgcctgccaccatcgaattaatgacggtgtagtcatcgtccatttgcagcacggcgccgatcccctcaagggagaggctcatttccgtgttgaactgttcggtgttacgcggcgagagataattggtgtgcggatcgatttcgtgcgcgaacgcggtcatcgccagtgagaaaacatcttcactgttggtctgcaccagacgacggatcgcaaacttatagcgacgcgtcagggtctcgcggatctctttttcgtttttaccggtcagcttcaggctcagttcgtcaaacttaaccttgccatcccacagggcgttcagctcggcttcgtctttcggccacggcgctttgctgcgatcgacgttgaaggagtcgttgccggtaaagtccatcggacgctccagcactttcagcgcgtattgataacgctcaaagcgacgcttctgcgccagattgtacagatcgtagaaaacgtcgagtttaccggtgcgtaactcatcgccgatcacgccctttttctgggcaaactgggcgacatcgctggctaacagcacgttgtggctgtaatccagcaggttcaggtagcgatcgaaaattttggcggaaaacgcctgatccagatcgaactggcggtagtgggagcgagtgaagcgcgaagtcacgcgttcactcactgtggcatgctgcgtctcttcctttaacaccggaatttgatcagcacgcgtaatatcttcgacggcgaaagcctgccctgtgatcaggagcaggccagccaacgcggtgcgcttaaacaaagtgttcatgccaggcctggcctccgtttcagaacaacaggtgttctgcgcgtacaatcatcgacataccagaagtcagctgcacacgaacgccatctttggtgatttccgttacagtggcatccatggcattgttgcccgctttcaccttgaggttctgccccacactcagcgcagtgatatctgacactggagtatgctgcggctcttcacgcggtgcgcgctgtggcttagcggctggcttatcggcacgcggtttacgctcgccgccttctttgcgacgaggcgtcgccgggcgcggtttacgttcacgacgcggtgcgtcttctgccggctccccggcggcggcggcagcttcgcgctttttcgcctgctgctcggcacgttgtgcctgcacgcgggctttggcttcttccagctgcttacgggcgtgctctacgtgctgctcgtccagcacaccgcaagggttgccgtcgagatcgacgcgcgctgcgcccgctttgataccgtacaggtagcgccagctggaggtgtaaagacgcaatgcagagcgcagttgggttttgctgagattcatctcaccatcaacacgctcgacgagatcctgaaaaataccaattttcagggggcgcgcttcgccttcagcactgaaacagagcggaaaacgttcggccaaaaatgcgataacttctttactactgttcaacttaggttgattttccatgaaatttcctgattacaacggacgtagccaactagccgcaggcatgaacaggcgtcattataatgacgctatcagtaaatgctacgttatccgttgattatcctgcgacggctgcaaagaatttacggtaatcggtcgccgccagaacggtttcaagctgcgaaaccagctggcgcaggccctcttcgtcctcagcagtgaagcgggaaaagaccgtactgtcgatgtcgagcacgccaataatctgatcgttcactaccagcggcagaacaatttcagcattactggcggaatcgcaggcgatgtggccatcaaaggcatgcacatcatccacccgctgcacacggttttgcgccaccgcggtgccacacacgccgcgaccgacaggaatacgtacacaggcgattttgccctggaacggccctaacaccagcgtctcgccttccagcaggtaaaagcctgcccagttaaccccgtccagacgctcaaacagcagcgcgctggtattggcaagggtggctaagaaactgctttcgcctgtcatcaacgcctgaaaatcgcggttcaaatccgcatagaaatctgctttgttcattatttaatcacttggttgtcttacaaaattcctgcacagcctaataaaataagcattaaatgcgttcttgctcaagatgattccattcatgagttaatatagatgcattccaacactggctattgaaaccatggctttaaaaatctcgcaggtaacaccagacaaaaaaatcaccgtacattcggttggtgatgctttgcctcgtgcacattatcagcgttgcccgcagtgcgatacgctttttgcgttaccggtgatgaaatcgcaccagagcgcctggtgtccgcggtgtgacgccaaaattcgcgatggacgcgactggtcgctgacgcgcctggcggcgatggccgtcaccatgctgttgctgatgccctttgcctggagcgaacccttgctgcgcttctatttgctgggcacgcgcatcgacgccaacctgttgatgggcatctggcagatgaccgcccagggcgatccattgaccgcagcaatggttttgttctgtaccgtcggcgcgccgctggtgctggtcgccgccattgcctatctgtggttcggtaatattctcggcatgaacctgcgcccggtgctgctgatgatcgagcggctgaaagagtgggtgatgctggatatttatctggtcggtattggcgtcgcctccatcaaggtgcaggattacgcctacctgcaaccgggcgtcgggctgctggcgtttatcgcgctggtgatcctcagcatcctgaccattatccacctcaacgtggaacagctgtgggagcgtttttatccccagcggccggcgacccgcccgcatgataacctgcgcgtctgcctcggctgccatttcaccggtttgcccgatgcccgcggtcgctgtccgcgctgccatattccgttacgttttcgccgtcggcagagcattcagaaatgctgggcggcgctgctggcgtccatggtctttctgttacctgcgaatctgttgcccatctcggtggtttacattaatggcgcgcgccaggaagacaccattatgtcggggattatttcactggggagcagcaatatcgccgtcgccgccatcgtatttatcgccagtattctggtgcccttcaccaaggttctggtcatgctgacgctgcttgtcagcattcattttaaatgtgagcaaggattacggactcgtgtattgttattgcggctggtgacctggatcgggcgctggtcgatgctggatttgtttgtaatttcactcaccatgtctttgattaatcgcgatcaattgctcgcgtttaccatggggccagctgcgttttatttcggcgcagcggtaattttgactattcttgctgtggaatggctggacagccgcttactttgggatgcacatgagtcaggaaacccccgcttcaccgactgaagcgcgcattaaaactaaacgtcgtatttcacctttctggctgctgccggtcatcgcgctgatgatcgcaggctggcttgtctggagcagtttcgaagatcgcggtaataccattaccatcgacttcgtttctgccgatggcattgtggcgggacgcacgccggtccgttatcagggggtggaagtcggcacggtgcaggacattcgcctgagcgaaaaactcaataaaattgaggtgcgggcgagtataaaagccgacatgaaagatgcgctgcgtagcgatacccagttctggctggtgacgcccaaggcatcgctggccggtatttcaggtctggatgcgctggtgggaggtaactatatcggcatgatgccgggcaaaggcgaacctcaggatcattttaccgcgctggatacgcagccaaaataccgtcttaacaacggtgagctgatgatccatctccatgcggcggatctgggctccctgagcagcggctcgctggtctacttccgtaaaatcccggtgggccgcgtctatgactacgccatcaacaaagacaaacagggcgtcaccatcgacgtgctgattgagcgccgtttcactaacctggtgaaaaaaggcagccgcttctggaacgtctccggcgtgaaggcggacgtgggcctgagcggtgcgaaggtggagctggaaagcctcgcctcgctggtgaatggcgccatcgcttttgactcgccggacagctccaaacccgcagagccggacgatgaatttggtctgtacgaagatttagcccacagccagcgcggcgtgctgatcaaactcgatttgccgggcggccaggggctgaaagagaactctacgccgctgatgtatcaggggctggaagtgggcgagctgaccaaaattaaccttaatccaggcggcggcgtcaccggcgaaatgacggtggatccgagcgtggtcaatctgctgcgtgacaatacgcgcattgagatgcgcagcccgaaaatttccctgaacgataccagtctcagttcgctgttaaccggcaatacgctggagctggtgccgggcgaaggcgagccgcgggatcactttgtggtattgcccgccgataaaaccctgttgcaggagccgggcgtgatcaccaccaccctgaccgcgccggaaagttacggcatcgatgccggtcagccggtgatcctgcacggtgtgcaggtgggtcaggtactggagcgtaatctgacggcgaaaggcgtgaccttcgcggtggcgctggatccgcagtatcgcgatctgctgcatggcgacagcaaatttgtggtcaacagccgggtggacgtgaagctcggtctggacggcgtggagtttctcgccgccagcgccagcgagtggatcagcggcgggatccgcatcctgccgggcaataaaggcgagatgaaatccacctatccgctgtttgctaacctcgacaaggcgctggaaaacagcctcggcgatctgcccaccaccacgctgacgctctccgccgaaaccctgccggacgtacaggcgggatcggtggtgctgtatcgtaagtttgaggtgggtgaagtcatcaccgtgacgccgcgcgccaatgccttcgacatttcgctgcatattaagccggaataccgctcgctgttgaccagcaacagcgtgttctgggcggaaggcggcgcgaaagtacagctcaacggcagcggactgacggtacaggcctcgccgctgtcccgcgcgctgaaaggcgccatcagcttcgataacctgccgggcgctggcgcgtctacgcgtaaaggcgacaagcgggtactcttcccgtcagaaaccgccgcccgcgccgtcggtgggcagatcaccctgcacgcgtttgatgccggaaaactgtccgccgggatgccgatcaaatacctcggcattgatattggccaggtgcaggatctgaagctcatcaccgaacgcaacgaagtgcaggcaaaagcggtgctttatccggaatatgtgcagacctttgcccgcaccgggacacgcttctcggtgatcacgccgcagatttccgcggcgggcgtggagcatcttgataccattctgcagccttatatcaacgtcgagccgggacgcggcaacgcacgccgcgacttcgagttacaggaagcgactatcgccgactcccgttatctggacgggctgagtatcgtggtggaagtgccggaagcaggcgggctgaatatcggtacgccggtgctgttccgtggcatggaagtgggtacggtcaccggcctgacgctgggcacgctgtcagatcgcgtgatggtcggcctgcggatcagtaagcgctatgaacatctggtgcggaataactcggtattctggctggcttccggctattcactggactttggcctgaccggtggcgtggtgaaaaccggcaccttcaaccagtttattcgcggtggtattgccttcgccaccccgccgggcacgccgctggcaccgaaagcgcaggtcggtaaacacttcctgttacaggacagtgaaccgaaagagtggcgtcagtggggcaccgccctgccgcgttaaccaaccggggctccggcgtgtctgcgccggggcctttatgctacactgcgcgcctgtttttttgctggtgatacgcgagtggcacacaattctgtttatcttcccgatgcttttcttacgcaaatgcgccaggccatgccgtcgcatctctcctttgacgactttattgccgcctgccagcgcccgttgcgccgcagcattcgcgtcaacaccctgaagatcagcgtggaagattttctcacgctggtggcgccctatgactggcatctgacgccggtgccctggtgtggcgaaggtttctggatcgagcgtgaagatgaagataccgtgccgctcggcagtaccgccgagcacctgagcggcctgttttatattcaggaagccagttccatgctgccggtcgccgcgctctttgccggggatgaacagccgttacgggtaatggatgtggccgccgccccgggatccaaaaccacgcaaatcgccgcccgtatgcagaatcgcggggcgatcctcgccaatgaattttctgccagccgcgtaaaagtgctgcacgccaatatcagccgctgcggtattcataacgtcgccctcacccatttcgacggacgggtgtttggcgcagcgctgccggaagcctttgacgccattctgctggacgctccctgctccggcgaaggcgtggtgcgtaaagatcccgatgcgctgaaaaactggtcggtggcgagcaatctggaaatcgctgccacccagcgcgaacttattgacagcgcttttcacgccttgcggcccggcgggacgctggtctattccacctgcacgcttaacctggacgagaacgaagccatctgccactggctgcaggcgcaatatcctgacgccgtggaatttgaatcgctgacaagtctgtttccggatgccggcgccgcgcttaccgcagagggtttcctgcatgttttcccgcagatttacgactgcgaaggctttttcgtcgcgcgactgcgtaaaaccgcctccgtggcccctttaccggccccgacctacaaagtgggtaattttcccttcgcgccgatgaaaacccgtgaaagcgcaaacgtgatacatgcggcggccagtgtcgggctgcgctgggacgagcagttgcggctgtggcaacgggacaaagaaatctggttattcccggcggccatcgaaccaatgatcggtaaagtgcgcttctcccgtctgggcatcaaatttgccgaggtgcataacaaaggtttccgctggcagcacgaagccattatcgcgctggccggcactgcaaatccgctggcctttgagctgacccatcaggaagccgaagagtggtatcgcgggcgtgacgtttatccgcaaaccacgcccccgcaggacgacgtgattgtcactttccaggggcaaccattggggctggcgaaaaaaatcggctcgcggctgaaaaacagttatccacgtgaactggtgcgggacgggcgtttatttgcggccagagactgacggcttaaaaaaataagcacattctgactggcgtattccgcttaagtgaaccaggctaaaaaatgggtgactttactggtcgtaccactatagcaacttaacggagagcattatgacgaaaaccagcgtgcgtattggcacctttgaaatcgatgatgctgagctgcaaggcgaacagcagggtgaacgaacattgcgtattccatgcagttccgatccggatttatgtatgcaactggatgcctgggatgcggataccagcattccggcgctgcttaatggtgagcactcagtgttgtaccgcgaacattatgatgagcagtctgatacctggattatgcgtcttgcctgatccgaagaacccgtcttccggacgggttatttactccacgaatttcccccgctctgtttcatcccctacacttaccctacgttagcccgatctgaggatggaatgttcgcactggtattatttgtttgttacctggatggtgggtgtgatgacattgtgattgatgtctataacactgaacaacagtgcctggtggccatggatgagcaacgtttgcggcacggcggctgctacccggtagaagattttatcgatggcttctggcgtccggctcaggagtacagtgatttctgatgacctttgtcatatattgcgctgcgggtgctccgcagacgcaataataccctcgcccgcgtccctgtttattgcccttccggtctttttatttaaatcagattaacctcaatcaatcctaaacaaagcggaaataaaactcccgcagccattaacatatttttgtcaggcctccagaatagtcggaaattagagaggtcattattgtgacaaacactaccctgcaaattgatgcgccctcatcgccgcatccacaccttatttccgacctgatccatggccgtctgacgcccggaccgatctggcaaaagcgcgattatcgcgttaaatttctcctgcgctcgctgctcttctggccgtcgaccgttaaaatgctgaacagcctgtccagccgtccgggtttcgaccgcctgctcagcgcccaaatcacgctgcccagtaaatcgcaccgccagtatttgatgcgggggctgcgtgccggacagcgcgccgacgctatcatcagccactatgactttatcgacagtcttacctcagcaccgcttgcggaggcgctgaccgctgccgcgccggtacctctactggaatttaccggcaaagacgatgcgccttttaccgtctacgcctcctgcgccagcaaagccgagcgtgaaggtgaaagcaccctgtggctgtatggcgcagataatacgctgctggcaagcgccactttcagcgtggtgacggaaaagggagcgcgcgcgctgatggtgggaggattacagggaccgcgccgctcggtttctcacgacgtcattaaacagtccacccgcgcctgctacggtatctttccgaaacgtatgctgatggaaatattctggcaactggcggcgcttaccggcattacggcggtctatggcgtcagcgataaaggccatgtgttccgtgccctgcgctatcgtttcagtaagggccggcattttcatgccagctacgatgaattctgggcctccgtggatggcacgcctgacaatgcctggcgctggaagttgccgttacagcttgagcgtaaatcccttgaaagcattgccagcaagaaacgcgctgagtatcgccgccgctttgcgctgatggatgatgttcaggcccgtctgcgggcgctgtttgattaatcatcacccgccgggcagcgtctggcggggtggcgggctctctgttattgtcttaaggccaggaacacttaagacaaggtagcggtatgcaaaagtttgatgaattgtggaatgccatagccacgcgggtgcgtgaaaacaacgacattccctttgcggaaatggaaaacgaagagagtcccctggggaatgccacccgacagcgtatcgcgcaaatatttattctggaagtgctgctcgccaggcatcgtgataaatacgccagcatgtttgttccgctatccggcgaagaagcgctttatcacctgattttcaagcgcaccggctggaagcctttcgagattaagcagctttccttcaatgatgccatgtttgtgatggctgaattattccgtgaagaaaacctgcccgtcgaggcgcgtgaaatgctgctcgcccagggtgtgcgtgacaccgctttcccggtttttgatttctcagaaaaagactggtcgccgcgcgaaaacgccctctttctgcaacgctgatattccccttcccgcggtgccgcggggagtggtagtttttttaaacctcgattttttgcattattttttcgcgatcaacataaatacagcgattacgaccggtttccttgccgtggtataacgccttgtcggttctttccagcacttcgcgtaatacttcatcttcatcgatacgggttaacccggcggtaaaggtgatcttaatttcatgcccggccacaagcattaatgttctggcaatcaggttgcggatccgttcggcagcaatgcaggcttctttttttgtggcggcatgcaacacaataataaactcctcaccgccatagcgatatacggtctcacactttctgacattatcttccagcgtcagcgccagacagcgtaataccccatctcccaccagatgcccgtagttatcatttatttttttgaagtgatcgatgtccaccagtaataaatacaatccctgttgactgtattgatcgaccatcccgctaaaagaatcatccagcgtgcgtcgtaaaggtaaaccggtgagcgtgtcgtaactgctgcgcaactgtaaaagatgggttttatagtcggtcaccgaggcattgaaggcaatgagcgcattttcaaagctatcaaaacgcgcgtcgctcacttcacccttgcgcaccgcctccaccagcgcccggcaggtgatatgaatgtcgtggtgcctgcggtggatgtcctgaagaaaactgccgtcattgcgctcttctgtcagccgctcgtcgatccactgaccaaattcgcaaattttatgggcgtcgtcataagtcagctcaggcatcagcgccgatttattcgcgataaaatggagtacttttaccagccatttaaaatgggcttcggatgaattattgagcccaagaatagttgaatcaatataactgtgttttttgttcatacatataaccttcgtgaatattttagcgcaaaataaatatttaaatagcctaatacgatactacactttaattagttttatttaaccttcacgtgcccgctaatatcagcatgagggcgaacccacaaagtgcggacaaaaagcgtcgaaaaggggttggatacactccaaaaaacgtttaccttgtaacctgagtcaggcaaaaggcgcgggatcggcacctgctggctaagttgttgatggaaaacagaataaaaaaagaccgaatacgattcctgtattcggtccagggaaatggctcttgggagagagccgtgcgctaaaagttggcattaatgcaggcaaactacgcctggcactttaagaatagatgacagcgccagcttttccagtctgccgcaggagtggtctggaaaatccggttaaggtcgcagccgaaaagcaaaaaaccgcagcacttcagtatgagggctgcggtttttttattggaaatcagaaagatatttttggtatttagcagagcttttcagcacgctcgataaacggagcgaggctcattttttcaccgcttttgtgcggattatcgacctggatcacactgatggacgtaccctgcgcctgaccgctgtcgacctgcttttgtgccgcctcgttcagcggatactgcaccagcgtcgacggattaatcgcaaagagcgcatgtcccggacggcaggttaacatcacctcctcgcggttaaaggcccagttatcttttccgacttcaaaacggcttaccgtgatcactttcggggctgccagcgcggcggcggaacaggtaagtaacagcagggagagaatacttttcttcattgtcttcgccagttattcagaaaggttcaagcgttgcgaacaggctaaccagggccagcaccagtgtacccaggatcacttcggcctgcgtcatgcgaataaagtgtgtttgcgcctgacgaccatgggtgcgaaagcgcggcaccagaacataacgattcacgaccgcaattaccagcatcagcagcaccagcgcacatttgcacaaaagcaggcgaccataatcgctctgccagggtagcgcaacgccctggatcaacagcgcattaataatacccgtcaggaataccagcgccaccgccagatgcgtggcgcgggaaaaacgcatcagcgtagtgattgccgcttcgcgcctgtgacctccggcttgtcgggtgcaaaaaatcaccggcaggagaccgccaaaccatgcggttgcgcagatcagatgcagggcgtgattcaggcgctgcaacaggccgggcagcccgtcatgcatcgccgcatgaccgaccatggcctgtaacatgagctgcgcgaggagcaacgcaaacaggcgcccctgacagcgtggctgcaccatcaccataaccagcgtgatgagcgccagcagcatctgccacagccagacgctgccaaattgcgtctgcgccaccgccagccagatatcagggtgaagcgtatctgcaaagccattgcccatcattccgccctgtacggcaaacatcagcagcgcgctgccagcgcacagggtcaggcagaggcgctgtatacgtttaaagcggcggatgatcaccggttgcatatctgccggcgccagcacggcgctgaaccaggcgctacctgtcgccagtatcagggtggcgaaatggataaaccgcaacgtgatatagagaaaggccagcatcggttatctgacgctgaagtgataattacctgtggttttgtgtccatcgaccgacacaacgtgccagtctacggtatactctcccggcgtcagcgcctgctcaatgggcacaatcaactgcgttttgtcgttctcattacgtttcaccgggccggttttcacgtcctgctgtttgctgccggtaattttcacgccgctgaattttggctcaatcccttccgagaaattgagcgtcagcgcctggggtgctgcatcgaccttcgcatctgctgccggatactgatgtttcagatgggcatgcgcaaaaacagcaggcgttgcgagcattccgcctgcaagcagcaaggcagaacagagacgggataccatgaaagtcatttattccattcctttttgttatatctcagtaatgagaataaccccgatgaatgtatgagtcgagtctgccggcagtcgggcttgcctttccggggcaggcttagtaagttttgcgccgaacactcaggagaagtttatgaacaaaaatctcgctacccttcctcaggatgagatggacaaagtgaatgtcgatctggcggcggctggtgtagcctttaaggagcgctataacatgccggtgatcgcggaagccgtagagcgtgagcagcccgcgcatctgcgtgactggttcagggagcgcctgattgcccatcgtctggcctcggtgtcgctctcgcgcctgccgtatgagccgaaaatgaaataaatttgcaccacctgctaagggaaacccacatgttacgcgtgatagacaccgaaacctgcgatttgcagggcggcatcgtagaaattgcttccgtcgatattattgacggccagatagtgaatccgatgagccatctggtgcgcccggatcgccctatcagtccgcaggcaatggctatccaccgtatcacggaagcgatggtggcggatcagccatggatcgaagaggttattccccattatatgggcagtgaatggtatgtcgcccacaacgccagctttgaccggcgcgtgctgccggaaatgcccggcgagtggatctgcaccatgaagctggcgcgtcggctgtggcctgggatcaaatacagcaatatggcgctgtataaatcccgtaaactgaatgtccagaccccggccgggctgcatcatcaccgggcgctgtatgactgctacattaccgccgcgctgctgattgatattatgaatacttcaggctggacgccggaccagatggcgaccattaccggccgccctgccctgatgaccacttttaccttcggcaaatatcgcggtaaagcggtgtcggaagtggccgaacgcgatccgggctacctgcgctggctgtttaataacctggatcgtatgagtccggagctgcgcctgacccttaagcactaccttaacgattagtagcctgacgtcccggtaacgtgccctgcgcaaggccaatgagaaacgcatattccagcgccaccccttcataggatttgaagcggcccgatttcccgccgtgcccggaatccatatcggtgcacagtaacagcaggttgtcgtcggttttcatttcacgcagcctggcgacccatttcgccggctcccagtactgcacctgtgaatcgtgcagcccggtggtcaccagcagatgcggataggcctgccgctggatattgtcgtaggggctgtagctcttcatataagcgtaatattccggatcctgcgggttgccccactcctcaaactcaccggtggtgagcggaatggattcgtccagcatggtggtcaccacatccacaaagggtacctgggctatcacaccgtggaacagatccggccgctggttaatcgccacccccattaacatgccgcccgcgctgccgcccatgccatagcaatagtgcggcgagccgtagccctgcgcgataagcgcgtcgcagacgtcgatataatcgttgaaggtgtttttcttgcgcaggaatttgccgtcctcataccaggactgtcccagttcgccgccgccgcgcacatgggcgatggcgtaaacaaagccgcgatccagcaagctgatacggctgctgctgaaatcggcatccatactggatccgtaggagccgtaaccataaatcaggatcgggttttcccctttacggaaatgtttgcggtggtataccagcgataccggcacttccacgccatcccgtgctttgatccacagatgttcactgcggtagtcgctggcctcgaaaccctgcacttccgtctgcttaagcacgcggcgctcgccggtatccatatccagttcaaacagcgtatcgggcgtggtcagcgacgaatagccatagcgcaggcgcgacgtttccggctcaggattatacgcaagccaggtgacataggcgggatcgtcaaaggcaatgccggtgacttcacgggttttgcggttgatctgtcgcagactggtcaatccgcgctggcgctcttccaccaccagccagtcggtaaagagcgtaaagccttccagcataatggcgtcccgcggcgggatcagcacttcccatttcgcctcgctgcgcactttggtgcggtaaaggccaaagtttttgccttcgcggttagagcgcaggtaaaaggtatgctgataatgatcaagattgtactcatgatctttacgcctgggcaaaaagcgcagcggctgggcgtccggcagctctgcatccagcagtaacgactcgctggtggtggcgctggaaagcgaaatcaccacgtagtgctgtgaagtggttttgtgcaggctgacgtaaaaggtctcgtcctgctcttcataaaccagttcatcctgacagacaggcgagccgacggtatgacgccagacctgatacggcagcaacgtcgtcgcgtgtttgcgcacgtagtacagcgtttcagagtcattaacccacacaaagtccggcgtgacgttggccagcatctccggataccagttgccggtttgcagattacgaaagcgaataccgtactggcgacgcgacagataatcttccgccagcgccataatattattgtccggcgagatcgccagtccgccaagggtgtagaactcgctgtgcgcggcgcgtttgttggcatcaagcagcacctgccactcatcccattcggaactgagcaccgactggcgctgatagatagcgtattcacagcccggctcatagatatgccggtaacggtagccgttgcgggtataaggcgcagatacttcgcgctgggggatacgcccaacgatttcagccagcagacgctcttccagcgcctgctgcgatgccatgacctcgcggccatagtcattttcctgatgcaggtaatccagcacttccggctgcgagcgcgagtcgtcccgcagccagtagtagtcgtcgatgcgtgtgtcgccatgcgtggtgatggcgtgaggaatttttctggcttttggtggcatagcgtctgtcttttgcagtttacaccctataagggtggcaaaagacacgcatgttgcaagcgcagcgtgccaccagggcgcagatgattagccgggaagcgccagcttttgctgtttgagatcctgttcaataccctcgcgtacatcctgcgggatcttcagggcatcccccagtgcattcagatagctgcgctccataaagtggtcgacatcaatggccgcacagctcaggaaataaatttccagcgcttcttcttcgtttttgatgccgcgcgccagacgttcaggatccagcggctgttcgatggcctgggtgaccagcgctctgccctgctcttcgacgcccgcttcgcgcatctgggcgtcgatggcggcacgttctttgtcgtcgatatgtccgtcgcttttagcagcgaagaccagcgcaaggatcagacgttcagtacgcacgtccagcggtgagctttgcacgccatactgcggctcatcctgatgggcggcgcgcaccttgtctttgtatttgttccacagcacgctaccggcgacggcaccgccgcccaccagcagcgcgctggtaccgtatttggttaacagcttgcgggacgatttgctggcaaccagcagccccgccagaccgcccagcgcgccaggcagcattttgctgaaaccctgatcgcccgacgacgttgccgatgcgcctttttgcttcagcagcgactgtaattgatccatccagttagccatgattcccctcaaatagctgatgacagttgccacagcgtaagcgaggggatgtcaggaaacgtctgtatcagcaaaagatgcgcaaattcacgggcgttactgcgcctgataatccgcccgcccggctttgcagtcgaccttcacccgatagtggatatcggtatttttaccgcgcacggtcaggggcacgttccagttatcgtccttaccggaaatctctttgacgttaatccacgccaccggatccgcctgaccgagtatttcctgatcgtccgcccagcgtgctatgcgattttgcagataatcacgcttcaccgcggcggcgatgccgtcttctttcagcccttcgcaacccggaaacttcaccgacttttcattggctgcctgcgccgccatgctgcccgccagcaacaccagaccaaatactacccctgctgttttcatgcttttctcctgtgagctaacccactcaaagcatggtacaaattgccggcagcgcaaggacggatcaggcggctttggtgcgcttcggcgtcggaatatcggtcacgttgacgtcagacggcgcgtcgtcggtttgtaacttaccggatttgatgatggtattgagcgtatctttctgctccgccatccacatcgccatttgctcgcgctgtgcctcatccagggctaccggcccctgcgccagccagctctccagcacttccgccagatcgagcattttgtcataagcatcggcttcctttttgctggcaaaagacattttttcctcaccttcacgaatgactacgtatttaacttcaaccgccatgatgcagcctcacattactggttatttatacagtatatgataactgaacgcccggcttaaggcaagccgggacggaaggaaaggtcagaacaggatcgtcaggccagggtggcgttatcaatcacaaagcggtaatgcacatcacctttaagcatgcgctcgtaggcctcgttgatctcttcggcgcggatcatttccacatcggcgacaatcccgtgttccgcacagaaatcgagcatctcctgggtttccggaatgccgccaatcatcgatccggcaatggcccggcgcttcgtgatgaggttgaacacttccggcggagcgtgcggcgtggcgggcgcgcccaccagcgtcatggtgccgtcgcgtttgagcagcgtgataaatgcgtcgaggttgtgcggtgccgccacggtattaaggataaagtcgaagcttttaagatgcgcttccatttcgctggcgttacgtgacaccactacttcatcggcgcccagcgattttgccgcctcgcgcttggattcggaggtggtaaaggccaccacatgcgcgcccatcgcgtgggccagttttatgcccatatgtcccaggccgccgatgcccacgacgccaacctttttaccggggcccgcctgccagtgacgcaacggcgaatacgtggtgatcccggcgcacagcagcggcgccaccgcagccagttgatcttccggatgggtgatgcgcaggacgtagcgctcatgcaccacaatctgctgagagtaaccgcccagcgtgtggcccggcgcgtcctgggttggtccgttgtaggtgccgaccatgccgtcgcagtagttctccagcccctcctcgcaatcttcgcactgcttacagctgtcgacaatacagccgacgcccaccagatcccccgctttaaaagcagagacatgctcgcccacggcggtcacacgcccgacaatttcatgccccggcacgcagggatattgcgtccctgcccattcggagcgcacctggtgaatatcggagtggcagacgccgcaaaaagcgatatcgattttaacgtcatgggcgccaggctgacggcgggtaatttccattggttcaagaggctgcgtgccggtatgggcaccataagctttgacagtcatggtagaactccaggttataaagggctcaggcagagggttctgcacgtgaggtcaggaaaatcggtcaaataaactctcctgattgtagatgcgagtgtgtcagatagcaggttaattgcctgtgtactgctcgtcgctgaccttttccatccactccacaaccttgccgtcttccgcttcggcaatcgcgatgtgggacatactgttttccggcgcggccccatgccagtgcttcacccctgccgggatccagacaatatcgccgctacgtatctcacgctgcggaccgccccactcctgcacccgtccggcaccggcgataacaatcagcgtctgtccgagaggatgagtatgccatgctgtgcgggctgaaggttcaaaggtcactgtggcaccgcctgatttcgcaggctcagtgccctgaaacggcgcatcaatacgaacgttgccggtgaaatactcggccgggccttttacggagggactggtagtcggggttaagatcgtgatcatggtgttctccttaaaataacggggagtgaaaagtgtaagttgcctgcgattgattgataagatatgcaaatcagaatgctcatgtgcatggtatgcaacaatgtcgacagaaaatctcaacgatctgcgcgcgtttgcgcgggtggctcaggagaaaagctttacccgggcggcggcgcagctgggtatgtcgcgctcaggactgagccacgcgataaccgcgctggaagaacggctgggggtccggttacttatgcgcaccacacgtagcgtgtcgctgacggaagcaggccagcggcttatcaatacgcttgggccaatgcttgatgatcttgaacaggaacttaaagccctgcgctcattcagcatcagtcccgctggtacggttcgcatcaccgcccacgatcacgccattgcatctgctatctggccacgtttaacgccgttgctggtgaagaatcctgagattaccctggagctaagcgtggattatgggctgacggacattgttgcccagcagtttgacgccggggtccgggtgggcaatatcgtggataaagacatgattgcggttcgtatcggaccggatttccggatggcggtggtggcggcccccgcattccttcagggcaaaacgttgccgctcactcccggggaattaacatcctacgcgtgcatcaatcttcgcctgccgacacacggggggctgtatgcctgggactttgaaaaagcaggcaaatccctgtcagtacgcgtcacaggacaggcagtcttcaataatacctacctgatgttgcagggtgccattgacgggctgggtttcgcctatgtcccccgtgatcttgcccttccgcatatcgaggagcaacggctgatcccggtactggaagactggtgtcctcttttaccgggttatcatctctactacaccagccgccgtcaggtggcacccgccctgcagtgcgttatcaatgcgctacgctaccagtcttaacagacgcaaacgttttcgtttatactgctgccaacttttttcaagggcaggttgttatgactttattaggtactgcgctgcgtcccgcagccacacgcgtgatgttattaggctccggtgaactgggtaaagaggtggcaatcgagtgccagcggctgggtgtggaagtgatcgccgttgatcgctatgccgacgcgcctgccatgcacgtcgctcatcgcgcccacgtgatcaatatgctggatggcgaggcgttgaaagcgctggtcgcgcaggaacaaccgcactttatcgtgccggaaatcgaagccatcgccacggatatgctggtggcgctggaagcccaggggcagcgcgtggtgccctgcgcccgcgccgcgcagttaaccatggatcgcgaaggcattcgtcggctggcggccgaggaattaaagctgccgacctcccgctaccgctttgccgataacgaagcggcgttcagggaggcggtgaatgagatcggtctgccgtgcatcattaaaccggtgatgagttcatccggcaaaggccagagcctgatccgccatgccgatcagctggccgatgcctggcgttatgcgcagctgggcggccgtgccggcgcgggccgggtgattgtcgaaggggtggtgaattttgattttgaaattaccctgctgaccatcagcgccgttgacggcgtacatttttgcgcgccgattggccatcgtcaggaagacggcgattatcgcgaatcctggcagccgcagcagatgagcgcactggcgcagcagcgtgccgaagcggtggcccgcgaggtggtgctggcgctgggtggccacgggctgtttggcgttgagctgtttgtgtgtggcgatgaggtgattttcagtgaggtgtcgccgcgtccgcacgataccggtatggtgacgctgatttcgcaggatctttccgagttcgccctgcatgtgcgcgcgtttcttggtttaccggtcggcggtattcgtcagtatggcccgtcagcgtccgctgttattctccccacacttaccagccagaatgtgacctttgataacgtcgatgccgccactggcgctgggctacaggtgcgtttatttggcaaaccggaaattgacggttcgcgtcgtctgggtgtggtattagcgacggcagaaaatgttgatgatgcggtggcgcgtgccaggacagcagcagccagtgtgatggtaaaaggataaagcgcccacatgcccggcagcttgcgccgccgggcatgacgtcagattactgcttcgcgccttcaacggcttcgcgggccagtctggtgatacggtcgtaatcaccggcttccagcgcatcggccggcaccagccaggatccaccgatgcagagcacgcttttcagcgccaggtagtcacggtagttagctggtgagataccgccggtcgggcagaaacgcacctgcgagaacggacctgcaatggcctgcagcgctttggtgccgccgttggcttccgccgggaagaatttgaactctttcagtccatagtccatacccagcatcagttcggaaacggtgctgatgccagggatcagcggaatggtgccttcggttgccgctttcagcagcggctccgtcagacccgggctgatggcaaactgggcgcccgcttcagtgacttccgccagctgtgccggattcagtacggtgcctgcgccgatgatagcgtccggcacttcttttgcgatggcgcggatagcatccatggcgcactcggtgcgcagggtgacttccagcacgcgtacgccgccagccaccagggctttcgccataggtacagcgtgttccagtttgttaatcacgatcaccggcacaaccgggccagttttcaggattgcttctgcactcgttttccagtttttcatcagagttttttctctcgccagatctacaatttttaagtcttagaaagtgatacaggtcgcgccctgctccgcaccggagagattctcgcgcaatgcgctgaacatctcgcgccctgttcccacgcgcgacgcgctgaggtcaggaatgtgtggctgacgtgcggccagttcggtttcatccaccagcagggttaattcccctgtctgtccattcacgcggatgatgtcgccatcacgtacttttgccagcaatccgccatcgtaggcttccggggtgacatgaattgctgacggcactttacctgatgcaccagagagccgtccatcagtaactaatgcaattttgaaacggcggtccaataatacaccaagtggcggcatcagtttatgtaattctggcatcccgttcgcttttggcccctgatgacggacaacaaccacgcagtcacgatccagaagacccgcgtcaaaggcaggtaagacgtcgtgctggctttcaaataccacggccggggcttcgatgatctggttttccaccggcacggcggacgtcttcatcaccgcgcgtccaaggttgccgctcagcactttggtgccgccatggtgagagaaaggtttgtcgatggtggcgatcacattctcatccagtgagctgtcagccccgtcgcgccagtccagctcgccattgttcagccatggctccagggtgtaacgggaaagcccgaaaccggcgacggtgttcacgtcttcatgcagcagaccgcctttcagcaattcacgcatcagcagcggcacgccgcccgccgcctggaagtggttaatatccgccgggccattcgggtagagacgggtcatcagcggcacgatgtcagagagatcggagaagtcatcccagttgatgataatgccggccgcccgcgccatcgccaccagatgcatggtgtggttggtggagccgccggttgccagtaacgcaataatgccgttgacgacgactttctcgtcgagcattttgccgagcggcatccattcgttgccgttgccggtcagacgcgtcacctgacgcgccgcagcggcggtcagggcttcacgcagcggcgcgtccgggtgcacgaacgaggagccgggcagttgcatacccataaattccaccaccatctgattggtgttggcagtgccgtaaaaggtacaggtacctggcgcatggtaggacgcggcttcggactccagcagcgccatgcgatccactttgccttccgcatacagctggcggatgcgaaccttttctttatttggcaggccgctggccatcgggcctgagggcacaaagattgccggaagatggccgaacgacagcgccgccatgacaaggccggggacgatcttatcgcacacgcccaggtagagcgcgccatcaaacatattatgcgacagccccaccgccgccgacatggcgatcacttcgcggctcagcagcgacagttccatgccgtcctgcccctgggtgacaccgtcacacatggccgggacaccgcccgccacctggccgacggcgtttgcctcatgcagcgctttacgaataatgtccggatatttttcataaggctgatgggcggacagcatgtcgttataggaggtaataatcgcgatgttattgcgcagcatgcttttcagcgacgctttgtcatccggctggcaggcggcaaaaccgtgcgccaggttgccacaggccagtgatgaacggtgcaccgtttcgcttttcgccttctcaatacgggcaaggtagtcagcgcgcgtctcgcgggaacgttcgataattcgttctgttacccgtaacatttttgcattcatagaagctcctgaaattatctgtcatgggcgggggtaaacattcgacatgttccggcattaaacctgcggtacgccgtcgcccggtggcaaaatcgcttcagccagtgtaataaaaaaagccccgtgggtgaatccacacggggcttaaaagctgaaatattactcaggagtctgagtcagatcatgttaccggtaaaataagagccttccggttactcaaactcattccatgaacgaccatcacgggtgatcatcgcaactgaagccaccggcccccaggtgcctgcctgatacggcttaggcgcatcgttgtccatcgcccaggcttcagtgatggagtccacccacttccaggcttcttccacttcatcacgacgcacgaacagcgcctggatgccacgcatggtttccagcagcagacgttcgtaggcatcggcaagatgcgtctggttaaaggtttcggagtagctcagatcaagtttggtggtttgcagattatgcttgtgatccagacccggcactttgttgaggatctgaatatccacaccttcgtccggttgcagacgaatggtcagcttgttctgcggcagatcctgccaggagtctttaaacaggttcagttgtggcgtggtgaaatagaccaccacttcagagcacttcgccggcaaacgcttaccggtgcgcaggtagaacggcacgcccgcccagcgccagtcgtcgatatccacgcggatcgccacgaaggtttcggtgttactggatttgttcgcgccctcttcttccagatagcccggcacttttttgccctgagcgaaaccggcggtgtactggccgcgcacggttttttcacgcacgttggagcgatcgatacggcgcagggatttcagcactttcacttttgcgtcgcggatgctgtccgcagacagatcagacggcggagacatggcgatcatgcagagaatttgcagcaggtggttctggatcatgtcgcgcatctgaccggcctgatcgaagtaaccccagcggccttcgatacccacttcctcggccacggtaatttccacgtgatcgatggtgcggttatcccagttgttcacaaacagcgagttggcaaaacgcagcgccagcaggttaagcaccgtctctttaccaaggtagtggtcgatacggtatacctggcactcttcaaaatactcgcccacctggtcattgatttcgcgggaggtttccagcgacgtacccagcggtttttccattaccacgcgcgccggtttggcgttcagcttcgcttcaccaaggcctttgcaaatcgcgccgaaggtgcttggcggcatagcgaaatagttgatggtaacgcggttttcctgatccagcatctcgccgagacgcttaaaggatttagtgtcattgacatccagattgcagaaatcgaggcgtccgctcagcgtgtcccacaaactttcatcgatcttctctttcatgaaagtttccagcgcttcgcgcaccactttggtgtacgccgctttgtcccagtcggcacgcccgacgcccaggatccgcgtttcaggatggatctgacccgctttttccagttgatacagggaaggcagcaatttccggcgtgcgaggtcgcctttcgcgccgaaaatgaccaggtcacatgcctgggctgtttgcgttaccgccatgtcattctcctcagttagctatcctggtgcttctgccaggccttagttgtaattttattacagtgcactgtactgcttttacgtgattaccgaaaccgttaacgttttgccgcttgtgcgctaaagacatcagggcgtacgtacaggccaattgccctgaaatatcagggtttttgcacggggtcggtgtcactaaaatccgaccctgatcatgtaatgaaaaaaaacaacaacttttcgggttgttatttacccataatcacgtcacaagagtaatatcgagttacacgcaccgcggtttcatccatttctggaatcgattttacccaagagcgccctgttaaacatgaatatgctggaaaagatccagtctcaactggaacaccttagcaaatccgaacgcaaagtggcggaagtgatcctcgcctcccccgatcaggctatccattccagtatcgctgcccttgcccagcaggcctccgtcagcgaacctaccgttaaccggttctgccgtagcctggatacccgcggctttcccgattttaagctacatctggcacaaagtctggcaaatggtacaccttatgtgaaccgtaatgtggacgaagacgacagcgtggaagcctataccggtaagattttcgaatcggcgatggcgacgctggatcatgtgcggcagtcccttgatatggcggcggttaaccgggcggtggatttgctcacccaggcgaaaaaaatcgccttcttcggccttggctcgtccgctgccgtagcccatgacgcgatgaataagttttttcgcttcaatgtgccggtggtgtataccgacgatatcgttttgcaacgcatgagctgtatgaattgtagtgaagacgatgtggtggtgctcatctcccacaccgggcgcaccaaaagtctggtggagctggcacagttagcgcgcgaaaacgacgccatggtcattgccattacttctgccggtacgccgctggcgcgggaagccacgctctccattacgcttgacgtgccggaagataccgatatttacatgccgatggtgtcgcggctggcgcagctgacggtcattgatgtgctggcaacgggctttaccctgcgtcgtggggcaaaattcagagataacttgaagcgagtcaaggaagcgctgaaagaatcgcgctttgataaggaactcctcgtcagaggggaaaacattaaaagttgataacaaagttgtaacttattacgccattcggttaagttcatagcggcccacagaggcgcacgatgtcaccgaatttttaattcacgcaacaccggttgtttcagtcaacggagtaatacatgtccagaaggcttcgcagaaccaaaatcgttaccaccctgggtccggccaccgatcgcgataataaccttgagaaaattatcgccgcgggcgccaacgtggtgcgcatgaacttctcacacggcacggcagaagatcataaattgcgtgccgataaagtgcgcgagattgcggcaaaactgggacgtcatgttgctattcttggcgatttgcagggtccaaaaatccgtgtttccaccttcaaagaaggcaaagttttcctcaacatcggcgataagtttctgcttgacgccaacctcggcaaaggcgaaggcgataaagagcgcgtcggtatcgactataaaggcttacccgctgatgtggtgccgggcgacattctgctgctcgacgacggtcgcgtgcagttaaaagtgctcgaagttcagggcatgaaagtgttcaccgaagtgaccgtgggcggaccgctgtcgaacaataaaggcatcaataaactgggcggcggcttgtctgcggaagccctgaccgacaaagataaagccgacatcctgaccgccgcgcaaatcggcgtcgactacctggccgtctccttcccgcgctgcggcgaagatctgaactatgcccgtcgcctcgcccgtgacgcgggctgcgacgccaaaatcgtcgccaaagtggaacgtgccgaagcggtatgcagccaggacgcgatggatgatgtgatcctggcctccgacgtggtgatggttgcccgtggcgatctgggcgttgaaatcggcgacccggaactggtaggcattcagaaagcgttgatccgtcgcgcccgtcagctgaaccgcgcggtgatcaccgccacccagatgatggaatcgatgatcaccaacccgatgccgacccgtgcggaagtgatggacgtggcgaacgccgttctggatggtacggatgcggtgatgctgtcagcggaaacggcggccggtcagtatccggcggaaaccgtggcggcgatggcccgcgtgtgcctgggggcggagaagatcccaagcattaacgtttccaagcatcgcctggatattcagtttgataacgttgaagaagcgattgccatgtcggcgatgtacgccgcgaaccacctgaaaggcgtgacggctatcatttccatgaccgaatcgggccgtacggcgttaatgacgtcacgtatatcttccgggctgccgatcttcgctatgtcccgtcatgagcgtacgctgaacctgaccgccctgtaccgtggcgtgacgccggtgtacttcgacagcagcgccgacggcgtggtggcggcgaatgaagccgtgaccctgctgcgcgataaaggctatctggtgtccggcgatctggtgattgtgacgcagggcgatgtgatgggtactgtgggtactaccaataccacccgtattctgaccgtcgaataagtagttgtgcccggcggcgctttgcttgccgggcctacccgcttcgtaggcccgtgcaagcgcagcgccgccgggcatttaaaacggctacttcttcggaaaaagctctttacgcttgtacggctctttttcccctggcctgcgcgttttcaacagcttaaggatccaggtgtactgctccgggtgcggacgtacaaaaacttccacctcttcgttcatacgccgggcaatggtcgtatcgtctgcggtcatcaaatcgtccatcggcggacgcacctgaatggtcagccggtgcgtggcgctgtcatacaccgggaacaatggtacaacgcgcgcacggcatactttcatcaaccgcccaatggcgggcagcgtcgctttataggtggcgaagaaatcgacgaattcgctgtgctctgcgccatgatcctgatcgggcagatagtagccccagtaaccctgacgtactgactggataaagggcttgatgccatcgttacgtgcatgcagccgtccgccaaagcgacgacgcacggtgttccagacgtaatcaaagaccttattcccctgattatggaacatagcggccataggctgcccggttgccgccatcagcatcgccggaatgtccacgccccagccatgcggcacaaggaaaatcactttttcgttgttgcggtgcatctcatcaatgatttcgcggccctgccagtcaatacgcggcaggattttttccggcccgcgcatggcaagctcggccatcagcaccatcgattgcggcgcggtggcgaacatctcatcaataatgtcttcgcgctgcgcgtcgctcagttcaggaaagcagtacagaagattgatctgcgcgcggcggcgggcgcttttgcccatccgtccacccaaacgccccagttttgccagcaagggatcgcgcactgacggcgggatcatcgccacaccggcgaaagccattaccccaagccaggcgccccagtagcgcggatgtaaaaattccctttcgaattcagggaggtattcactgttattttttttcgtttccatgcatcttccagggtctgcggactcgggtaagaaaaagataatgcgtaagtgtagcgaggctgacttatccgcacaaaagaaaaagccgggtatgcactatcacccggcttatttcgtacgttacttaatcgaaccgaagctgcggtataacctctttgacctgcgcgaggtaatcgcgacgatccgaaccagtcagcccttcggtgcgcggcagtttcgccgtcagtgggtttaccgcctgctggttgatccacacttcataatgcagatgcgggccagtggagcggccagtgttgccggagagcgcaatgcggtcgccgcgtttcactttctgcccctctttgaccagcagtttgcgtaaatgcatatagcgggtggtataggtgcgaccgtgacggatggccacgtaatagcctgccgccccgctgcgtttcgccactaccacttcgccgtcgcccacggagagtaccggcgtgccctgcggcatggcgaagtcgacgcctttatgtggcgctacgcgcccggtaaccgggtttaagcgacgcggattgaagtttgaagagacgcggaactgtctcgaggtcgggaaacgcaggaagcccttcgccagcccggtaccgttacggtcatagaatttaccgtcttcagcacgaatggcgtaataatctttcccttctgaacgcaaacgcacgccgagcaactggctctgttcacgcttgccgtccagcatttcgcgggacatgaataccgagaattcatcgcctttcttcagcttacggaaatccatctgccactgcatggctttgatcaccgcgctgatttccgcgctggtcaggccggcatttttggcgctgctgacgaagctgccgcccacggtgccgttaagcgttgagttaacccagtcgcccttctgaatttcggcgctcattttaaagccgttatcagcgcgatcgtaagtacgggtttcgcggcgcgacatttcccaggtcatgcgctgcagttcaccggcatcatttagcgtccaggagatctgctgaccaattttcaggttacgcagatccttatccgccgaggctaactggctgatatcgcccatatcgatgccgtactgattgaggatgctgctcagggtgtcgccggtggaaacgacatattcatgtacgcccgtttcgttcgccgttttatcgtccagctcatcctgcggaatggcttccacttcatccggcatggtctgatcgataggttcactggcttcagggagcaaagaacgtatttcgcttttttccagttcgatggtttttacaatgggtgcggactgggattgggggtgatagacatagggtcgccagacggcgaccgctaatgtgagaacagtaagagaccccagcataacgcgatgggggcgtggcagattattaaacgccaggctgaccgcgcgggctatctgttgcacgtattcacttcctcgttattctcctttcaggcagcccgagtactggttggcgagttgagtcaggaactggggatagctcgctttactcaatttgatactggttccaagcggatccagggtccccatgcgaactgaggtacctctcgcaacagcttcaataacggctggcctgaactgtggctcagcaaaaacgcaggttgctttttgctcaaccaactgtgttctgatttcatgtaaacgctgagcaccaggctgaatttcagggttaacggtgaaatgaccaagagacgtcagaccataatgtttttcaaagtagccgtaggcgtcatgaaaaacgaagtaccctttacctttcagcggtgccagctctttacccacctgctcatcggtttgggctaattgtgcctcaaaatccttcaggttggcgtcaagtttggctcgactttgcggcataacttccactaatttttgatggattgcaaccgctgccagccgcgctacgtctggcgaaagccaaatatgcatgttgtattcgccatgatggtgatggtggtcaccattttcatcatgatcgtggccgccttcatgttcgtgctcgtcttcctcagcgcctttcatcagcaaaggtttcacgccgggcagctcggccatcaccacttgtttcgcctgcgggattttttgcgtggtcttttgcatgaaggcttccatgtccggccccacccagacaactaagtccgcgctctgtaagcgttttacatcggacgggcgcagcgcataatcatgctcagacgcgccatccggcagtaagacttctgtgttagtgacgccatcagcaatagccgacgcaatgaatccgattggcttaagtgaggttactacggctgcatttgcgcctgtactcaggccagcccataaagcagcggaaaccgctgcgcaaagaagcgtatttttatgtaacataatgcgacttatcatcgtaatgaattggtggaatgtgatattataacattctgtcacttgtgcaagtctttaaacgctatgactaatttagtttcacttgaaaaagtctctgtctctttcggtcaacgccgcgtcttgtctgacatttcgctggaactgaaaccggggaaaattttaaccttactggggccaaacggcgccgggaaatcgacgctcgtgcgggtggtattgggcctggtagcagcggatgcgggcgtgatcaagcgcgataagcagctgcgcattggctatgtgccgcagaaattgcatctcgacgccacgctgccgttaaccgtcagccgttttttgcgtctgcgtccggcaacccgtaaagcggacattttgcctgcgcttaaacgcgtgcaggcggggcatctcattgacgcgccgatgcagaaactctccggcggggaaacccagcgggtgctgctggcgcgcgcgctgcttaaccgcccgcagctgctggtgctggatgaacccacccagggcgtggacgttaacggtcaggtggcgctttatgatctgatagaccagttacgccgcgaactggattgcgccgtgctgatggtgtcccacgatctgcatctcgtgatggcgaaaaccgatgaagtactgtgcctgaatcatcacatctgctgttccggcacgccggaagtggtttccatgcatccggaatttatttcaatgtttggcccgcgcggcgctgaacagctcggtatctatcgccataaccataatcatcgtcacgatttgcagggacgcattgtactgcgtcggggaaatggacactcatgatcgaattattactccccggctggctggccggaattatgctggcctgtgccgccggtccgcttggttcttttgttgtctggcgtcggatgtcttattttggcgatacgctggcgcatgcctcactgcttggcgtggcctttggcctgatgctggacgtcaatccgttctatgcggtgatcgccgttacgctgttgcttgcagccggtctggtgtggctggaaaaacgtcctcaccttgccattgataccctgctgggcattatggcgcacagtgcgctgtcgctgggtctggtggtagtcagcctgatgtcaaacatccgcgtcgacctgatggcctacctgtttggcgatctgctggcggtgacgccggaagatttgctgtctatcgccatcggcgtgacggtggtgatcggcattctgctcagccagtggcgcaatctgcttgccatgaccatcagcccggatctggcctttgtggacggcgtaaaactgcaacgggtgaaattactgctgatgctggtgaccgccctgacgattggggtggcgatgaaatttgtcggcgcgctgattatcacgtcgctgctgatcattcctgccgcgacggcgcggcgcttcgcccgtacgccggaacagatggcgggcgtggccgtgggtattggcgttgtcgcggtgaccggcggtttaaccttctctgctttttacgacacccctgccggtccgtcggtggtgctgtgcgccgcagcgctgtttattctgagtatgctgaagaaacaggcagcgtaatgcaggccgcctgccctctccgcaccggagagggcaaaagcgcggttacggcatggcgggcggcgtgatgccgaagtgatcccaggccctgatcgtcgccatacggccgcgcggggtgcgctgtaaaaagccctgctggatgagaaatggctccagcacgtcctcaatagtttcccgctcttcgccaatggccgcggcgaggttatccagcccaacggggccgccaaagaatttatcgatcaccgccagcagcagcttgcggtccatatagtcaaagccttccgcatccacattaagcatatccagcgcctgtgccgcgatttccagcgaaatggtgccgtcgtgtttgacttccgcaaagtcacgcacgcggcgcaacaggcggttggcgatacgcggcgtgccgcgggagcgtttagccacttcccaggcaccctcttcgctcagctccagccccataaagcgcgcgctgcgcccgacgatatgctggagatcggccacctggtaaaactcaaggcgctgcacaataccgaaacggtcgcgcagcggcgacgtcagggaaccggcgcgagtggttgcaccgatcaacgtaaagggcggcaaatcgattttaatcgagcgggccgccgggccttcgccgatcataatatccagctggtaatcttccatcgccggatagagcacttcttccactaccggcgataaacggtggatctcatcgataaagagcacatcatgaggttcaaggttggtcagcatggcggccagatcgccggccttttccagtaccgggccggatgtggtgcgcaggttaacgcccatttcgttggcgacaatattcgccagcgtggttttcccaagccctggcgggccgaaaatcagcagatgatccagcgcatcgccgcgcagcttcgccgcctgaataaaaatctccatctgcgagcgtacctgcggctgaccgatgtattcgtcgagcagtttagggcggatcgcccgatccaccgcttcttctggcgtcaggtttacggccgacacgagacggtctgcttcaatcatcctttactacctcacattgcagcgcggagcgcttcacggataagattttcactgctcgcacccggctgagcaattttactcaccatgcggctggcttcctgaggtttatatcccagcgccaccagcgcagcaactgcttcctgctcggcatcatcttccgcaggaccggccggcgatgccagcaccagatcgctggcgggggtgaagagatcgccatgcaggcctttgaagcggtctttcatttcgacaatcaagcgttctgccgttttcttaccgatacctggtaatttggtcagcgccacgggatcttcgcgctccacggcatttacgaactgttgagcggacataccggagagaatagccagcgccagcttcggcccgacgccgttggttttgatcagctcgcgaaacagcgtgcgctcctgcttattgttaaaaccgtacagcagctgcgcgtcttcgcgtaccacaaactgcgtaaagacgatggcttcctgcccggcatcgggcagttcataaaaacaggtcattggcatatgcacttcatagcctacgccacccgtctcaagcagtaccagcgggggttgtttttcgagaataatgcctctgagtctgcctatcacatcgcgctcctgcgttaatggcaaagttattgggggctatcatataaaaaaggctggataaatatccagcctgatttgcaattatcgcaaccgcccgcgcgccagattgagccggctgtcgctgatttgcaccgcattctgactgacatgacagtgcgtaatggcgatggccagcgcatcggcggcatcggcctgcggattggcgggcagtttcagcagcgtgcgtaccatgtgctgcacctggcttttctccgcgctgccggtacccaccaccgtctgtttaacctgccgtgcggcatattcaaacacaggaagatcctggttgacggcggcgacaatcgccacgccacgcgcctgccccagcttcagcgccgagtcggcgtttttcgccataaacacctgttcaatggcgaaataatccggccggaactgggtgatgatttccgtcacgcccgcgtaaatgagcttcaggcgggacggtaaatcatcgactttggtgcgaatacagccgctgccgaggtaggtcaactgtctgccaacctgacggataacgccataaccggtgatgcgtgagccggggtcaataccgagaataatcgacatcacgcgcctccgtcgttaaggcctgcctggcacgtcattctaacgtagccgcaacctcatcagagatctcgccgttatggtaaacttcctgcacgtcatcgcagtcttccagcatgtcgatcaggcgcagcagtttcggcgcggtttcggcatccatatcggctttggtggacgggatcatggagacttctgccgcgtcggctttcaggcccgccgcttccagcgcatctttcaccgcacccatctcttcccaggcggtataaacgtcgatggcgccgtcatcgtaggtcatcacgtcttccgcaccggcttccagcgctgcttccatgatggtgtcttcatcgcccttttcaaaagagatgacgccttttttgctgaacagataggccacagagccgtcagtgccaaggttgccgccgcatttgttaaacgcgtgacgcacttccgccaccgtacggttgcggttatcagagaggcattcaaccattaccgccgtgccgccaggaccgtaaccttcataaatgatggtttccatctgcgcatcgtcgtcaccgcccacaccgcgcgcgatggcacggtttaaggtgtcgcgtgtcatgttgttagacagcgctttatccactgccgcacgcaggcgcgggttagagccgacgtcagcgccgcccagacgggcagccgtgaccagctcacggataattttggtaaagatcttaccgcgtttggcatcctgtgccgctttgcggtgtttggtgttggcccatttactatgacctgccataaaaatatctccaaaagcctcgccctttcaggcggcgttaattacaaattcttcaatcgcctgccggttgctccatgatttggttaatgcagccgcagcgggcgcatccagccagcggtaggtcagatgttccgtaaacacaatctgccgctcatggggcagcgcaagacagaaccaggattccgtattgcgctcaatacccggcgcgtagcgatgacgcaaatgagtaaagatctcaaactccaccgtgcgctgacagtcgactaaggtcagttgctcttgcacaacgtcgataacgacctcttcctttacttcacgcagggcggcctgcgacgcggtttccccctcctccaggctgccggttaccgactgccagaaatcaggatcgtcgcgtcgctgcaacatcagcacccgtttcgtgtcctgcgcataaatcaccaccagcacggaaacgggacgcttatattgcatattatttattctccggggactcttttttgatcacctgaatacccagttcggtcagggacgcgtcgttagcaaaacttggcgcttccgtcatcagacaggcggctgcggtggttttcgggaacgcgatcacatcacgaatgttgtcggtgccggtaagcagcatggtcaggcgatccagaccaaaagcgaggcccgcatgcggcggcgtaccgtatttcagggcgtccagcaggaagccgaatttctcgcgctgttcctgttcggtgatgccgagaatgccgaacacggtctgctgcatttcagtgcggtgaatacgcacggaaccgccgcccacttcgtaaccgttgatcaccatgtcgtaggcgttggcgatagccgtttccggcgctgctttcagctcttccggcgtcatgttgctcggcgcggtgaacgggtggtgcatcgcggtcaggccgccttcgccgtcgtcttcgaacatcgggaagtcgataacccacagcggcgcccatttggactcgtcggtcaggttcagatctttacccagcttcagacgcagcgcgcccagcgcatcggcaaccactttcttgttgtcggcgccgaagaaaatcatatcgccatcctgcgcgtcagtgcgggcaaggatcgcttccacaatctcagcgttaaggaatttcgccaccgggctggtgatgccttccagacctttcgcgcgctcggtcactttaatataggccaggcctttcgcgccgtagatcttaatgaagttgccgtagtcgtcgatctgtttacggcttaacgccgcgccacctggcacacgcagggccgccacgcggcctttggggtcgttcgccgggcctgcgaagaccgcaaactccacgtctttcagcagatcggcgacgtccaccagctccatcgggttacgcagatccggtttatcggaaccgtaacgacgctcggcttccgcgaaggtcatctgcgggaactcgccgagatccacgcctttaatgtccagccacagctggcggatcagcgcttccatcacttcacgcacctgcggcgcagtcatgaaagaggtttccacgtcgatctgggtaaattctggctgacggtcagcacgtaaatcttcgtcgcggaagcatttaacgatctgatagtagcggtcaaaaccggacatcatcagcagctgtttgaaaagctgcggcgactgcggcagcgcgtagaatttacctttgtgcacacgtgaaggcactaaatagtcgcgcgcgccttccggcgtagctttggtcagcatcggggtttcgatgtcgaggaagccgtgatcgtccataaagcggcgcacgaagctggtgattttggcgcgcgttttcaggcgggtcgccatttccgggcgacgcagatccaggtaacggaatttcagacgcgcttcttcggtgttgacgtgattggagtccagcggcagcgattctgaacggttgatgatctccagatcggtggccagcacttcgatttcgccggtcgccatgtcgctgttgatgtttttctcgtcacggcggcgtacggtgccggtgactttaatgcagaactcattacgcagttcggaggccagctttaatgcgtccgcgcgatccggatcgaaaaacacctgcacgataccttcgcggtcgcgcatatcgataaagatcaggctgccgagatcacggcgacggttgacccaaccacacagagtcacctgctgcccctcgtgggacagtcgaagctgtccgcaatattctgtacgcatgagatatcccttaactttgccgcaggccgattgtcgcctgccgtgcaggccacgttgtcgcagcgttagcctaatgtcacaactggatgaaaaaagggggttattatactggaaattctggcggacgataagtgccacgccgtgcggacgcgcgattgctgcgcgcttattgcgtaatctcacaaaaattaacaatatttgtcagccgcgctacccttttatacaggtaaggtaaacgcgatgtcattcaataaacgggagttattatgctggaactgaacgccgccaccaccgcactggtcgttatcgatttgcaggaggggatcctgccctttgccggtggcccgcacagcgccggggatgtggtggcccgcgccgcgcggctggcggaacaatgtcgccttaaaggcgcgccggtggtgatggtgcgcgtcggctggtctgcggattttgccgaagcgctgaaacagcccgtagatgccgcgatcccggcccactcgctgccggacaactggtgggattaccctcttgcgctgggtaaaaaagagagcgatctggaagtaaccaaacgtcagtggggcgcgttttacggcaccgatctggaaatgcagctgcgtcgccgtggcatcgacaccattattctctgcgggatctccaccaatatcggcgtcgagtccaccgcccgtaacgcctgggaaatgggctttaagcttgtggtggtggaagacgcctgtagcgccgccagcagcgagcagcatctcggcagcatgaccaacatcttcccgcgcatcggccgcgtacgcagcaccgaagaggtgctggcagccttatgatctacatcgggctgccgcaatggtcgcacccgaaatgggcgcggcttggtattcagggacttgaagactacgcccgacacttcaactgcgtggagcggggaatttaaaaatcactaaagaacgcccaagagcatgtgtattctttgtgtattcataacgttataaacatagctcatatgaaattcgctaaagttcatatgagcacaaatgccccatacgtgccccagaacattttagtttgccccatacatgccccattagattaccgggcattcgtcatccaccccgttctgcgtatcgacgacgaaatgggtgacgacgccgatcacctgcaactcattcaggcactctccctctatcggatcaccatcatgcgtgatgaacgccttccccataaacttcccgaaataggtacgaccatccaggctggcgaacagcacgtcgccttgccgcgctattaaccccctgtcgaccacagccgcgccggttgatgtctcaatgaccaggctgttagccgttaaattgcatatgatgtcagcgcacatcgttgtttcaatgtaatcagccgctggagacgggaagcccattattgaacgtaccccatactgcgtagcatccacagccggttttcgctggtatctggtgtcttgtccacgaatcctgtctggtatcgctctatccacttattggcatcagccagagtgtaatgccagttgcgattgcgcagttcacgcacgaaatccgccgtccgcaagcattgatagcccttggggtttttgtgtattgccgcaacgaacgcgccgctaatgtctgatctgcgtgccatagtctccctccatttatactgtatatataaacagtatttcaaaggggagatttggtcaataccaaaaagaaagccctcacatggagggctgtgtttgtaggtcagtaatcccactcaagtccggacagcgatacgaactgagttcctgctggaagcgtcccatcctgaacgcggatgtgatctgttactgagatatgagaatttacaaagcctgtcgaaccaagcatcaatgcagtatagcgaccgccgggagagacaggctgcaacgcagctggcagcgatactatatttgctgtcgcgccggaacctacctgcataaatccacgcactgatgcacgatagtttttcagggaaaattcatactgctcattctcagatgatgccgaattccatcctaaggtaagagacgggccggtgctgcctccgtccatttgaaatttagatttagtaatgatgctgtaacgctcgctaccaacataaatttttgcataggtggtcatgaaataaaggcttccaaccgtggtcccttccacctgatcgatgaagatacgtgcaaatgccaaagctgtaatcattgcattggtgatgtttacaccctcgcaccggccaatagagagctgagctgagggattttcagtaggctgatttaggtaaattccacgcttacagtttgaggctctgacatgatcgattctgatgcgtgatgaactattatttccgtcaataatgaaagcatactcaccaacgatagcattgttatcagcaagaccatctgcaacaatattaacaatatgcacatcagctaatggcattaatccggcaccgtgcactccccatactgccccgcttgtatgtacactaccaatataaacaggaccgttgaaagtcctggcatttgggtcaatatccacgccatgtttagcgtatgctggttcaaaccatgggctagtgtttctcggtttataggcgtaagtgaagtcgtgaacgaaaacgttaccgcagtttgatgatccatctgctttgataattagtccgttttcactttggcagtatgcaaaaatacccgtagccactacgtcagatgctttaatgattacgccatgtgagccaccgatgccggtgacgttgtctaaccgaccatggctataaccttcggtaagtaccgcgtgacctagcgcctggctgttatacatcaatccaatgatgttacgcagcacaagtccatttttttgttccaatccagtagatggagcgccataaacaaatgcatcccatgtattgccttcaggatgtgaagcagtggttgtgtcagcgccgggatattttgaattgatgtaatctcggccattgtcaaagccgatgttttccactgtcaggttattcgcccaggcgatgaagcgaccagcaataaccgatccgccgataagtcgagtaagtgtagagttccaggttggcgctctttcaccaagtatacggatattatcaacgttcatgctgtctgcattaacgttccatttccctgactcatatcttgctgccgggacgtataccgtcccccccgaaggaatagctgctatcgcttctttaagtgaggaatagttagcaatattgaccgtaggcaacattgcataagatgcgttgagatatgcgccaaccgagccgtaaggataatccatacccggctgatagccgacaagcccagcgccctcttcctttttcagatcagctcgcaaagaggcatcgccaactccaacccatgcgcctttttgcactccccctgtgctatctggcgttgagccagggggtactactttggggaagttgccgtcccaccggtagtattccccgttgctcttccagcgcaggcactcgttagcagtgctaagggtgctgccatcttcaaaagaatccttcgtgatatagccataattcagaattgcctgattagcatttttctcaataccataccatgttttgcgaggcctcccaagacggtctggccatgtctcgttcgccatatcgttggttaaatgatcgagattctcggcgttatcgtataaatctttagcagcagcggaccccagcggattgccggtgttataagtcgtcatatgggcctcagtaacgaaaaaacccgccggagcaggttcatgagaagtggatttacttaagcaacattgccgggatagttggcgttgtcgtactggtaatagagtggcgaatactgcgcggcgttgagctggcaggttccgtctgaagacggatcgacacttgtaaccgtggcgtcatacccaacccttctggatgagcagaaaatcaggcgcagcggctcgatgtacgggctgttcatctcccactcgctgaggcgcagtgcatcgctctccggaaccgtcagtgtgtatgcatctacgcgttctggtaccagcagcggcgttgcgctaccgtcctgcaggcgcagcaagcaacgggggttttcaaatgaccagtccagcggctcactgactttcatggttaccagtgcgccgtcgtggatcatatccgtgaccaggcagctgatggtgtcactccccgggatgtcatcggtcagcaccaagcgatcgccatactggtagcaaagcgcgtccagctccgtggaagtggagtgcgccagccgctgatacagatgcttcatcagacgtcgcatcccgatccgccaggcccgatccgggtctgtaaccccgtaaagcttgtagtcctcgaccttacgcggcgtgccgctgccctgcctgcaatgtatggtttcctctgcccaggtcaggctgctgacgaaagtgacgtccactgcgtcgaagtcatcctctgtcggtgctgtgaacgacgtctggagctcctcggtggtttcctgcgggctgatgacgccaacccagtttttaaccccttcacgtcccacgctggccagtccgtcggaaagcaggaaatagctcatgccggcgttgcagatcgtctgcaggatatcgagtgctgatttgccggactcactggccatgtagtcgaacgtttccccccgcggcgtccagtatgccgactcgagcgcggcgatcgccgcggcgtcagcttccataccaattgattcaagaatatgccacagtgcaccgctgatgctgcgcgccgggtaaccattgtcatagatacgcggcgacgtcacgctgacgcggcgatcggactgcgcggccaggcgggagcccgtcctgacggttagcccgataatggtcacgccctcatagcgcgcaggacgacgcggcaaccgcgagcgaagtgcctgccagtaaacctgatcgcgcgtgctgctgcccgccggcggctcggtacggcgcatgcgtacttcatactgtccgggtgtaacgtcgatcacctcagtgaaccctatctggtcttcagtctggcgctcataccccagcgcgacctgctgccagtcactggtgctaccggcggcacggtactgaatgattatcccaactctggcggatctccgctttcctttgctgttgtagcgcaccagtccgttctggaaattcaggtttatctccatacggtcggtggtctcgccgtcaggacagcacaggaaaggccccagccagtcatagttatcgttaacgccggtaaccgacgcatccagtaatgtacgtgcggtaaaacctgtccagcgcggatccactgttgttgccgtgttcccggccaggtctttggtaaccgttacgcgcgctacggtgatcgtcagcgcattaatggccgttatctggtactgatacccggagggggtcaggctaaatcgctgctgaccggcaggcagaccggcgaacggcgcacccgacgggtaagacaagcgcagactcgccagccgggcagcggtaccaccgctggatgccaggcccgcgacggatacaggagcgctgccgaataagaccaccggcaatgagctgaaggttatggacccaccagcgaacgggctagactcctcgcttataataatgcgcccagatttatcgttggcaactagcccggatccgttcagctgactggtaatcgctgacaccaggccggacatagtcacgtagtttgcggtcagcgacacaggcaaggcgcggtttttccaagtaatactgaacgtctgctggctaccgctgaagtcgtaggtctggggcgcggcgctggcggtgacagtagcgctactgccacccacgccgggaacagccgcaaccgccggggaatactctgcgacaaccagatcaaactggtcattgttgatttcaagagtcagcggcatacccaccaaaggggcgagttcatccaccgatccggcgatctcgctatacccggcggtactggttaccctgtacgtgtccggagcatcaatgttaatcagcgtgccctccacccagccggacgggatctccgtgtcactgtccccggatgacacagagccaatcagcgtcaccgtattgccggatacgagtacagcatcagcgtcaacggtgacggcggccgggccgctggtaccgagatccagaccagagccaccagcggatgtaccacccacttccgtggagttgtaccagttctcagagcggggatcggcagaaacatctgcgcccggcgggtatacggtgtaagagacatcatcgccaaagctgctgacaggcgttgccccgatgcgcagatcctcttttttgatatctccactgccgacgccccagcacacaaacatgctggttaccatgtcacgttcgttgacgaaccggctgacaggctgcacaacataatccggatagacgcggtagagaccaaacacctcacgaatgggatcgcccaagcgggcggcgttagcttttgccggatcaagcgatatctggtcgccctgcccctgcccactgagccctcccttatccatggtggtcatcatgtagatggaatacgctgctgatgctaccgctaccgcaacagccgtccataccagccaggcgggcgcagctggtccgtacgggatagggtagattcgcacatcgctgtcaggccgaagatggcagagcggccattcctcaggcgggatgggggcgccgttgacttcggccgcaacgggctgctgccggtcattctggtaaccggtaacgttttctgcaaaccactgatggagtgtaagggagtcgtgttcgtgcgtctccagcggttcacccggcagccgggacggataaatgcgtatggtcactcgtaatactccacggatgaataaagcctctcaaagcgggccagcggcaggatagtcacgttacggtgtgggtttgattcgagaacatgcagcgttccttcgatattgaccaccacgcccaggtgatcgataacccccccggaataacacgcagccactgccccttctttcgcttccacgcgtcggacgttggccgagaacgccacgcacgcccgtgccatcgtatccccttcgcggatcacgccctcaaatgcaggccattccggaagcccgagatcccggcgtacctcatgcacaacgccgtagcagtcaagtaccggccagacgcgcccgcccatctgccaggtgacagagcggtatttgtcgatattaaacattgaaacctcagaggtagcgaaggcccggaaaagaaggcagcgtgtagcggtagcgtggccacgccatatccagcacattcatatagcccgcggtgatctgcacttcggttgaagtccatgacccggttttaatggacaatgtgtacgggcgcgctgcgggtgcgttcaggctggttgagatgtacaggcggtaggtcagcgttgcgccctgaatattctccagggctttacggatcgtgctggatacctcaccggtaatattactgatggcaaatttaagatcctgcgtaccgtcattgttgcgggctggcagcgcaatatcaatgccacagccctgaaaggttagtagctcgccattctcagttgtcacctcgatgtcgtcccagccacgggtgaggtaataaacgtcattgccgatgttgatctgtagggtctcgatcaacacttcgtcaccgcttgatgcataaagccggttcagtaccgtcatgcgtttggccactccctgttaacagcgagatcgataatgtcagcgccggtaataaagcccgggaatacaccccagcctggagccagtaacggacgttcataaagctcaagctgtgccgagtaacgccagaaattcccgccttccagacttggcccctcgtaaatgtcggtgaaccggcaaacctttggggcttcgcctccgggcgtgcgcaggttcatgttgaaccagtccgcgccgtccgtcagcacgtcgcgaaaccatgcctcgaatgcctgcgcctgctggtctgtcaataaccatgatatgctggccactgtcggtgtcgagatgtagcggcggcgctgccgtgcacgtccgctggtcatctgcgttctgactatcgggctgacaggctgaaagccgtatccctcctgaagaggtacgggtagtgcatcatgtggatagttaatattggttgtaatggccatcagcgctttttcctcccaaccgcccagccgttgttaagggcttttgatgcctgccctgaaccgccagccagatcgttagccgtcatctggtagcccagcgtcgcgccgcgcttcactgcaccctcaatcagagccagagtgcgctgatctggatcaccgtgaacctcgagaggaatggtgatgtttggtgcctgactaccggtagactgttttcctacacgctccagcgtggcatccagtttcgcgctggttttggcggtggtaacgcgttcacctttttgcagcaaccaggtgccggtttccggtaccgagtcgataccgtcatgagcctggcccttgagggctgagctgacgcccagcatcaacacacccgctccggcagcggcagctgtggctgctgaccccgcaagggctggccccacatacggcacaccaatcatgctggtaaatgcctgaagtgcagccatggctacctgagcagctgcatactgaagcagcgccgcgcccatcgactgaataaaggtggcggcgaagtccttaacgttcatcttccctgtttcagcccattcgataatcatatcggtcaggctgctgaatgcctgcgcgccaacctgctgcatattggagtacaggtccatagaggcttctatttgcgtggcaagccccgagacaaaaccagcgttaccgttattgcggagatcgtcaacctgctggtaatagtcctcctgaatctgcaggcgttcggccatcgcgtcgttcagagcctgcgtctcgctgtcatacagcgttttggtgatatcgccagattgatactgtttctggagatcagcctgacgagagaggaaatcggcctgaatctgaaggcgatcatgcatacgctcgcgctcctgcgcgcccagccacccaccagcaacatcgatatcaagcgaggctttctcgttctggttggatgcatgcagcccggcggtgaactcagccagtttgaggttttcttcattcgcccggcgaacagcgttcaggcggtcaatttcggtagctagctgcgacaggcgggttttctgcgtctcgttgagtccggccagctttccgtcagcaatatcaaactgaagccgttgaagctcagttacctcgaccacctttttacctgtggtgtcgatcagcgctatctggcgctggtatgcctgctcggtcgccttaaaggcgttctcaagtttgttggctcctgcatctgccgtgggcttaccgttaacttctccttttccaagcttatatcccgtagtagcggagctgctcgtaactgccgggaatattggtaaagaagtctggaatttatctaaactggcaagtttttcgcgcagttcctttaattctttttgcttggcatcggtatccataccaatacggtttattccagccagaaaacctttatcgctcaggtcagcttcaagatttttaatccgcctttgaatttctacgcttgaagcgttggccgcaactctttgtccgccctgaaagttctctacaaggcgacccaactccgaagctgcgttaccgagccatccgacaagagatgctacaccaccaaccagctccgataatccctgcaaaactgctgggtcggtgaaagtctttttaagatcatccagcccttcctgaagtggtgaaagatcaactttagcgagccctgcagcaatctccatcttcagaccactggcctgtgcttccagatcctgaaatatctgattcacttttaaaaggtcatctatagatttcggatctggtgcaacaccgtagtctttcgccagttgaataaactcgtttaatttttggttattattatcaaatagcggtaatagctttgatagatcattaccgaggctttcaagaatattggtcttttcggcgttggtatttattttccctagcgcgtcaccaatagctatcaattgtttatcagggctaaccttagatagtttttccgcggaaaggcccaaggcattaagcgcgtcgaccgcttcacccgacttattaagtacagcatcaccgattttatcgccgatatctttaaaaatgtcggctatctggtcacctgacactccagccttttcagcggcaaactgccaggccatcagttcctgcgtagatacttgcagagactttgcccacctgtccgtttcagtgatttgttcagaggtggacttcagtaaagctattcctgccgaggatacagcaactgccgcgcccgctgcggctgtacctatggtggcaatggcagagcccgcagcctttacatctgactggacttttttccgccacttctcagacgagcgttctgctttatccatgccagcaacaaaaccacccaccttggcgatcaggtcaatcgtcagggttccgagggatttaccggccatattatctccataaaaaaaccgccaaagcggatatttttacattcagggtttattcggtgattattaccgcctgctgactaattccagtttttcatcgcgtcttccagcgacacgggcggctcgtcaatatgaggcgcgaaatcactgatgcggaacgacggggtgtccttacctttgttgacgttcgccagcacggaggcgatcagcgccgcgccccactctgtccgcatcatcgggttcagtcctccatactggctgcggtaccggagccagagctggaactctctgaggctgagtcgttcttgagcttcggcgatcgttcttccgccgatgccgttgaggacgagctcgcaccaaacctcatcttcggcggtgagttcatctttcccagctcgttcacctcctgaatagcgaccagcagcgccaccgtaagcgccccatcaagcgcgccgcgctccggatcagcttcgccggtgatatctttgggcgtaaaaatcgggttgccggcttcatcacaaaccgccgccgcgatataaccggctacgccatctattttgcctgcgctggcctgaatgccctgggtagcagcatggtaaccggcaggccgaatgaacaccgttgcggtcagctcctcttctccctgtttccaggtgatctctttttcaatcgggcggccggtgaacgccccggcttttttcagattatcgagcgtcagttgcatgatttttcctgctccaaaagttatacggggcatacgccccgcgttgcttaactgccagcttggactttcggcacccataccgccgggccagaacgctgaaccgatgccgacgtggccacaaccgtgttagccgcaaaatcgaacgggaaatcggtcaccttgcctttgaacacaaaccaggtgcggtcttccggaagttggaggccatctacgctaccagctcctgatccgactgtaggcgctgactcaccatcagcccagcccactgcccaagtaagatcgtcctgattgtcggactctgccatgcggtgcagcatcagatggctgagattcgccggatccgcgttaagcgtcaccgtggccgcgccgggggtacgcagaccttttttataagttcgcgtgcttcgctcactgaggcaggtatcttcaatctggtcggcggggttgccgccagggctaaacgcggtgatgcactcaacttcgctgactgcgccgtccgccagaacatagagctgtgtgccctgagtcactacagacatagttatctccggatataaaaaaaccggctcggggccggtgtattgagggttatcgcttcactatccagtcaacgtcgaaggaatagcgatagcgttttgtttcggggtctttctcctgccctccccagcgcgtgatgtgcgcgtgcggctctatggcatcgcgcagtgcagcggcgacggcaatgacctcatccaccgtgtcggcataggcatccacctgaagcgtgaatgcatcagcgtcaggtcgctgcgccaggtagttctccggcgctccggtgacattctgccagaccgcatacggataaacgactgcatcgtcctgcataccgaaggggtaaacgcgcaacgggtcagaccccagcaatgctcttacgcgcgggctgccagcgcaaacggcgaaaatcggagcgatcatggcggaactcctttcttctgtgcgcgcttaatggcccggtcgagcaccttttcgtattcagtggcaaaagtgtttgtcacctcgttaaggttgttctcagctgccggacgcaaaaatggctgagcgcgcatcttctcggtaccgaattcaatgagtcgccagtgcggggtcggggcgttctcgctcaggtcaggatgatttttcagcacagcgccatgaagcacgccgatccgaaatcccaggtcaccggtgcgcctgaacaggcgaccattccagcgctgcgtgacgtttgcggcaatgctgcgcccggtttccggatcatcaatacggctggcgttttctttagctttttcgacaatcacattaccggcgcgccggagcgccgcccggccacctttacgccgcagatcgtcactgacggcatcaagcttacccagcagcgactccagccctgtgatactgaaatcaataccgtcagccatcattaactccccgcgaacacggcagcgtcaggtattcccggccgcttttatcgtcttccagcacgccatgaatgttgtagatgcggccccggtgaacaatgcgatgtttatccgtgatatcatcccgccagcgaatggtgatccgggtagtcacttcactttgcgcggctcgcgcggccacaaaatcgcgggcagataaatcaacaacactggcccacaactctgcgacgtcagcccagccattagtgacggcgcctgtggcagggctttgggttttcaccggcttctggagcatgacgcgcctgtttagctttccggcctgcatgcttaccccctgggtttaccgctgaggtaagtgtgtaccggggagtcgatcgtggtcgtttcaatctcccccaccattgactggtaaatcatcgccgccagggcttcgtttgactccgccagccgcgtcattgcggcggtctgcgctgccatcgctgccagcaggccgtttacctgttgctcgttcataggcaatgtccctccattttttcagccactcccggcggcgtttacatccggcgcaggccatcagtgccaccgccggtggcgtaacagcagcgcttcgacgcccagcggcgtttccgccaggttctgcgccgctgcctcgcggtttgcgtaccagtgaccaatcagcaaaagcattgccgcccagatacccgaagtaaaaagaacctcacggggaggctccttttcttcgtggggaggtgtcagcgattccaccagcgcaccgtcgcagaagtgctcaacgtaatcaacagctgccgaggcataggcagcaatcagatcgtcttcggcgccactgtcaactttcagatgcgtctttatctgcgccatctgctccgcgcttatttccacctttacccccggttttggctttttcagactgcacaggatcggaagctcccaccttttcggtttcaacctcttcggccaggtgcaatttcaccagtgcttcgccgatttctttcttcaccacgcgggtttcaccctgtgacaccgttccgaggtgataatgcgagaacatacggagagctttaattttcatagcgtttacgcggccattgctgaccgcgcccttttgttatgcgccggtaccgacagcaatatcaccggtaacgatggcggcaggacgatagtgcgccagcgccaggcgctcttcgcacaggatggtcagcatgtttttcacgaagttatcgcgatcctggttgctgatttcgatagtggcatccatgcggtcccagacctgagaggcaaggccaaatgcgccgacggtaaacgtaccggccgcctgcgctgtggtggacacgaccggcagcccccagagcaacttcgaggcaaatgcctgagggccgccaaggatgtaattgccgttcgcgtccttcagcagcgcaatgcgatgccagtctgccgggttaagaacgataccgtcggcttcaaattcgctgagtgatacctggtagatagcatgcgccagcacgtcagcccccgtatcacctgaagcattcagcgcggtttcatactcgttggcaaccacgttcagaccctgcaggttgtcgccggtaccatcaccgttcagcatctggttttcttccaccagtgccaggccatacatcatgcgggagttgatataagactccagagccggcgcatcgtccataatctgacgcgatgcctggatccagtgggcgatggtcttcacgttcgccatttctttggtgaaggtgatgttactttccggcttgagggtgccttccgccaccggcgccgcagcgttggtaaacacgttctcgcgaacatattccagtgcgttactggtgatacgcccctgcgccagaagatcacgcacggtcagacggcgcaggcctggcatgagaatgcccggctgctgctgcggcagaaccagcgcaccggcggagttagcacccgagccgatcgccttgtcgaagctggttaccttcgctttggtgcgcgaaccgtcccagcccttcatcaggtcttcggacacacgctctgcaaaagatttcttcgcggtctggtcggggacgttaccagcgagcttctgctcaagatcgaacaggcgcgtaccggtggttttcagttcatcctgcgctttggtcaggtcggcctggagttgtttgttaatttcgccattttcattaatggacttacgttgttcgtcgatcagttgcttcacttctttctgtgaattctcgatcgctttttccagtacagataattcagacatgtgttgctccgttaagcattccgcagattagcggcaaaggaagttatgcgctgtgccagcgcgtcaatgtcgccgctaccggactcgctccggcctgcggacttcacgcgggcaataaatgcctgcgcctcagcgcgcgtcaggccgactgaatccctcagccaggcctccgcgtcacgaatggttttgataccgtcgatacacttcatggcggtcacgcctgccagctcattagccgggaacgtgcagacgctgatttcccgcagataggagatgtttttaaaaataaggccggtgctcccgacgctgtaatcgtcaggaccgacagaaaaccctactgacatgccctcaacagtgccgtgctgcatggcggctttaagatcttctgaaatgctgagtccaggcgtaagctgtccgcggacatacagccctttctcatcttcatgcatcgcatcccatttgccgacagggatggcgcgggtctggtggttgaaaaacatggccactttacgactctggctggcgatcacacccgcaaaagcgccgggcaaaataatgtcgccatcggcgtcggtgttattgaaaaccgaggcgtacccctcaaaggtccccttactgccgtcgccggtaaacttgatttctgtctggtcgaacgccagcgttttttgaatctcaggcatcgtagcccccataaaaattaagcccctccggagaggggcttgttatttgttccgagatcggtgatcggtatgttctgcgactggcgcgttgccacatcgccaccgggcaggggcggcaggttatccagccgtcgtacttcatttacggtacggatcccggtattaaccatgatctgcataaacgaggcccggcttgtagaatcgccgcgcaacagcccgtcgagattatgttcggcgtgaatactgccctgctctgattctttaaccagccagcgctcaatgctgtattcccagcgatcgagataaggtttaagggtgtactggaggaagccgaggttttgctgctcgatgccggatccccatgaggtgcttttatccacatcccctaccagatgcggaggtacaccgtaaaagcgcgccagttcggcgacctgaaattttcgcgctgccagaatttcggagtcctgaggcgaaaccccgatagcctgtgtagtgaaaccgctctccaggatccacaggcgtttcttaaccggaccgccggcaatctctttgaagttttcttccagttgcccgcgctgctctttggtcagtaccttgccgtcagtcatcaggatctgcggtgacttcgcgccgtttgcgaaaaactcacgctggttatcttccatggcaatggcaacaccggcagacttcgcgctgaacgccaggggtgacagtccggtcaggccattaaaaccaaatcccttgagatggaagatttctttctgtgaaaagtcggcatattccgtgtcacggcggtaccggtagataatggttttaccgttatcgctgagccgcacctccatgttggcactcatcagcggaaccatactgataacgtcgccgacgctgtttcgttccacatgcgcgtaggcatttccgtaggcacacagctgcattgtcatggcctcgcgaaactccagcgcggtcatgaaattgttaggccggaagcgcagaagctttgcgagaggatgcgtgcccggtactttgctgcgctgatcatctttggtctggtagacatcaaggggtaacgatgcggtgacggtggagataagcctgatacaggcccacaccgtactgatttgcatattacgctcgtcagtcaccaccgagtcaccgaccacaccgtgcgcagacgttcccgccatctgcgaacctttatccggcgtcaccagtcggccgccggtcaggatggaggccatgcgcgcccagaatggcgatcgcgttcgcaggtcaatgctgtaatcggtatcagccatgtttacacgctcaaaaagttgtaaatgaaatcgttaacgtcaccctgctcttccacctcgtcgctgttctgcgccccgacggacattgccagcgcgaccatgccatcgatgcgcccgctagatttgccttttacgaatttgcggttgcccgcagggtcagtgatgacggtcgcatttttggcgcacatctccaggatcggatgattgccgtgcttcagctgcgcgccgagcagtttggtttccagctcacgcagcgccggcgacatagatacaaagccctgcccgaattccacgaaccgttcgagttcagcttctgtgaatccggcgtcaataaggtgcgggcgaagaaagcgcatgttgtaacggtcaaaggccagcgccctgacgttgcaggtatcgaagatgtcgcgcagctcttttgcgataaaggcgtactcaatggccttgccgggcgttgtgttgaggtaaccctgccgcgcccagatgtcatagggcacgcgatcgttacgggccttatcagccagtccttccgcaggaagccagaacttacagtgcacatcgcctctggcagaattcagcaccagcgccgtcagatccgagacgctggacaggtcaagcccgccccagacggtggcaccggccaggctgtcaggttcttctttattcatatgccagacggtctgactgacgaaggggcttttcgcttccacccgccggttaaggacaaggttttcaaactcagcctggcgcgacggcagacgtttggcgctggcggccatgtccagcacttcctgctggttcatgaacacatcaaatgccgggtttgctgctctgatcgcttcaaccgaaaacggatcaatatcttctggcgcagtctgtaaccggaccaccgtgcgcgggtcggcgccagtcagcccgtcatcaatcagcaggctcaggaggtcgctggcatccggtgcctgggtactgataatcaccgagatcgggttttcctgcgcggcggttgctgtctccagtgcctcgtaaagcggatcacgcgggccacgaacctggcctaactcatcgtgggccacaaagcgcggcgagaatccgtaagcggttgtagcttcggcgctcagcgcccggtaataggagcccagttcagggcaatggatctctttggctgagtctttaatcgccacgtactgcatcagcaccgggttcatccggcacatttttgaggcgaggttaaagaggattgcagcctgatcgcgggaacgcgccgctgaataaagctgggagttgtgcgccgcctccgggccaaccagataaagcagcatcagcatggcagtttccaccgtcttggcgtttttacgccccctgctgatgatcgcgcggcgggtgccgtgcacgttgtcaaaaattgccctgaagtcatccttcatgaaatcggccatcttcagccgctgtccgacaaacttgccctcaggaatgaggatgttctgctcacaccaccggatgtttcgttcagcccgtgtaaggttctttttaaccatcagctactcagccttaatcaatttcccagggcttcttctcccgcgccaggttgttatgcgcccgccctactgttttcgggtcggctgtggcctggcgcgtgatccgcaaacgggtagccagtgaagatgcggaacggacttcacgctcacgcatggtcagcaaccggtcgtaacgcttaaggccatcttcacgggacagccattccagctcgaacgcttccagctgcgtggtgatgatcctggcctgcacgacatggcggcagtacatctccatcatgtcgcgatgggtttcggtgaacgaactggcaggattgtaattgaccagtcggatccagacattgatctccggatcgctgagatgcagcgacggctgtaatctgctttcagccagcgccggcagcgagacagcagacgtcgcagcgagagactttctgcctcgctgtgccatcactttttcctttttttctggacgtttttaataaaaagactgagggcgcggtctttaagattttgccgtcagagttttatccctcccccccacccttccggtctgacaaatgagaatcgctctcacttctcgatgatgcgcaggttatcgcggggctgagggtttggcaccagtcgttcgcgggtaccgatgggaatggtcaatgtaaccgtgggcagcgtctcgcctacctgatggtggaggctgatcgcagtgagtgagctgaagctgatgccatcgatgctcagttcaatcagcttgccttcacggtattcaatcctgaggtcctgcattgcatgctccttttaccagataacccggccttcactgtcgaactctgtcaccgttccgcccttctccatgcgctgcttcacggagtcgtggcagcgtttgcataaactttgtaaattttccgggtcgtgaaagagtgtttcatcacccttatgcggtgtgacgtggtcaacgatggaggctgacactacctgattacgtttaaggtgaaactcgcacagtggctgtttctgcaactggtggtaacgcagacggtaccagcgcttggtgttgtagaggttatgccagggtgaactggaagccatattcactccaataaaaaagccaccagcggataccagtggcttgaatgggttgtggtgtacgtgttggctcgggtgtgccgatctaagtcggatagccatcgtaaaggtgcgctcgccttttcctgcttatttgacgattaacacgcacaccacaattcgtcattatcacaggcactcagtgaatgcctgctgtaatgccttaacagtcgtcatcaggcttggctacagagcgacacgcaaacatgcaagctttctgcatttccgttttcgccatagcaacccagcgcggatctgcgcctgtctctttagctgtatccagtaggtggaggaaatgacgactcacatctttcatccggttcatcacttcaatatcgcccggcgttaacgtgcgataacccttaacggtgctgccgtcctgcggttttgcttcgctcattgttttaccttatgggttaatggtgcgctgcgatgcgctttaaatgacggcgattaacgaacgtcaatatcagggatgatcaccgacggcttgaaggtgacacggtaatggttaacgctggcgttcgtgccgctcaggtcttccataaaccaggtcacgttatccgacaggcccagcatgtgctttttgtaagtgtccggcccggtcttgcagataacgcccagcgttcgctcggtgctggtattgtcctttgagcaaagcccggtaatttccagcatgaactcgccggtaatcccgttataaaaaacaaagcgccgttgcgcctcaaagttatcagcggccttgcttacgttgcggctggctacatcggcatcattgatatcgcaggcagcaagcgccagcaccgccaggcagagaagcgtctttctcatcacgttttaccagagtaattgattgtctcgttgctcagggtgagcagtgggccggagtcgcggcgcttcgcagcgtggctaaccgtgttgttgtgcagcggagagaacatcatcaggcgctctgctgtgaaagcgccttgtgacagtgtctcaggaaaaaacgttgactaaacggcattcattcgtgagccatatatcatttccacagaaatattgctgacactttcaggtgattcgctacgttagaaccgttacacacacagcaaacggagaaaatatgaaccttgatgtactgaattttcttgttcggaatcgtgaagaattaattcgtgattcagcaaatgataatggactaaacgaagataatgtttggggtgtcgctcaaaaagtcgtgggtgaaaatagcatcaccggcttatctgaaaagcaacgttacctgttcgataatgctctacttcccctcatagaggatgtaccttgccaaggatggtatgacgaatttgatggtgacgagggctcgcatttcgactgtccaagcacaattgaagaaggaaggctcattcactgctaccaagaagaaagcatgctctgcgaaagttgcgaagaagaagaatcttttcgcgcttcaaacaaacgcagattcatggaagatgattaattctccttcgcgtggcagttatcctgccacgctttgttatgcgccgcgacgtcggctttggtctgcctgtccatcacggctacgtcatgggcagttacgtaaatcggccgcacccagtcgcaggcggtatctacaacctcaatccttacgctgccagttgtcgagcagctcgcgatcaacatcatcgccagacatatggttaacagcctgttcagcatctgccgccctctttgttgcttcaacgcggcgttctgccgctgctgcactgcctgcggcccgctgttctgcctcacgcgcccgggcgtccgcctcggcagtgtctttgccctgcgatttactgatgcgccaggtgcccaccagcaggagcaccagtgtaattatgccgccgatcaacccttcagcacccattacggtttctccgttacagttggctgtttcaccaggcggccaatgatgccgcataccgccacaaccgcagtgatggtgcccatccagcttgccgggatgtttgctttcacatcatcaggcagttgcgaccagataagcgggatggcgccagctactgccagcgcctgaacgctgaacagccgccaccacttacgccagttttcgataaccatgctcacctcacagtgcgcgacgggcgcgcttataacgttcagcacggtcatcgaggccgttctgcccgccgttgatgatctgcgtcacccgcaccacatcgcccggataccgcatgcaaccgctggtggcaaagaaccatgccgctgatcgggctgcgtggcggtcttccgccagcaattcaggcgtggtgaccagatcgagtttcagggcagcaccgcattttcggtaattttccagaccggtgatctggatcagaccgcgaccgcgatatttccagccatcctgcggacctttgttgccgttgcgtttgttgtaagccagatttgcgagcgcgcgctggcgctccagcggaagtgaaggttcaccggcgcggcggccaagcatattcgcctggtcctgcgtgatacgcccggcgcggatgaaatcggccagacccgccacgctgtagttgaagctctccaccagcgcggtaaagcccgttgattcgtggcctacctgcgcaatgaacatggcctgctgcaccggttcggtgatgccgaattcacgcatcgccgcatcgatatgcggaaaccagcgcgcggctaacccggcgctgagattagccgcccgttgaaattgtgtctggttcattctggcctcagtacctggaacagctgcgccacattaccccgagccctgaacacggcggcgcagatgattaagttgatggtgacggtcgcccagtgggcgtggaaatagaaatcgaacaggaagcggaacggtaccgaggcatacgccaggataatcaggtacgccagccaggacgcccaccagttatgtttgccacccggcttgcggaacatcatcaggcgcagaacgatcgcggtgcatgtcattacgttggtcagcaccagaggatcacttattaccattggttcctcctctccacctttgcaataacgtcagcggatcctgctcactgaaaaaagtgagtgtcttgatagccagcgcggaaagaagtaccgcgcccagcgcatcaagcggcttgtcgttgtagctggtcatgctggcgagccaggagcccaccagcccggaaccatataccccggcaaaataggaaacgatgaagtatgcagatcggcggaaaatcgtcaggtctgctgcggtggccacgtagaaaacggcaccagcgaacgcgccgaacacgacaccataatcagtgccggtcagcagtccataaatgctggcgcccgttaatgcactcgcagctgcaacagacccggataaaggttcggacatttagccccctcgtcattgctgttgatcctctcagatgaggggaaataaaaaggccacctgctggcagcccaatgcactctgtaaaagacgcccggcggacgcctttagaagaatgttattttgttgttttaatcagtggcagaagcaaaacaatcacacccgccaccagcacgccgtccgcaaggatcgacatcaacttgctggtaaagtcgatagcgatcaccaggaacagcagcacaccagcggctacccatcgcagctttgccattacaggtgattttccagacgcaggccgagcgcgttggcgatctcttccagcaccttacgctcttccgattctacttccccgtcagcttcagcaatagccaccgccacgtcgagaacgtcttctgcttcacggggatcgtgcttaacatcttcaatctcacgcagcgctgcccggcgaccaatcttaaagttggtatccagctggccgacgatcgttgcgctgatagcgttgatttcagaggtgaacgccgccagtgatggctggttgcgcagcacctgttcgatcttcgccttttctgacgcttcacactcgccgtcggcgtatgccaccaggtaagcagcgtttaccaccgcctgggccagatcccgcttttcgaacttcttgatgtcgcttactgctttacgtgcttttttaccgaaaccgaacatagtgactttccttttagggggtgagccagcgctcagaaatggtcagcccacagagacggtcacaccgaccatcactctggctcacctctgaaaggctctgtggttgaattgcgccgagcgtagcgcgggtgtgaaaaaggcccgcatatgcgagcctctgtagattctttaccacttcccggagtggccacgctcatgcccttgaggtgctgtcgcttcatcgccgctaataaccggtgcgcgtttggctgtcgcgctgctttaccggagcttgttttgatctatgatcctcacccatcactacacaggttcgccattacgcgactcggggcagcatcatgactgctgctttacctaatagctgcggtctatccgtttagatctgcattttataaccctccagaaacgaaaaaacccgctcatgaaagcgggttcggataacggtagatactaaatgcccatcgttgtaaaaaccctaaccaacttttccgaattttgcaagcattgtgttgcgaaaattacttaaaatgcttctatcgtgtgactttgcgcaaaagtttctcggcgaaagcttcttcctgccagcactttgttaccagcttatcgatgacctcagcataaccgcagtaccactggtgcttcgtcagatccggtaccagccgttccacaaccacacgggccaggctggtgggaacacgactgaagcggtgaccattacagcgaccgcagatcttctgcactggcacgccatgaagtctggtgcgcttctcatcgagcacggtgcctttacctttacagcccctgcaggcagtgctgacctctcctttcccgttacagtgttcgcacagttcctctaccacttcttgttttaccttcgcttcaacgcctctcacaccgggatgctttacgacgtcctgaagggagcggcgaacaccctccccgccacagtgttcacacacagctttgctggcagcagatcgggaataatcagcgtacgcgaaccggaccagacagccgacaatttcatgccgtgctttatcgctaagcttattcagcacagggtttctcagcgccagcgcgtaattaaacagcccttctatagcaggctgtggatcctggatccccattttggctaaaaagagattaaatccgagtgaagcctgagcctgaacaaagccctgggctgccattacatcggtgatcgtcagcgcatccccgccggtggctggcgtcacgtcgttcagcttcggtgatttcggggaataaaatttaggtaatgattcgaggttcatcgcggtctccactccgtttacgccagtacgccgatcgccagcgcgcggtctaatgtcttcagcagcagctcgggctgcgtgccatatttttcttcaaacgccttcatgtcagcgtgcaactcgtcgtgatgcgctctgcacagcgggatcacgaacaggtcatgcgctttggtgcccattccgccctggccgtagccaatgatgtgatgcggatcgtcagcaggactgctacagcagacgcacggctgcgcctttatccacctggtgtatttctcgttctcccagcgcttacgtttcgggcgtcgcataaaggactccggcgattccggatcgatgcgcagcgccagcacctgcttcgccttttcctcaatgatgctggtggccgccggcgccggtatcagctcgctttcgcgatataccgacggaatggttgccaccggcaggcgcaacgcgtggcgcgccagctcttcgggaataacgtcagccagatcgttacgcaccagccaccagcacagctccgggatcgtcagctggtgagtatcatcaaagcccagcgccattcgtacgaactcaatgagccactgcgccaggttcgtccgggcgatgcccgccaggcgctcggtggactggccgcgcagtgtgttatcgcagtgccagcagacgcggatcacgccgggcgcatgatgaaatgccgtcacgttttccatgtgataggtaccgtgcggatactgacattcaccgccgcgcatcagccagttttccaggcctgacatgccgccagcgcgcgcgatcaccttctcgttttcaaacaccggtaccagcaacggatcttctgccagcggctgcgcggcgggcgggatttgcccggacggtaacccggccagacgttccggttcgttctccagcaacatgcgcccgcgactgaaatgcgccagcaagtctgctccaggacggaacatcaccacacccagatcccggacaacgaccggtttgagaagtgccctcatgccgcttttcctttcgccagatgttccgcccacaggccgccgatccacttgatgcctttggcggtaaagcgcgcctggctgaatgcgtggttggtagttgacgaagtgccggtcttaacttcgaaccgaccgagatcgatatgctgatgatgaggtgtcagcgtgcccgccagccggtacatgatgtttttatcgatgaggaacaggcggaactctggctctttggcgccaagcagtttggccacctgacgaaacgacatggatccgcgtgcggtacagtaccggtcgacgaactccaccttcggcgccgcagaggccagctccgccgtcagcttctgcttttgctctgccagatcagcagcgaggcgaagcgcatcaggcagagattgtggcacatggatttgctgcgtctgttcgagctcctgccagcggtcaaccagccgcgcggtaaattctggagacagctgcgccacaacgacgtagctgtcacgcttgttcaccaggtagacggagaccgtctgattgaggtgatttttaacatccgccagtggcggaagttgaataatgcttcgctcagccaggcgttcgattgagcgcttcacatcgtcatggcgtgactccaccagatcggcaatttcgcggctggacattgtcagcgcgctagttacgttgattaactcgttcatgctcttctccacttattcggcgactgcactcgccacggtttcaaatttgctgatcgtgatttctacccttcccttctttatcactggcccccactccaccagcatacgttttacctggctatcgtcctcccagacaccagcgtgcgtcagcgcgtcgaacagcgctttgttgtagttgtcgatgtcccggcgtcgggcgtcaggcgggtacagaatgatttcaaccgcagcggcttccaccgacggcttaggtaagcggcgcaactgctcgatgatcgctgcacaggcatcgctctgatatttgcgcccggcggcgctgatgagatggcgcccggccagcggccccttattcggggcgcgccagtaggtgtttacgcttggaggaaatggcagcgtcagtttcatatggacaccccgcgcatttcgagaaaggtgatcgcttcttcccgtgcatgctgatcgccagccacaagcgagcgcagcagtgatatagcctcatcctctgtgctttggctgtttattgagatgccccggcttacgcccggcaccagggtgatcgcacctttgcgctgaagcgcacgtagcagttcggtcgccgcgttcggagacgccgcgcccatcaggtcggcaacttctttttgcgttggtgggataccgtgctctttctggaaagccacgatcagggataaaacttcttgttggcgggcggtcagatttttcatgctgcatcctccttcagggaggctttgctgctgaaatccttcagcgtgacccgaatagtgcgaatattgcagcgcgccgcgggatccatttctttgatgacatccagaaatgtcgggatcgccatgccatattctttcatcgcttccatacctgcgatattcagccgttcctgcatatcgacttttccctggtcattctcggggtaatttagatccagccattcgctgacagccagctgcaaacttttctcagcgatcagaacttccgccacagcaatgtcacctgcgcttaccatgacaacggtcggctcggaaacattgtcggaagcccatacgtgagcaaattttgactctttgaaggtgtactcttccttgtcgccgaacaccgcccggacacaggcccatgctttgataccgctcttcgcaagaatatctgcataactcagcggcaggatttcttcagaactggttaccggtgatggcagcgcaacttcatcggcctcatccagcgctgatacgctttcggcagcctcatcgcttgcgacaggaatcacttccggaatattttgttgctgcatctgggctaacaggcgcagcgcttcgcggcggatctgcgcaataaatgcatcaccgcgggcttccagatccttgcggtcgatgtagctgatcgccgggccgcgccagtttttgtcgaatacagcaatcgccccggcgaaaaacgctcctgacggaacctgtttttcatctttcggaatgaaccacttcggcagatcaaaaccgattcgcccgcggataaacgatatgtgatcggcatcttccggccaccacacttcgctggtggctgccttgatgagaaatacataccgaccgcctttatcgcgcatcgcgctggcgtgctgcatgatgtaccgcatcccggtgatgtattcgccgtcatgctgagatgcacgactgtaaggcgggttgccataggccgcgccatggagttcttcgagccgggctgaccagtcctgcgccagagcattgtcttcggcagtatagaaatcagggcactttgagttttcaccgtcggtaaacagatcgagcaccagcgggccgaacatggcgttgataccccagaagatgttgtctggtgtgcaccactgatcgccaacatatttgagttcatgcgtgggctggctgcgcagttcggcaagcgcctggcaatatttgttatgcatcatcagttcaccacctgaaagccctgaggccgttgtgagtaatcggtaccggaatagctcgacttaaacatcggatcttcttttgccgcggcggaaggagggattaaccagtcgtcatcatagtggccgtcagggccgaaaaatgttttagcctgtttgacaaactcggtaccgatcttgcctgtttggctgacaaatttggcatagcgtttaacgccttccagcatgacgagaggtgctaccccttcccgaacgcgggcatcccaggctttcagcgcagcacttttcgagttaccacctgcccgcttcggatataacgcccaggcctgatcaaataagttttcattgactggttcattgactggttcagataagtgactgattccgggtgcagctcctgcaccactaaccggtgcagcaggttcaccacctggtgcagcaggttcaccacctggtgcaggagattcaccacctggcgcagcctgtgcaccagagggtgcagcatttgcaccagtacgcagattgagtttgtaaacgtttgtgcggttaagcccgtttgaggacttacgttcttcaaccgaaaccagaccatcctcgaccagctgcttgatatggttttgcacagaccgctctgaaatctcacactgctcggcgatataaggaacggaaggccagcattcgccctggtcgctggcattatcggcaagtttgatcagcacaagcttgcgcagtggatttcccactttagctttcatggctctgaccattaattccatgctcatctggacctaccttaatttccctgaaatcacgcataaagatttggagcgggctgaagcattcgtgtgggtagccagaacgcagatagataacccggtgcgactctggttcccagcggatgacacggacgggtatgccccggcggtctttaaaccacctttcgagttcgcgcataacgctttcgccctccggtaatacacacccacgattgcctgcgcgcggctgtggttacacgccacccagcggtttgatattctgcgttcataccgaaacagcggctgtcccggcaccgggatcatccgcagttgcggtaagcggttatttaccgttaaactgttcatgcgttagtttctccacgttacgacacgccacgacgccaggggctgcacactcgctggcgtcactcttttctggcgcacaaaaaacgcgataaagcagcgttaaatgctcctgccacttagccattacctgatagctgttctcttcgatttgagcgcgttctgcctggtcaataactccgtcggctgtagcctgtcgaacgaagcgcgagtgctcactgatccattcaaaggtttccatgagacgctgattgatgtcggcgttatccacgtcttcgatgtccaccagcggaacattaacgctgttggactggcgtgataccgcatcggcaatgtgcttggtgccgctggcctgctgcagtaccatcgcccagcccattggaaagatctgatcgcccccggtgcgcaggcggttaaacagcgcatcttcggtaacgccaagccattcagccgcttcggcgtaaccacccggcaaactggaaatggtctttttaattgcggtcaccaaccacgcgggctgcttttcgacttgccagtgttgtttatccacggttaactccttgatgctgtggtgtcttttttccacgttcacagttactgtttcgggtagatgtcaggccgcaaatctgatttggttattgcgccggacgtgatttcttcgagctttttggcgagggagaagcctgcctttttgtagccgttgaaaaccaagcgcaggtaaccgcgagtcgatttaacgcttacagctaattcgcactgctgctctttggataaagagtcccaatactctttcataatatgtacctcctgtgtacatattacacgaataatatgaacccacaaggtacttgtacccttaaggtacacaatgtttaattctgggatgaaaacgattcaggaaattaggcggttaaacgccagaaaactgcgtgacggtgtcggcgggaacacttacttcgccaccatgatcgacagagaacctacccagaccagcaggtttatgggggatggagcgtctaaaaatatcggcgatgcgatggcgcgccatattgaaaaatgtttcaatttgcctttaggatggttggatcaggaacaccaaactactaacgttgcaaaaagtcctgacgtatcagacactaatagaaatattacattagttccggttatttcctgggtgcaggcaggagcatggacggaagctggctttgctgaggtggacttgagtagcgttgaaacttatccgtgccctgtgccgtgcggccccatgacatatatcttgcgtgtgattggcgactccatgatcgatgagtatcgacctggagacatgatttttgttgacccagagatcccggcaagtcatggcgatgatgtcatagcgcttatgcacgattccggagaaactaccttcaagagattgattgaagatggttgcagtaaatacctgaaggcattgaatcaaagctggccagagccttacataaagatagatggcaactgctccataatcggaacggtgatcttctcaggcaagccacgacgatacctccataaaaattaattttaacttgtgcccgcgttaagcgggtttttttatgcttgacaatgtacccatgcggtacataatgtacctacaagcaacagcgataggcaggacacccacgaagtagctgccggtggcgtatgaatgaccggatgattcgcacacaacaggaaagagcattggttggaacgcacatagaagcttcgttgtccgggccagtggctggggaagaatccagtacaaaccgaccggcggccagatcggtgccaggttacgcaatgctctttccgttgtgacgtgttcaagcgaactgcagcgccggccgacgcaaagacccgtaatcggctgagtcacaggcactggtgaccaataccaaaacagagcggcgggaagtaagcgggtgtagcgccccggtgtcacaaccaaaattccaataaaacgaacgtgtgtagtctgttggcggcgtctgatcttattttcccgtgagggcgccgcacttttttacccaacacacaagagcatcaccgggcgacgggctcataacccaatccacccgggcggatcccccaaccgcaggtgctcttctgtgttgtgtggagaaactaagccgtagcgcctgtgcagtggcgctcagaggacaacctaatgaataacccgttcttcaaaaacctgctggcttatcgcctcagccgcgatgtgatcatcgtcgacaacaacggcacggcgaagctggcgcagcagcttgaggcgttccgcttcactccctgcggtagccaggacttcgctaaggctggctgggtgtcgccgatgggcgcgctgtcggatcagctgttccacctcactggcggccaacttctgttggtaatccgtcgcgaagaaaaaatattgccgaagccagtgatcaccgaggagctggacaaaaaggtagcgaagctggaaggccagcagaaccgcaagctgaagaagaccgaaaaagactcgctgcgcgatgaagtgctccactccttgctaccgcgcgcctttactcgcagcagcatgatccgcatctggataaacctcaacgactccctggtgctgatcgactctgccagtgctcgacgtgcagaagacgcgctggcgctgctgcgtaaaactctcggctctttgccggtggtgccgctgacgatggagacaccgatagagctgactatgaccgaatgggtgcgctcaggatcagcgcctcagggatttgctctgggagatgaagccgagctcaaagcgatcctggaagatggcggcatcggccgcttcaaaaagcaggagctttccagtgacgagatcacctcccacttggacgctggcaagctggtcaccagactggcgctggactggcagcagcgcgtcgattttgtgctgagcgatgacgcggcaattaagcggctcaggttcgccgatgagctgcgcgaccagaacgacgatattgatcgggaagatgccgctgcgcgctttgacgctgactttgtcctgatgaccggcgagctggcttcccttctcaataacctgactacggcgctcggcggcgaagccaaacgataacccctaagcagtgacctaccccatcgcaatgggttgggttgctgcaaccaaaattcggcgcggtgcagcgcgaaataacacggagaactaacgatgtcctttattcaaaccctgagcggtaagcattttgattacctgaacgcgcaaacagacgatgttgatattgaggacatcgccactgccctgtccaatatttgccgcttcgccggtcacctgccggagttttacagcgtggcgcagcactccgttctgtgcagccagatcgtgccgcaggaatacgcctttgaagcgctgatgcatgacgccgctgaagcctactgccaggacatccccgcgccgctgaaaaggctgctgccggattaccgccggatcgaaacgctcgttgatgacctgatccgctctaagttcgggttgcccctgcatcagtccgacatggtgaaatatgccgatttggtcatgctggcaaccgagcgtcgcgatctggaaatcgacaacggtacgcactggccgattctcgaaggcataccggcatccgacctcatccagatcaatccactccgcccgggtcaggcttatggcctgttcctgaaccgcttcaatgaactgagcgaggcgcgccaatgaaagagcaaatggcaaaaatgaccatcattgagctggtcagaacggcgcataactacgccaccagcattaagcagactggtgtttattccgatttagtgggtgaaatagcttcccggcttgaagcgcttaatttggcgtatatcggattaacgaaaaaaagtaatggaatgcaatcagagcgcgatcagctgtcagcacagcttgcggatgtggtggctgagaatgcggagctgaaggctgcaattcagtcgcacagtgaatccgtccacttctgcgagttatgcggaaaagacgacccttgcagcacagatgacatttgctatgtgctcaaagaaactcccgccacggatcgcttcctggccgagcagcagtcaatcggcattcagaaagcggcggacagtggcttgttcagcaactgggttaatcaatcactcatcagctttgcgattactgttcgtaatggtgacgacttcgccgcccagctgcgcaacgaggtgaaggtatgaggccagatgaagatttagaccgttgtccacgctgtaaagaagacatgtgggtaggtcaaaagctttgccggatatgccagagcgaagaagacctggaggatgctgcatgcggcgacggcaacccctttgatgacgattattacgtcgaggtgaagcatgactgacatcaccgaactgacggcgaagctgaaagcggcggcgctgaaagcaacggcgctcaatcttgacactgcacaagttaagaggggcaacggtgggtatttagaatgcccatgctgcgaaggcgctggctacgtcgaagaagaaaatgacttctgcaacatcgacggcgtggcacttggcgtccaattctacggaataggcccgcatcacggcctggcagaagaatacttacgtgaagccaaccccaccaacatcctggcgctgacagaggcgctggaagccgcacaatctcgcatagctgagtttaaggcacgtgcggaagccgcagagaagcgctacgaaaaccgcacgccgacagagtgggcttacggccaggcatgcgcggccattgagaatcatcgtgctcgcgctgatgcagcggaagccagaatctccgagcttgaggccagaacgctcaccgtgaagctgccacgccgtcgcacatatgaagactatgcggatgccaggttcagcaatgcggatttagcggcaatccacaacgtcacggtttcttcgatgatccgaatatttgaagaaaattgcgccgccgcgggcatcagcctgaagatagagggggagtgagtatgtccagtgttatcaaaatggagtgcgtgtactccgaaaagaccgagtggtttactcctggagaaatttacgactctgaaaagcgcggcccggatacctgcttatgcggtgacaatcttgtttctgaccttaatcctgaagactggtacgaaatgagcttacgcgctgacggattatggttcctgaccggatttcagcagtcaacgctgtttcgtgcaattgaggactaacccatgacactgaccagagaaagactggaagaaatccgcgattacgacacttgcgtaacgctggaggagtcagcagaaatggcccgccgcctgcttgcggtcgaaggtcaggagccggtggcgtatttgtaccgcgataagcttcacgctgatgcgagatttagcctggagccaagatttggtaactggtcaccagaagacatcaacgagtacgaaattacggaaactaagctctacgcctccccgcagccagcaccagtagcgcagccggaattgacagtgtggtatggcgctatgccggagagcaacggcaaaaccaactggacggcaattctgcgtcgtaaagatggtgggtgcagagtgttcacaattgactgctcggaataccctgaccgcgtgcgctatgaagcagatagaatgcgctggatgattggtgaattgccagaagaaccagacattctggcttatgacgagcatctgcacagtggctatgtgccaccagtagcgcagccagtgcaggtgcctgagcctattaaacgtaacgatgcggacggatggtggatgtacaaagggcgtcgagtcggtggcggctgtgctgagtggtacaatcgggcgcttggagactggcgcgccgccatgctcaaagccgaacctgtaagccagccttacaagttgcctgaaggttggaagcttgtgcctgttgagccgacagcggaaatgatttcttccggtatagcggcccactacgaacgcagccaaattcaaatccacgacaggccggcgccggggccaatggagtgcgcttatgttgccatgctcgccgccgccccacaggagccaaccaaatgaaccacttaatgattgacctcgaaaccatgggcaacaagcccaccgctcctatcatctcgatcggcgccgtgctgtttgaaccctctaccggcgagctggggccggaattttatgccgtcgtggatctggagagctctctggtgggcgatgcagtggccgaccccagcaccattctatggtggatgaagcaaagcgcggaagcgcgggcggcgatcaccagcgataaccgcatgcatatcactaatgcgctgggcggtctgagaaggctgattgatgaaaactgcattcttagagacctacaggtctggggtaacggggcgacattcgacaacgtgatcacccgggcctcattcgaacgtcatggtttccactgcccctggcagttttggaacgaccgcgacgtgaggacgattgtcgagctgggtcgcgctgtcggctttaacccacgctacgagatcccctttgagggtgatatgcataacgcgctggcggatgcccggcaccaggcgaagtatgtttcggcaatatggcagcggttaattcctgccaccagcgaataaggttaaacacccgggtgcagccgggcaaagtggaggtaactatgcaagaagtgattcagttagcgcctaacgagtgggtttgcgaaagtgttcttatcacggtgaccgggctgaagccggggaccatcctccgggccagaaaagaatgctggatggttggacgggaatatattcacgtttccccggatggcaatccgaaaccatccagtgagtgtatgtataaccgcaaggcagtagatgcgtgggttgcctcgctcagaaataaacaacctgggtgatttgataccatgaaaaaggtaagctcacatcgctcttgggcgtcgggagggaacgatggttaaagccatatatccgacaggcgtcgaaaaccacggtggctctttgcgcatctggtttacttataaaggtaagcgtgtcagggaaaacctcggtgtccctgacaccataaagaacaggaagatcgccggggaactgaggacatcggtatgtttcgcaatccgcacagggacgttcgactatgcggcacagtttcccgaatcacctcacctcaagacttttggggtaggcaggaaagaaattacagtgaaagaactcgcagaaaagtggctggatctgaaaaagatggagatttctgcgaacgccctcaatcgctatgagtcggtcgtaagaaatatggtgccacggatcggagggggcagactggtagccgcggtgaccaaagaggatctactgtacatcaggaaggatttgcttaccggccatctggcaggactgaaaagcgattcactgaccaaaggcagaagtgttgttaccgtaaattattacatgacaacaatcgcgggaatgttccagtttgctgcagatcatggctacataaagtcgaatccgtttgaaggtattaagccgctgaaaaaagccagggtagaacccgatccgctaactcgtgacgaatttatccgcctgattgaagcatgccggcatcagcagacgaaaaacctgtggtcattagcagtgtacacaggggtgcgtcacggggaactgctctccctggcctgggaagacatcgatcttaaagctgggacaataacaatccgccgtaattatacgaaactgggtgaattcactctaccgaaaactgatgccagtacgaacagagtgatccacctgatagagccagctgttagcgtactgaaaaaccaggctgaaatgacaaggctgggcaagcagcatcagattgatgttcagttgcgcgaatatggccgtgcggagaagcacgactgtacgtttgtctttaatccgcagttggtcaggcgcagcgatcaggtaggttttgtgtataaggtcgattcgataggtgactcctgggacgcggcggttaagcgagcaggaataaggcacaggaaggcttatcagtcacgccacacttacgcgtgctggtcattatcggctggcgcaaaccccagcttcattgccagtcagatgggtcatgcaagcgcccagatggtgttcaatgtgtacggggcctggatggctgacagcagcacagagcagatagcgatgctcaaccaaaagcttggcgactttgccccatcaatgccccatcgcccacaaggcagtagtggagcatttttaaaatcagtaagttagttagtgttgcccgccatgtcaactgcgtggagggtaacaccaccctctacgccctgccgaaagcggagatcgtcacccgctggcgcgagcagactcatgatgattttcgcttctgctttaaatttccggccaccatttcccaccaggcggcgctgcgcaactgcgacgatttaacccaggaattcttcacccgcctgtcccctcttgccgatcgtatggggcagttctggctgcagcttccggcgacttttggcccgcaggcattacctgccctgtgggaatttctggatggcctgccgaaaacctttacctatggcgtggaagtgcggcatggggaatttttcgtcaaaggcgaagcagaaacgcagcttaaccgtggcctgcatatgcgtggcgttaaccgggtgattttagacagccgaccggtgcacagcgcgatcccgagtaaccaggcgattattgacgcccagcgtaaaaagccaaagctgccggtgcacgcggtagtcaccgcgcaggatcccatggtgcgctttatcggcagcgacgacatggcgcaaaaccgcgcgctgttcgacgtctggctgcaaaagctgccgctgtgggagcaaagcagcacgccctggctgtttttacacacgccggatattgcccaggccccggaactggtggataccctctggtcgtctctgcgcacggccataccgtccgtcggcgccgcgccctcaattccacaacaatcctctcttttctgaagcagtcgcgctatcatagaggtgtgccatctttgtacctttaacggagttgttatggttagcgcgctgtatgccgtgctgagcgttttgctgttgatgaagttttccatggatgttgtacggttacgcatgcagtaccgcgtctctttgggtgacggcggttttagcgaactgcaaacggcgatccgtattcatggcaatgcggtggagtacctccccgccgccctgatcctgctgctgtttatggaaatgaacggcgcagaaacctggatggtacatttttgcggcctgctgctggttatcgggcggctgatgcattactacgggttgcaccaccatctgcttttctggcgtcgttctgccatgagcgccacctggtgcgcgctgatcctgctggtgctggctaacctgtggtatatgccctgggagttggttttctccctgcattagcgcacaatacgccacttttgttttctcggatttttacgttatgcctcaccgcgacacgcttttttctgcgccaatcgccagcctgggcgactggacatttgatgaacgggtagccgaagtcttcccggatatgatccagcgctccgttccgggctactcgaatatcatctccatgatcggcatgctggccgggcgtttcgtcacgccggatacccaggtctacgatctgggctgttctctgggcgcggccaccttgtctgtccgccgtaatatcgcccatgagggctgcaaaatcattgccgtggataattcaccggcgatgatcgaacgctgccgccgccatatcgaagccttcaaagcgccaacgccggtagaggttgtggaaggcgacatccgcgcggtgcgtatcgaaaacgcctcaatggtggtgctgaatttcaccctgcaattccttgaacctgctgagcgccaggctttgctggacaacatttatcagggcctcgtcccgggcggcgcgcttgtgctgtcggaaaagttcagctttgaagatgcccaggtcggcgagctgctgttcaatatgcatcacgacttcaagcgtgctaatggctacagcgagctggaaatcagccagaagcgcagcatgctggaaaacgtcatgctgacggactcggtggagacgcacaaagcccgcctgcgcaaagccggttttgaacacagcgagctctggttccagtgctttaactttggttcactggtggcgctgaaagccggggatgcgcaatgatcgacttcggcaatttttatcagcttatcgccaaaaatcacctctcccactggctggaaaccctgcccgcgcagatcgccagctggcagcgcgacgccctgcacggccagttcaagcagtggaataacgccgttgagtttctgccggagatgactccttaccggctggatctgctgcacagcgtcaccgccgaaagcgagacgccgttaagcgacgggcaaatcagacgcatcgaaacgctgctgcgcaatctgatgccgtggcgcaaagggccgttttctctctacggcgtggatatcaataccgaatggcgctccgactggaaatgggatcgcgtactgccccatctgtcggatctgaccggacgcaccattctggacgtcggttgcggcagcggttatcacctgtggcgcatgatcggcgcgggggcgcacctggcggtgggtatcgatccgatgcagctctttttatgccagttcgaagcggtgcgtaaactgctgggcaacgatcagcgcgcgcatttgctgccgctgggcattgagcagctaccggcgctgaacgcctttgacaccgtattctcgatgggcgtgctctatcaccgccgctcgccgctggagcatctgtggcagctgaaagatcagttggtgaaagagggcgagctggtactggaaaccctggtcatcgaaggggatgaaaatgccgtgctggtgccgggggatcgttatgcgcagatgcgtaatgtttactttatcccgtcggcgctggcgctgaaaaactggctggaaaaatgcggctttgtggatgtgcgtatcgccgacgtcagcgtgacctccattgaggagcagcgccgcaccgactggatgatcaccgaatccctggcggaattcctcgatccgcttgatgtcagcaaaacggtggaaggttaccctgccccgcagcgtgcggtgttgattgcccgcaaaccgtgatcttgcggcggacgcccgcccggcggcgcaggcttgccgggcctacacgttaactttacatctttttccaaacgggttcggtttgcaacaaggcggcgacgcagcaaatccccgggagcttacataagtaagtgaccggggtgcacgaggaaagccaacgcagtggcaggccgaaacaggctggaaaaagacaaaaaaaggcccctgttgaaattgcaggggcctggtacaagcaagcatcacattgggcgacatgatgcgcggtaaaaagggttaacgaaggcgatgacgggcgatcatcgctttcatctcagaaaccgcgtcgccatcaacgccataacgggaatactcatccgcgctggcatccgaagacatcgacaatcctgaatgacgataacgcattggtgacggcgtccatcttcccgctgaactgtgaacctccgcgatacccgcgtcgagaaacagttcaaggttggaagggcgaacaccagcaccggccataatgattggaacacgggagtgtgcttttagttccgtaataaatgaaagtccttgctccgccgacgcctgctgacccgacgtaaggacgcgcgccacgcctgaatccgccagcttttcaaaagcttcgatggggttctggcacatatcaaatgcacgatgaaaagttaccgccatctctccggcagcagccattatttgccgcatccgcggcaaatcgacgttgccgtcctcatccagcaccccggtgaccacgcccggatagcccagcgatttgataaaacggatgtcttccagcatggcgctgaattccgcctcgctgtagcaaaaatccccgccgcgcggacgcacaatcggatgcaccggaatagtcacgctttcccgcacgcgttttaacacgccgtacgagacggtcagcccgccctctttcggcgcagcgcacagttcaatacgatccgcgccgtgccgttcggcaacgatcgcgcacgcctcgctgtaacaacagatttccagtaatgccacggttttctccttaaacgctgtgattaatgctcgctggcgacgatctcctcaatcgaccagggatggaatttgatcgtcaccttgccgtcgctgaccgccagcgtcggattcggcagacgctcgcgctccccttttggcgaactggttttcacaacaatgcccggctggctcaggccctcgtccgccagtagcgccagcgcacgggcgttaaggctttgcggatcgccgggcaggacgatttcgatatgctcccagccctcatggggatagcgtttttcgccgggccacggcagctccaccactttaaactgccagtgcgctaccgtcaccggctcgtgcagcttaaacaggcagatggggcgtccgttgatcagcgtttcgctgagtaactcgccgcactgctcaaggcccgtccgccagcgttcggcagtggcgttctgatgacagcgcagggaaatgtgatcggcatcaaggggtgcgatatccagaccgagccgggtggcaagttctgttaacgccagggtgaagcgcggtaaatccgcggaaatatcatgcagttcatcaattgtctgccagtgtgccatcgtcagtgcctttcacgggtcgcaaaaccgctaatttaccctgttgccggtggcttaccaaccgctgatttacagcaggcgcaactgaatgattattcatggatctgccgcgatttatttgcgcattctgcacccggtcgcagggctgacggcaggggccaattgcagtatactcccgcctttgatgatcaacatccgggtgcagccagcccttacgcgctgcgccattaaccaaaggtatcacggtgaatattcaggctcttctctcagaaaaagtcagtcaggcactgattgccgcaggcgcgcctgcggattgcgaaccccaggttcgtcagtcagcaaaagtacagtttggcgactatcaggctaacggcgtgatggcagttgctaaaaaactgggtatgcccccacgacaagttgcagagcaggtgctgactcatctcgatctcagcggcattgccggcaaagtggaaatcgccggacctggctttatcaacattttccttgagcctgcgtttctggcggcccaggtggatcaggcgctggcctccgatcgcctcggcgtttcccgccctgagccgcaaaccgtggtggtcgattactccgcgcctaacgtcgccaaagagatgcacgtcggtcacctgcgttcaaccattatcggcgatgcctcggtgcgcacgctggaattcctcggccataacgtcattcgcgcgaaccacgtcggcgactggggcacccagttcggcatgctgatcgccttcctggagctgaagcagcaggaaaacgccggtgaaatggcgctggcggatctggaagagttctaccgcgcagccaaaacccattatgacgctgacgaagcctttgccgaacgcgcccgtaactacgtggtgaaactgcaaagcggcgacgaatattgccgtgagatgtggcgcaagctggtggacatcaccatgacgcagaatcagatcacctacgagcgtctgaacgtgaccctgacccgcaaagacgtgatgggcgaaagcctgtacaacccgatgctgccgggtatcgtggccgatctgaaagagaaaggtctggcggtggaaagcgaaggcgcaaccgtggtcttccttgacgagtataaaaataaagaaggcgagccgatgggcgtcatcatccagaaaaaggatggcggctacctctacaccaccacggatatcgcctgcgcgaaataccgctatgaaaccctgcatgcggatcgcgtgctctattacatcgactcccgtcagcaccagcacctgatgcaggcgtggaccatcgtgcgtaaagccggttacgtgccggacagcgtgccgctggaacaccatatgttcggcatgatgctcggcaaagacggcaagccgtttaaaacccgcgcgggcggcacggtgaagctggcggatctgctggatgaagcactggagcgcgcgcgtcgtctggtcgcggagaaaaacccggacatgccagcggacgagctggaaaaactggctaacgccgtgggtatcggcgcggtgaaatacgcggatctctccaagagccgtaccaccgactatatcttcgactgggacaatatgctggcgtttgagggcaacaccgcgccctacatgcagtatgcctacacccgcgtgctgtcggtattccgtaaggccggtctggatgaaagcacgctgagcgacgcgccggtgatcctcactgaagaccgcgaagtgcaactggccgcccgtctgatgcagtttgaagagacgctgaccgtggtcgcccgcgaaggtacgccgcacgtgatgtgtacttacctgtacgatctggcgggtctgttctccggcttctatgagcactgcccgatcctgagcgcggaaaacgaaaccacgcgccagagccgcctgaagctggcgctgctgacggccaaaaccctgaagctgggtcttgataccctgggtatcgaaaccgtagagcggatgtaataaaaaaccccggttcgccggggtttaatttttgcaggtctgataagcgaagcgtcatcaggcgttttccctggtggcgcgtggcttaccggggctacaacctcagaagtatttgcgcaaatactccgtcagacataacatcgccatcgcctggccgtacggcatggacgtgcgcggaatattgcggtagaaatccagatccgatcccattccggtaccaaacgacgtctgcaacagctccccttccggcgaaatgttattcacgatacctttaatggccttctccgccacctctgcatattcctggctgatataacgcttacgcaccgccttcagaatgccataggcaaaacctgccgtcgctgacgcctccagataagagtgcggatcgtcgagcagtgtatgccacaggccgctgtcatcctgacatttcgccagcgccgccacctgcgcgttcagcacctgcaccagataacggcgcacggcgttgttttccggcagatccaccagctccaggaaatccgggatgacgatggtcagccagctgttgccccgcgcccagcgcgctttcgcaaagttatggttgccttcgtaattccagccgtggaaccacagcccggtttccctgtccatcaggttctgcacgtgcagcaggaactgatacaccgcctcttccacataggccgggcgatccagcagcttgccgattttcgccagcggcagcacggtcatcatcagcgtgtcatcccacatctgctgatgattttcctctgccagggtgatgtgctgcatgccgccatgttccgtacgcggcatctcgtgcatcgcccactccgcccagctttccagccacggcagatacgccgggttgcggttttcctcatagcggtacgccagcgtcaggaacggcgccatggtgttgacgtttttggtggtcgccccttccgcaaagcggtcggcaaaccaggcatcgataatatcgcgcatcgccagatcgccggtctgctggtagtactgccagatgccgtaaaggccgacaccgtgcgtccactcccagcccgcccagcctttggtatcaatgacgcgcccgtcatctaatcgcagtaagaactcaccggattcatcccgaatgttgaccaggttatgggtcactttctggatcagtgccttcagctcatcccgggcgataaaacgctccggctgacgcagtaaagggctatatttgacaggataaacaatcatttacttcacctcctgagtattgtattcagtcgctgcgcgggctttaagagagcccggggctggcttattgcgattcagatagccaatgttgttattgccccacagggattcgaacggcatacccgccagcatttccacggttgcacgcgcctgcggggtgacggtttccggcatcacgcggcctgtctggcgcattttttcggtttcttcccgcagcacgctatgggttttcagatttagtttgaagcgcagtgagaccaggaagccgcacagcagcaccgccaccgtaccgaagcagaggatcatcagaatggtatggctgacagattccacctgggtcttctgaccagaaacaaagccggacgcctgcatgatgatccccaccagcataatcgcacccgcctgggaggctttacgtgtcagggtcatgatgcccgcgaagataccttcacgacgctgcccggtgatcacttcatccacgtcagcgatgtaggtataggtgttccacggcacgtagttgatgccgccacgtcccagaccagcaatcgcagaaatcagcagcagcagcgaataaatgtcgctcatcccggcgtaataaagcacggcgtatgaaacagagctgagaccgaacagcaccaccaccatgcggtaggacggcgctggtccgaaacggatacacagcgggatcatcatgatgaccgcgatgaactggaagatcgccatggtgcccagcaggttcgacgccattgacgcatcctgcatcagcacgaacaccacatagtaagtaaagacggcgttgaagacgtcctgcgcgatatagccgcccaggtacatgcccaggtgctgacggaaaatcttgatgcgcagggtggagcttaactccgtaaacagacggctcatgctctggccgaaagtaaggtgttttttctcctcttctgcacgcagcgccgcttcggtccagtcttcacgcggccgttcccaggtgaagaaccagacaaaggtaagcatcagcgcgcacagcaccgagaacaccaggctggcataaaagaaagaaaccggattgtctttaccgaaatgggttaacagaatgcccggcaggaaggacgccagaatagcggacatctgcgccataccgatacgcgcgccggagaatttggttttctgtttgaaatcatcggtcatctccggcaccagggtttcataaggcacgaggatcatggtgtagacgatgtcgaaaatcaggtaggtcagcaggtagtaccagaatcccatgtcgccgacccacataatggagtagctaaacacggcgggtataccgagcaggataaagaacttgcgacgaccgaagcgtttacccagccaggtcgaaccaaagttatcggttaaaaagcccatcagcggactgatcaccgcgtccagtacccttgcggtggcaaagataaaggtggcttcgataggcgttaagccgcagaaggtggtgtagaagtacagaagccaggccgcagtcagcgctgtggtgcccgctccaagaaagtcacccgagccgtaggccaggtagtttgccagtccaattttacgtgtcttcattgccgcaaaccctttttgttattgggagctctcaggcaattggcgtagcctgaaaggaacattacacggctaaagtagaattatgttatgagagaaacctttctgtttctgccagggtactgacgcaactggcaaaaatgcaaagagtctcatcatgcgtgtcactgatttataaaacagtgtttctcgcggttcaaaaggcggggccgaaatatgagagccagccaccggattgcggaagaaatcaccagtggcgggttaaaagacgggcatttagcggtagttaacaatcacttcattgcggctgactttcagcgccgggatcagcctgccgccgccgggcacttcccagataaagcgtaacggctcggccgccggaacattggcgaagcccatggtcgtaccgctttcgccgtccagctccacgcagcgcgattgcgaacacaggcgcaccagcaggcccgccggggtcgggccgttaagttcgtagcgccaggccaccagcgtcatcagaccgctggctggctgcggggcggacagcggctgcgatgacgccgcctgcccacggtgactgagcgtgatgccgatactgctggcctgccacgccccctcacccgccgcctgggcgaacagcggcagggcgattaaccaggcaagatgacgcattatttgcctccgatggtggcggtcatgcggatgctgcggttatccgacagctccatgttggacagcaccaccagctgcggcagactgcggcgcaggaagcgcgacagcaacggacgcagggcatggttgaccagcaataccggcggcgcgccaagcatctcctggcgctgcagggcttcctgggtttgcgccagcaggcgatccgccagacccggctccagaccgccaccgccctgcagggcctgcaacagcagacgctcaagcggcgtatccagaccaatgacctgcacttccccgctgccagggaaccactgctgggttatggcgcgacccagcgccacgcgcacgaccgtcgtcagctcatgaggatcgttctgtaccggcgcatgttccgccagggtttccagaatggtgcgcatatcgcggatcggcactttttcttccagcagattttgcagcactttatgcagcgtggtgagcgtgaccacgcccggcaccagatcttccgtcagcttaggcatctcctgggtaacacgatccagcagttgctgcgcttcctgacggccaaacagttcagatgaatattgtccgatcagatggttaaggtgagttgccaccacggtgctggcttccaccacggtataaccctggatctgcgcctgctctttcagggcgctttcgatccagatcgccgccaggccaaaggccggatcgacggtctgctcgcccggcaatgtgcccgccgcagtgccagggttaatcgccagccagcggcccggataggcgtcgccgctgccgatctccacccctttcatcagaatacggtaacgcgcgggcggcagatccatgttgtctcggatatgcaccaccggcggcaggaagcccatatcctgcgcaaatttcttacggatactgcggatacggcctaacagctcgccatcctgctgcatatccaccatcgggatcagacggtagcccacctccatgcccaatggatcttccagctgcacatcgccccaggtggcttccaccgcctgagtattttccggcagcttcacaggcgcggcttccaccggtgcctgctgctggcggccgcgcagccaccaggcgagacccagtaacgcgccggtaaacagcaggaagacaaagttcggcatccccggcaccaggcccagcagacccagcaccgcggcgcttaacaccatcacgctcggattggtgaacagctggcccaccatctgctggcccacatcttcatccgtagccacgcgggtcacgatgacgcccgccgcggtggagatcaccagcgccgggatctgcgccaccaggccatcaccgatggtcagcagcgtataggcttccgccgcatgaccgacatccataccgtgttgcagcacgcccaccagcaggccgccgatgacgttaatcaccatgatcaggatgcccgcgatggcatcgccgcgcacgaatttactcgcaccgtccatcgagccgtaaaaatctgcttcctgggtaacttcagagcggcgttttttcgcctcttcttcgccaatcaacccggcattaagatcggcgtcgatagccatctgtttgcccggcatcccgtccagtacaaagcgcgcgcccacttctgcaatacgcccggcacctttagtgataaccataaagttgatgatcacaaggatgataaacaccacgataccgatggcgaagttaccgcccacgaggaagtgaccgaaggcttcaaccactttacccgccgccgcgccgccggtatgtccgtccatcaggatgatacgggtggaggcgacgttcagcgccaggcgcagcaaggtggtgaacagcaggatggtcgggaaagcagcgaactccagcgtacgctgggtgaacatcgccaccagcagcaccatgatcgacagcgcaatgttgaacgtaaataacaggtcaagaatgaacgccggaagcggcagcaccatcatcgacaaaataagcatgatgaggatcggtccggcaaggatctgccattgaatcgacttcatgttgccaggcaaacgcaattttgccaccagattattcatcagtgtccttctcgttcataaaatccagcgcttcaggcaccggaagatttgcaggtttaacaggtgcagtaccccccgccagacgccagcgtttcagctgccatacccaggccagcacttccgccacggcggcataaagctgccccggaatctgctgaccaatttccgcatggcgatagagcgcacgggccagcggaggggcttcaagggtgggaattcggttttcgttgccaatttcacggatgcgcagggccaccagccctgcccctttggcgatcacttttggcgcgctcattttgttttcgtcatacttcagcgccacggagtagtgcgtcgggttggtgacgatgacgtcagccgtcggcacatcggccatcatgcgacgacgcgcggcggcacgctgcatctgccggatgcgccctttcacatgcgggtcgccttcggtctgtttgtactcatcgcgaatatcctgacgggacatgcgcagtttcttaaagtggctgtagagctggaagcccacgtcaaagccgaccatcggaataatgctcagcaccaccagcagcacgcacatgcccaccagatcgagggcattgttcatcgccgtggtcggcgcttcgctgaccagacgcataatttctggccacttattccacaaatagagtccggcgaccccgcccatcagcactgatttaaggacggctttcagcagctcggccccgacctgcgcggaaaacaggcgtccgataccggtaataggattgagtttggaaaatttaaacgccagggatttggtgctgaaaatcagcccgccgagcagcaccggcgacaccagcgcaatgatcaccaccccggtgatcagcggcagcagcgcataaatcgcctctttcaccagcaaaatcacctgacccaggatcagcttctggtcgttaatgatgccgtggtcaaaccgcaagcctgacgccagtagccccgccagccgtcgggcgatcgactcaccgccaatccacacgatacttacgcccaccactaaaatcagcagtgacgtcagttctttggatcgggggatctgcccttcctcacgcgctttgtccagtcgttggggtgtgggggcttctgttttgtcgtcgctatcttctgacacagccgaagttccggagatataggtttgtagcatgatgccagagagaggccgccgcaatgggcagataaacgcgactaaaaggcggttttttcaggcgataagaaccctgcggcgtgtcacgcagcatcgggataatgcagagagtggagggtaaatccattaaccccactccccgcctgccggagtgcgcaggcggaaagcgggattgtcgatcagaaaccgaggctgtccagcaggtcgtcgacctgatcctggctggccacgacgcctgctttggtggtgtccagttgcggaccgttcagcaggctgtcgttttcacgtttggcgcgtgctgccggttccggcatgttatcgagcagcaccatcagcagctgacgctcgatttcctggatcacgtccatcatgcgcttgatcacctgaccggtcagatcctggaaatcctgcgccatcatgatgtcgagcagctgggcgttggtgaagctggtatgacccggcacgtcgcccagatactgacgtgtatctttcaccagttctttggcatccgtcagctcgataggattctcgaaccactcatcccagcgtttggtcagggatttcgcgccggattccatcgcgtcctggtgcggctgcgaggcttcaacgctgttcagtgcacgttcggcggcctgcgccgtcatctgcacaacatagtcgagacggtcacgcgcatccggaatggcttctgccgcttcggcaatcgcctgatccagacccagctcacgcaggctgtcacgcagcatacgcgtcaggctgccgatgcgggcgataatgtctccggcagcgttttcgtctgccggtttaatctgcgattgatgcatcattatcctgccctcacatgccaagtttctcgaagatcttgccaagtttctcttcgagtgttgcagcggtgaacggtttcaccacgtagccgctggcgcctgcctgcgcggccgcaatgatgttctcttttttcgcttccgccgtgaccatcagcaccggaagcgacgccatgttaccgctggcacgaatggtttttaacagttccagaccgtccatgttcggcatgttccagtcagaaatgacaaaaccgaaaccacccgcctgcagtttattcagcgcgtcaacgccatcttctgcttcttcgacgttgttgaaacccagctctttcagcaggttgcgcacgatgcgacgcatggtggaaaagtcatccacaaccagaaacttgagctctttgtccgccataaaactacactcctctttaaatacgtattgcctgtccggcactgatttttgccagcatctgctggcttacctggctaagatcgaccacttcgctaacgccacccatattgatagcctcgcgcggcatgccgaacaccacacaacttgcttcgttttgtgcaatggtccaggcgcccgcctggtgcatcgctaacataccggccgcgccgtcgttgcccataccggtgaggatcacccccacggcattacgacccgcgaacttcgccgccgaatgaaagagtacgtccaccgacgggcgatggcggttaaccgccgggccgtcgtggatcttgatttgatagtttgccccactgcgcgacagctccatgtgccgatcaccgggcgcaatataggcgtgccctggcaatacacgctcgccgtcctctgcttctttcacggtgatctggcacagcttgttcagacgctcggcaaaagaacgggtaaaacccggcggcatatgctgggtaatgagtaccgccgggctggaaagcggcagcggttgcagcacatgacggatcgcctcggtgccgccggtggatgcgccgatcaccagcagtttttccgaactgagcagcggcccggcttttaaagtggcaggcgctgccgtcggcttatgcgccgccagtttcgcccgggaagcggtacgcactttttcagcgatcatttcgctgtaggccagcatgccttcgcggatccctaactgcggtttggtgacgaaatcaatcgcccccagctccagcgcgcgcagcgtcacttctgaacccttaccggttagtgaggaaaccatcaccaccggcatcggacgcagacgcatcagcttttcaagaaaatccagcccatccatgcgcggcatttcaacatccagcgtcaggacatcggggttaaattttttgattaaatccctcgccaccagcggatccggcgcggttgccaccatctccatatcgctgtgactattgatgatttccgtcattatctggcgcatcagtgcggaatcatcaacggacaataccctgattttactcatgctttttccttactcagcgcataaacagtctgcccacggagggtgaactcacgcgcgaggttgctaaaattctccgagtgcccggcaaagagtaatccgtcgggcttaagcaagggtgcaaaccgacgcagaatgtcctgctgagtcgttttatcaaaataaatcattacgttacgacaaaaaatcgagtcgaacggcccctgcacgttgtactgtttggcgagcaggttaagcggggtgaattcaatgtaattcgccagctcctgacggacgcgcaccagcccttcatgcggtccggtgccgcgcatgaaataacgctgtagttgctgcggcgacagcgttttcagttcgtccacgcggtagatgccgcttttggctttctccagcacttcggtatcgatgtcgctggcgatcactttaaagcgccccggcgccataccgagcgaatccgccagggtgatggcgatggagtacggctcttccccggtggaggccgccgcgcaccatacgcggtactcgccactgcgtttgcgggcgtggtcagccagcaccgggaagtggtgagcttcccggaaaaaagccgtcaggttggtggtcagggagttaataaacgcctgccactcagcattactctgattcgcctccagcatgctgagatagcgaccaaaatcatccaggcccagcgcgcggaggcgacggacgagacggttgtaaaccatgtcacgcttatgatcagccagtacaatccctgcacgctggtaaatcagttcacatatccgacgaaaatgcgtgtcggacaacgccagacgttgtgtcatctgtaacagcagcgatgtttgcccggtgggcgtggatgaggtcatagcgccttcttaattactctcaggttacaacgggcacggcttcagccagtgcaccagcaggtgttgaatggtgttcatcgagcttaaatacggcgaccagcgatgtcagatggtcagcctggttagccagttgttcggtggcggcggccgcttcttctaccagcgcggcgttctgttgtgtcacctgatccatctggctgacagcaagggcgacctgctcgatcccgcggcgttgttcatccgacgcggacgcgatttcgcccatgatgtcgtttacctgggtaacggatcggacaatgtccgtcatggtctgcgcggcggtacccaccagcccggagccttgctggacgcgggagactgattcttcaatcaggcctttgatctcttttgccgcctgcgcgctgcggcttgccagattacggacttctcccgccaccacggcaaagccgcggccctgttcccctgctctcgcggcttcgacggcggcgttcagcgcaaggatattggtctggaaggcaataccatcgatcacgctgatgatgtcgccgattttctgcgagctggcggcaatatcctgcatggtttgcgccacacgggacgtttgctcgccgcctttacgcgcggtttctgccgcgctggacgccagccctgacgcctgacgggcgttgtcggcgttctgcccgacggtggcggtcagctgttccatactggcggcggtttccgccagcgacgcggcctgctgttccgtacgcgccgagagatcgttattaccggcggcgatctccgcgatgccggtgtgcatggcgttgctgccgtgacgcacttcggtcacggtgccgcgcagcgcggtctgcatgtttttcaggctggcaaaaattgccgagatttcgttacggccatacaccatgaccggtcgcgccagatcccctgcggcgatgctgtcgaaatgactgctgatgatcgccagcggttgcacgatcattttgcgtgaccagaacagcgcgctggtggtcagcatcgcggcgatgatcaccacggcgataaagatcgccgccgacatatggtaatttttctgcccggcgacgctcgcggtctccacgaagctgtcgatatgcttctgccaggccataaagttgttatcaaaagccgcctgagaggtctcaaccggcgcggtcataaaatccgacagctggttattttcaagccaggtggcctgatggcttaaatcgtcatgccatgccgcaaacgcagttttggtctgctctttcagcgccctgccatcagctgacagcgtgtcaatcgccaggaaggttttcagctggtcctgcgcctgttgcagactgttatgcgccgtaaccatcagccctttaatatcttccggcggataggccagcgcggtcagcgtgcccgctttgttcagcgcgatacccgcctgtaacatcgtggtgcgcatttgcgccagggtgttacgttgcaaattactcttttcaagctgttccagatgctgatagccatcgcgaaacgcccagaacgacaacccgttactaccgacctgcaaaatgccgcaaacaatcaaaatcagaaaaagtgtggtcgagatacgaatacgattaaacattcacgctcccatcaggtggcattgccacattgctgtcacttaaaaagtttcccagttagcatcttgtccggtgtgggtctgacgcggaactgccgcctgcgggatcgccggcgacggcgcaacgcctggctttgccggtatgccgggtacagtggcaagacggaaagcggatacggccatattcagtcgactggcttgttcttctaatgccgcggcagctgccgcagactcctgtaccagtgacgcattctgctgcgtgacgcgatccatctcggaaatcgccagcgcaacctgatcgatcccgcggctctgttcatcagacgcggaagcaatttcacccatgatgtcggtcacgcgcgttaccgcattgacgatctcgttcatggtttccccggcgctttccaccagcaccgagccggtatccacgcgcgccacggagtcttcaatcagcgctttgatctcttttgccgcctgggcgctgcggctggcgagattacgcacttcacctgccaccacggcaaagccccgcccctgctcaccggcgcgggccgcttcaaccgctgcgttcagggcgagaatattggtctggaaggcgatgccgtcgatcacgctggtgatgtcagcaattttcttcgagctgccggcgatgtccgacatggttttcaccacacgatccaccacctggccgccccgcccggcggtatccgaggcgctgtgcgccagctgcgacgcctgacgggcattgtcggcgttctgcttcacggtggcggtcaactgttccatgctggcggcggtttcttcgagcgccgacgcctgctgttcagtacgggaggagagatcatggttaccgagagcgatttcgctggtgccgctgtagatggcatccgagccctgacgcacacgggtcacggtatcggtcagcgactgctgcatatgattgacgctgtcggcaaggtcagtcatttcgttgcggccttctactgccaggctttgcgtcagatcgccctgggcgatctcgcggatatggcggatcacgcgattgagcggatcgagcaggattttacgaatgccgaaccacaccaccgccagcaccagcactaacgccagcgcgagggtcgccatctgccatttggcaaactggtagtcgctgacgctttgggtaaaggcatcctgatacagcgacgcgctgagcgccgcgtacgctttcatggcatcgcccatgccgttctgcatgccctgggtcggctgcgcgaaataggcatccatgttgccgctctccaggaattggatcagctcattaagcgcggccgcgtaggcgcggtatttctcatccagcgtcaggctggcctgttccatggacggcagcgtcggcagggctttgtaggcgtcgtagtgtttcgccgcgtctgccagcgaggcatgggcgtttttcagcagatccgttttggcgctgctttgttgattattcggatccatcatcatgcgcgccgccgagcggcttaagttgatgcgcgtttgcagcatcagctcccaggcgctggtcagctcggtctgttgcgagcggagatcgttggaaacggcgaagctctgctggttctcttttaaggaagaaaacagcagaccaccggaaaccagctgcaaaagtgcgaagaccaccagcaccatcatcagcatggtgacaacacggatacggttcaacatgcaacaacaccttattgatgacttattaacggtgttatcggcacgccttaagggaactttacatttgcgaaaagtaaaaaatcagcgcagtcctaaaaagcgacgtcaacgatcaccgtatcttcataagtcccgccagggggcgttgcctgggtggtgagcactttggcggtgtaattgaaggtgcgcgtcagggcatcggcgctgatcagtgatgaggcgctgcttgcccagcgctcggtgccggtgctaccccagcggctggtggtgttgcctttatagatctcatagctcaggcggttattgccgctcgccatgttgcgcaccgtgccgttcgcgtacagcccgttgttcagcccgacggtgtaggtactgcctttagtgcaggtgagcgtcacggcctgggagatggtcgggaagttctgcaccagcggcgagctgccaaaattgaccgccggggcggtgatggttgaacagtcattggtgacggtgccgttgacctgcagggtggtggtcagagtaccggtttgcggcgttccgcacagcccgagcgcccccagcgcacagatgttgtagttgatgcttaagttcagcgtgacctgatacggccccgcggagacgttttgcccggcgacggtacgcaaatagatcggcagcgtatagcgctgtgagcccagtaatcccagcagcgccgaggcgttccaggtatagggcgtggcgttgatggtcacttcgctgttgttattgcagccggactgcccgcacacgcgaatggggatgagatcggtcaccgtcaggttatcggtgcgcctcatggccgcgcggttactggcggaggacgaggcggtgggcatgctcacggtgatggagtcgttagtaagcaaacccagcacgcgatcgcactgaacgatcagttgtccggtggtggcctgctcggtactgttgagcgcaaaggacgtcaccgggccgaaggaggccgccacagtgctggcggaacaggccgccagcgcctgtggactgaaggccataaataagatcagtaacagaccagcgcgtagcatcagcgtttctcctgacaggtgagaggcccaaaggtttgcagtttatggccggggttgtcccctacctgcaaagtcgtataacaggttttgttgtccggggtggtgacgcgcaacgggttgacgccgtcgaggttttccagccaggcgatcccgtcgtagccgacgatggcggtcggtttgccgtcgcgccacacctggcttgccagcggcagcgcctggccttgttcatcgtgcagaatgacgctggccacccgctcctgcaccatcgggaactccaccagataaccgctttgacggcgcagggccacccgccgctccgtctctttcagccgcgtatctgcgggtaaattcagcgtattgatgctgtaactggccggataatacgcggacacgccgctgatcagcagatagccgttttcatccgtggtgcccacaggctggttttcatagttgaccggcacgccgccattgccgctggtgctgatcaccacaaaggcatcgttgattttgttggcggcaaacacctggttgtccatcagcaccagcgaccccatcgcctcgccccaccaggtgaacatatcggtttcgccatagccgccgccctgaagttccacatgattattacgccagccgagtgtggcctgttgatagctgtccgcctgcgactgacgggcatacgccatgttccagctgaagccgccgtcggtcggcatcgcatggctgtagttcacccgctgcgagttgccggaatagggccggttttcaatgctgacggcggcgctgtcgcgttcgcccagcggaatttgcagcgacaggccgaaggtccagtcaccctgctgattatcccggctggcggcgaggttaacgctgctgctgccccagaggttgcggctccaggacaggtttaacagttcggttttctcattgtcgaaactgcgcacgccgatccacgccgcgccgacgttgccgaaatccccgaggttaaaggtcagcgaatactgatcggtgttacgactgagcgaggcgaccggctggcgattgttatcatcatacttatagagcgccgtctggtcgtaaagcgccaggttgccaaaaccgcgctcgcgacggctgtgctgagtggcgatgctgaactggctggtgctgtactgatagccccagttaaactggctgccgctgttgccgcgcatccggctctgcgtccaggcggaattgaccacgccgaactgccccagttttaacaccgtccccgccccgccgagcgccagctcctgggcggcttccgtatggccttccagcgtcaggtaatcggtcaggccgtagcgcagcgtgccgcttcccgccgccgggccgtaatcaaaattgtcgataccgtaatcacgtcgcaggctgccgacggagaacgcgccatcgctgagaccgcttttcagcacttcgctggcgacataaaacggcagcgtagtgctgacctggcggccgagcgcatcggtggtgaccagcaccgcgtcccccgcgccattgacgtaaggcagattggtcagggtgaaggggccgggttgcagacgggtgtttccggcgcgatagccgttgataaagacgtccactgaagtgggtaccgccgcctcgccggaaaactgcggcagcggccaggtgaccagatccgggcgcacggagaaatcgcgcccgtagcggatcccgccgaggcgcacgctgttgctccagctcagggaatcggaaatcacatccccgacgttccacacggtggcgtcatcttcattgaccagggttaaggtggtgtcgtagcggatatagccttctttttgctgtaaatcgccggagagattctgccgctgggtgccggtggagctgagtacagcgttttgttcaaagaagcgcagctcatgccagagggcgatctggctgccgatattttccgtctggctggtatagatgtcatagttcagtagcgcaccgcgcccgtacatcggctcgctgcgctcgctgtcgccggtaaaggaggtgctgctatcccctacccattcgcgcggcacaaacagcaacagccgctggccgctgctgtcatagtcaacgcgcacctccggcagggtcgacaggttaacgtctcctggcggtaatttatccgcaggcagtccggcgcgcttaaggttttcgctgtcgataaaaaacgcgttctggcggcggatcaccggcaccacctgattcgtgtcacggtagttcaccaccagcgccaggtggaaggtcgcctcgtcgttcagcgcccgggcatcaggaggcggcggcagggcgtcgtccccgtcggcagcctgcacgctgcctgtactgccgaggctcaacatcgccatggcgatcagcgcgcgggggccgactgccatgtcgtatccctggcgttaatggttgccgtcatggctgaaggggacgtcacgcccgccggcaagggccagctgcgggtgctaccgggcagaacataacccagcagcccctccgcgagggtgcgcctttgcccgccctgctgcactttcacatcgcttaaacgcacatgtacatcgctgcggttagtgacttcaatggccggtttgccgccgtcgcgggtggtgcgccagctcagatcgcgggtttcaaccagggcatgattcgccccttcgcggtaagtggcaaccccctgcccgtacgcaaagagtgggatggaataacgcatctggatcttcaggccgatttgcggagtgttatcaccctgcggctgggggatctcatcgacgataatgcggtaggcctgctcgacacccgcaggtaccgtggtctgtttgatcaaacggatcagctgtttactgcccttctcaatgcgcacgatgggcggactggcgaccacatcctgttgggcctggtagcgctcattaccgccatcctgacgccagcgcacaatacgcacctgcatggtggtcggggtgtcgccctgattctggatccacagttcagtggccggggtatccgccgccagccagggatcgataggccataataaaatggaggccgccgcctgtgcctgcggcgcgctgatggtcagcgcggaggcgaacagcagcgccgccagacgagaatttacgctcatatacttctccctgtctcaccaggtaagggtcacggtgagttgatcgctataagtgcctgcgggactgaatcccgtcagctgcgccgcgccaaacagcgaaagcgcaatgttattactgttgctgtaggtgaccgaaactgactggttctgggcgatctccgtattggcagccagcgtgctgctgctgtacaggcgatacggcacgacctcggtgccaccgctgcggcgcatattacgcacgctggtataattcagcccgccattgatgctcatggtcagcgccacgccgggggtacagggcagcaggaatgaagagttgggcacaaaactggtggatacgcgcccgctctccacaccggtacgggtgccgaaattcagcgtcccgagtacgccgccggtgccgctggtgactgaacagcccggcgttatcgtcgctcccaccctgaatgactggctggtgacagccagggcagttccctgcatcatgagccctgccagcgccagccagaaaattgggcgcagggctccccggcttccccgctgggaagctggcgttccttcagatttcatcgtgaagggcgttagtaaataacgctcacgtttatcgtatcggtataggtacccggcacgaccgtcacgctgttaccgcccccctgaatacgaccatagagggtatagttattgacgccgcccgtagttgaggcgataggcagcggcgcgttgttggccaccacgttactgaagccgctgtcgctgtagaggctgtaggccacgccctgcgcggtattggtggtattcaccagaaagcgcgcgggcgtccctgtggtcccgaccactgttgccggtggggtggagttggtattgccggtgatttgcacggtatagctgtcggtggtgcactgaatgccgaagctgttaccgccgcccacgccggtaagctgggtggtcagcgtagaaaaggttgccgggtgttcaccaaaattcagcgtaccgaaattgataccgttctggttgggagatccgttaatcaggcagccgttggttaacgtgagggttgcgccgatagtaccgttactggttaccgcctgagcatgctgcccggcgaataacaacgcgctacccgcgaggataatacgtaattttctgttcatgttatcgcctccagtaaataagcattccgcttattgcgataatggtttagccgccgtaaacattctcctgctgatgaaataacaggattaacagaaatttagctcagggaaagggaaagaactaccaggcgaggcgcgggtcatcagggtgcctgattgacataaattatcattaattttcaatgcattaaaaaataaatcaagatgtaaataaacgtatcaacgaaggatatattatgttgcgcgtgatctgcatcacaataaatcattagcgttgctgttgtttcatttatttgccgttaaccggagttaaccgcaccttaattattacggtcggggataataatatatttgagctattttattttttgggcagaaatttatttaaaagcgggcggggaaaataaaacgccctcgcgagggagagcgttttttgtttgccgggtggcgctgacgcttacccggcaaggtgaagcatcaggcgacgtgcgtggccgccacgtcgagcagcgccatttcttcgctgttcagcagtttttcgatattcaccaggatcagcatacggtcgccgagcgcgccgaggccggtcaggtattcagtggacagcgtgaccgcgaattccggcgccgggcggatctgatccgctgccagcgacagtacgtcagaaacgccgtcaaccacgatccccaccacacgctgaccgagattcagcacgatcaccacggtgttttcgttgtactccacgtccatctggctgaacttcacgcgcagatcgacgataggcacaatgacgccgcgcaggttcgtcacccctttgatgaactccggggtgttagcgatgcgggtgacctgatcgtaaccacggatttcctgcactttcagaatatcgatcccgtattcttcaccaccgagggtgaaaaccaggaattcctgacctgatggctcgccagccagtttcgttacattactcataccggtcatgtttataccttcttacctaaatcaggcggctgtatgcgccatacgttgttcacggtttaatccctgtaacgccgaaacatccacgatcagcgcgacactgccatcgccgaggatggtcgcagcggatatgcccggcactttgcgatagttgctttcgaggtttttcactaccacctgatgctgaccgatcagctggtcaaccaacagggcgtaacgacgtcccgcgctctgcacgatcaccacgataccggcggtggcttcggttttcgcgcccttgacgtcaaagactttccacagttctaccagcggcaggtactcgccacgcacttccagaacgcgctcgccgccggccagcgggtgcagatcttcttcacgcggttgcagcgattccatcacggcattcagcggcaggataaagacttcttcgctgaccttcacggacatgccgtcgaggatcgccagcgtcagcggcagcaggatacgaatggtcgtgcccgcgccctgtttggatttgatttcgacgtggccgcccatctcctgaatgttacgttttaccacgtccatacccacgccgcggcccgacacatcggtcacctgctcggcggtggagaagcccggcgcgaagatcaacatgccgacttcttcgtcagacatattttcgcttaccgccatgccctgcgatacggctttggcgaggatgcgttcgcggttcagacccgcgccatcgtcggtcacttcaatacagatattgccgccctggtgttcggcggacagcaccagattacccacggcggatttaccggcggcgacgcgcacgtccggcagttcgataccgtggtcgaggctgttacgcaccaggtgcgttaacggatcgataatgcgttcgatcaggctcttgtccagctcggtcgagctgccgaccagcgtcagttcgatctgcttgttcagtttagtggcgagatcgcgcaccagacgcgggaagcggctgaagacatattccatcggcatcatacggatggacatcaccgattcctgcaggtcacgggcgttgcgctgcaactggcccatgctggtgatcagatcgccatgggtgaccggatccagttcgttggaacgctgggccagcatcgactgggtgatcaccagttcgcccaccaggttaatgatctggtctactttttccaccgccacacggatgctggtggattcgctggcgcgcgccggtttttcacgttcctgacggcctgcggcggcctgctctttcggtacggctttcagtaccggggcggcggctactgccggcggctgcggtgcggcctgggctaccacttctgcggccggttcggcttttgccgcggcgggcgcggtttcgaaagcaatctgatccggttcaaccacgaagcagagtacggcaattagatcatcctggctcacgccgccatcgagggtggcgctgagggagtcgctgcctttgaccacgtcacttaaggtggcgaggtttttgagttcatcttccagcaggccgacttcgttctctttcagacgcgaaatcacgatgcgcagcttatcgttgtttgccggggcggcagcaacgtcagcctgttcgtcctgcgcctcgaccaccgtcagttttgcgccgctggttgcaggcaccacttcgcctttcgcttccagcgccagctgacgcagggcattgcagatatattcaaagctggcggcatcgggctcctgagagcttttataggcgtcgagctgttcctgcataatatctttagtttccaaaaacagattgattatatcggtattgagctgcatctctccgcgccgggcttcatcaagcaggttttccatgaggtgcgtggtttcctgcaaaatggtgaagccaaacgtgcctgcgccgccttttatggagtgcgctgcacgaaagatggcattcagttgttcggaatccggggcttcaggcaccagatccaacaaatgctgctccatgtcggccaacaactcgtcagcttcatcaaaaaacgtctgataaaaatcgctaatatccatgctcacgctatcacctcggatcgggttgtggcgatgtgggaactgtcgcctggggcaacgcctctggctgttttaataaacttactggctcgttctggctctcggcattttcgtgcaaaattgcctgttccgcctgccggttgagaaccaggagactgatgcggcggttaatcgcatcatcagcgcctttgtcgctaaggcgcatggtcgccgccatgcccacgacacgcaggactttaccgtcgtccaggccgccgatgaccagctcgcgacgcgatgcgtttgcgcgatccgcggagagttcccagttgctatagccgcgttcgccattagcataagggtaatcatcggtatggcctgacagactgactctgttaggaatgccgttcagcaccggcgcaatggcgcgtaaaatatcgcgcatatacggctctacttcggcgctgccggtcttgaacatcgggcgattctggctgtcgatgatctgaatacgcagcccttcctgcacgaggtcgatcttcagatgcggacgcagggcgcgcagtttcggatcggcttcaatcagctggtcgagatcgccgcgcagcttgctcaggcggttctgttccatgcgtttacgcaaatcttccacgttcggctgacgctgcacttcccccttctgctgggtgaaatcatcaccgccaccagggattgggctgtcgctgttcgaaatacgcggtccgccggtcaccgccgtcgccagcggtgtgcggaaatattctgcgatctgaataagctctttaggactggagatggaaatcagccacatgaccagaaagaacgccatcattgccgtcataaaatcggcgtaggcaatcttccacgatccgtgcgagccgcctccgtgtcctttatgtttacgtcgtttgacgatgacaatgggatgggcctggtttttcatgcgtcctcagtcgtggtctgctggtttgggtttctgaccgcgcgcacgtgctcttccagttccacgaaggaaggacgttcgctggagtacagggttttacgaccaaactcaacggcaatcggcggtgcatagccgttcagattagagagcagcgtgatcttgacgcactgcatcatcttggtggtttcggcgctcttctggcgcagcaccgtcgccagcggcgagatgaagccgtaggccagcaggatgccgaggaacgtccccaccatcgcatgggcaatcagcgcgcccaattcagccgccgggcgatccgccgaggccagggcgtgaacgacgcccataaccgccgccacgatcccgaacgcgggcagtgaatcaccgaccatcgccaggctgttggcgggcacttccgcttcggcttcatgggtttcgatctcttcgtccatcagcgcttcgatttcgaaggtgttcatgttgccgctaatgataagacgcagataatccacgataaattcgagcatcaccggatcggcaaggatacgcgggtagctggcgaaaatttcgctctctttcggactttcaatatcacgctccagcgagaacatgccctgttgacgcgatttcgccatcaggcgataaagcagcgccagcaagtccatgtacatgcttttggtgtattttgaacggcgaaacagcagaggaagcgctttcagcgttcctttgatggctttgccgttgttgcccacaataaacgcacctacgcccgcaccaccgatgataataagttcggcaggttgataaagtgccccaaggtgtccgccggtcatcatataaccgccgaagactgtaccgagaacaaccaggtaacctaataagatcagcacgacatcatccttcactgttgactaaggcgaggagaaacagatttgcgtttggcgcggcggcggggcaaaaaaaagcagcggtaattgcttaccgctgctggagtgttgctcacaccgttcggtcaaacagcctgattaatctgttcatccagcagttgtgaattactatcggcaacttccggggaaagtttacgtctttttactgccctggaaggcggctgacacaaactacaggcgaagcttcccacgggctggtgcgcatgggtaataaaattgccgtcgcagcagttacagcgtgaaagctgcagcattccgctttcgacgaaacggaccagcgtccaggcgcgggtcagggccagcaacggcccctcttcctgctgcggacactgttctaaatagagacggtaagctttgatcacggcgtcaacgccgctgcaaaggcccgttttcagtaaaaactgccaggcgttacagaacatggaggcgtggatattctgctcccacgtcataaaccagtcggtcgaaaacggcagcatgcctttcggcggcgggctgccgcgcagttctttatagagtttgatgagtcgaccacggctgagctgcgtttcgctttccagcatttgcaaccgcgcgccaagcgtaatcagttccatggccagctgaatatcgcgcgcttcctgaacaatgcttttaccggtcataaatcaggcccttttcttccgggcaggcgtatcaacagtctgaccagcatcgctgagtaaacgtgtcgacagcaaaataccggtatgcacctgctgcaaatcgtctacacgggattcctgcgtcagacgggtgatcgtctggtggctgtcaaagcggaactggcaaatcagctgattggtttcagccagttttaccatttgcggcaatgtcagctcgaccattgtggatgccatttcttcactcatccccagacggaacatggctgaggctttgtcctgactaatcagacgctgtgcaagaaggagatatgacaaattgatgtcataaacgtgtttcagcaactcggatgtatgcatttttcccatccagaataaccaacgaaaatcttaagcggtcagaccgcaccccgtgatgtcgccgggaaaaaacccggtagaataaaaagaaaaggcaaaatgcaatactacgattcagggatgtgacgcggaggccttcgcctctttgggcgacctggtccttcgcacgctgccatcatttcttacgctaaactaagatttttcctaaatcgaggcaactgtactcgcggacactcagacatacaatgtgagcaagtagtattttgaaaataatgtgatcgacgtcacataatttaagcgaatattccgaataaatccatcaataagactattgctttgcgtcttttttgttctattgaatctgttttctattcctttcgcacgaatagacatgcaaacacctctgacctgtgcgtgaaaagaatgcactgcttttcaaagcaacggcttagcgtaaatgatcgatctctattgtagagacaaattaataataatcttataaaacaacacattatgcaggaagataaaaagcccggtcgcttttgttaacgattacaaaattactaatcctcaggattagtaaaacagcagccagggttttttatcgcgaagatttgggttaagaagcggtatttttgcaaaatggttacgttgtgaactattccagtagtaagaataattaatgaatatttattaactctgtcataaaactaacatcttttgtagttgcgctgaaacataaaaaagagtatgggagtggcaaaaacgaggaagcgggaggcgtgtcgggcaagagaaacacgtgctcccgcctgcgcgggagcacgtgttatcaggctaatttcggaaaggtcgccacgttattttgcagcaaactttctgcactacgtggcgttatgcgctttaggtcggcgataaacctcttctgccaggcgtcgatgtcatttttctggataatgtccagcatctcggcgtggcgggaaatacgttcagccagcggcatcgtcagcgcgcggtccatcgccgccgccacatcatcgcgatcgtacgggttgaccagcagcgcggacgtcagttcgttggcggcaccggcgaaacgggaaaggatcagcacgcccgggttcgccggatcctgcgcggccacgtactctttcgccaccaggttcatgccgtcacgcagcggcgtgaccagaccgacgtcagagtagcggaagactttcatcaaaagcttgcgatcaaagtgctggttgagatagtacagcggcgtccagcccagctggccgtatttaccgttgatgcgccctgcttcggtttccagttgatgacgaatatcctgatacgcctgcacatcaccacgggaagtcggcgcaatctgcgtataacgaattttgccgtgatgctcggggaatttctccagcagcgtttcaaaggccgcaaaacgctccggcaagcctttggagtagtccagacgctcaacggagaagatatttttaacgcctttcagctcttctttcagctgggccatttttggcggcagcggcccggcggcagcctgggcgatctcttttggctcaataccaatcggatagacttcagtggcgaaggttttgccccaggcggtatgcgttttcttgtctttggcgatcagacgcgtctggctggcaatgctgtcgaggaaagacacacggtcgctttccgtctggaagcccagcagatcgtaatcgcacagctgttctaacagctcggcatggggcggtaaggcgttgaaaatttccggcgtcgggaaaggaatatgcaggaagaagccgatctggtttttcacgccgcgctcacgcagctcatgggcgaacggcagcagatggtaatcgtggatccacaacacatcgtcttcttccagcagcggcagcagtttgtccgccagcagggcgtttacgcgctgataaccttcccaggattcacgctggaactgtaccaggtccagacggtagtggaacgcaggccagagcaccgcgttagagaactggttgtaatactcttcgtaatcctgttcgctgaggttgaaagaggcccaggtgatattaccgcgcgtctctttctttaagggttgatcttcattgcctgtctcaccgctccagccaaaccagagtcccccggtggctttcagcgcccctaaaatcccgacagccagaccacctgcgcttgcttttttatcatccggcggtgcaatgcgattagatactacgactaagcgactcatagccatctctcctgtttgttagcgctaatttttcttgttgtaagtgatgatcaatcatctgttcgagccactggtgtacagcagaaacgccgtccagtcgccattgtgcctgggtgtcccctaagccgactttgatcgagacgccgcccacgcggttcacgaccttaaatccttgttcatcggtgaggtcatcgcccaggaatactggtgttctgcccgcaaacggggtttcctgcataaatgcgtcgatggcggcgcctttactgatgccgcgcggtttcagttcaacaacgcatttgcctggctgtaaggccagttcatcgtgttttgcttccagcgcctgtgccagcgcgtagatagcgtcttcgtggtgcatggcctgacggtaatggagtgcaaatgccattccttttgcttcgagttcggtgccctcaagaccatccagcccggcaatcagctccagttcaatctgctttaccagctcaggcggcagcgtcaccacgtggtgttcgccattgctgtcacggcgttctgcgccgtggacgcccgcaaggggaaagcgatatggactggcaagcgcatccagctcacgcatcgaacggccggacaccagagccactgcgccctggtaaagctcagcaagttgatgcaactggtcccgcaccctggcggggatggctacctgatcgggatggggtttgatgtcagcgagggttccgtcgaggtcaaaaaagaacgcaaaattaccagaaaaaatcggcggtacagttaactggtcggccactctggtctcctccttacagttcagatggtctgctccggcagacgcatcgcattatcattagctctgtaagtatagacagtgtgacggggctcgccattttaagaaggcgttgccagccatcgggacggctggcaacgggggagataaacttaaaggttaagcttaaacagtacgcttcgctttttgcttgtagcggtcgaaaatcaccgccgccagcaggatcaaaccgcgcaccacatactgggagaatggcgaaatattaagcaaattcatggcgttctccaccgtgcccagaatcaggatcccggccaccacataggagattttgccaatgccccctttcagcgacacgccgcccagcacgcaggctgagatgacgatcagctcatagccgatggaggtcattggctgtccgctggtcatgcgcgacgccagaataatgcccgcaatcgccgacaccagacccgacagaataaagatgatgattttggtgcgcaccacagggacaccggccaggcgagccgcctcttcattgccaccgatcgccagcgtatttcgaccaaaagttgtacgatttagtaaaaatccgaaaatggccagacagataacggtgagccagataggcgccggtaaaccgagccagttagtgtaaccgagggcgaaaaaacgctcatcttcaatgccgaccgccttgccatcggaaatgatataggccagcccgcgcacaatctgcatggtcgccagcgtggtgatcagcgcgttgattttcagccgggcgatgacaaagccgtttaccagaccgctgagcacgccgagcatcagcccggcgaagataccgatccacaggctttcggtcatgttgatcaccaccgcggtggtgacgcccgcacaggcaatgaccgaggcgacggacaggtcgaaatccccggaggcgaggcagaacagcatgccgcaggccaccatgccggacatggagatcgccagccccagccctttcatgttcacaaagctggcaaaattgggcacaaaaatggcgcagccgataaacagcacggcaaacaccaccagcatgccgtactggtcccagatacgacccaggttgaatggcgacttaggcgcgccggaagtggttaaagacgacatcatattctccttgctcaggcgacagcctggctaactttaggcatggcaaggcttaacgcctgctgttcatccgcctgaccgtgtagtaattcaccggcgatctccccttcgcgcatcaccaggatgcggtcggcgaggccgagcacttcgggcaggtcgctggaggcgaacagcaccgccacgccgcgtgccgccagcgcataaatcacgttatagatttcatgtttcgcgccgacatcaatgccgcgcgtcggctcatcgagcaaaatgaccttcatctcttcggataaccagcgcccgagaatggccttctgctgattaccgccggagagattcatgatcagctgctcagcgccgggggttttgatattcagtgaacgaatatggtggtcggcgttctgtacttcccagccgtcgttgatcaggcagcctgcgcggatgtatttgcgacgggcgctgatgttgatgttatcgcgcaccgaatgcaccggaataatgccttcggctttgcggtcttccgggcacaacatcatgcccgcggcaatggcgtggccgggtttctggatgttgatggccttgccatcgatccacacctggcctgcggtgatgcgcgtaccgccaaacagccctttcatcagttcgctgcgtccggcgcccaccagcccgaacaggccgacgatctccccgcgcttcaccgacaggctcaccggcttacgcacgcccggcgctttgacctcatcaaggcgcagcatctcttcaccggtctcacgcggctgccagccatagatatcgcccagatcgcggcctaccatcgctttcaccagtgaatcatggttgaccttctccatgtcgtcgaaggtgcagacatagcgaccatctttaaatacggtaatggcatcgcttaaggcgaaaatctcctccatgcggtgcgaaacataaataatcacccgcccttcgtcgcgcagttcgcggatgacgcggaacaggttgtcgatttcacgggccgagagcgaactggttggttcatcaaaggcgatcactttggcgttacgcgccagcgctttggctatttccaccatctgccactgcccaatcgacaagtatttcagcggcgtttgcggatcgatatcgaggccgagatgctccagctgtagccgggcttcgtagttcagcagcgaacggttaacgaagccgcctttatggggcagttgtccgagataaatattctccgccacggtcatttcaggcaccagatgcagttcctgatagataatggcgacgccggcattcagggcagcgggcgtatccgcaaaggtgacgtcttcgccgcgcagggccagggtgccggtggtgggggcatagttgccgctgaggatcttcagcagcgtggattttcccgcgccgttctcccccatcagggcgtgaacctggcctgcatagcaatcaaagctgatgtcgctgagcgcttttacgccagggaaggttttgccaatcccccggaaagacaggtatggagttgactgttgcataacatctccgaaacgcttttcagtgtacgactggccctccacccggcgggtgaagggcacacttgccacgcgtattacttaacgccgagtccttttttcgccagctcttctttgaagttatcgcgggtgatcagcaccacgtcggtaacggcggtgaatttcggcggctcaacgcccttctccacccagttgtaaagcatttcgctggttttatagccgtgcacgtccgggcttggcagcagcgaaccatagaagccggtgccctgcgctttcgacagttcgctcaccgcatccacgccgttaatgccgataccgatgacatcagccgctttaaagccctgaccttcagtggcgcgcacaccgcccagcacggtgttatcgttcataccgaccaccagccagtgtttcacttccggatgctgcaccagcagagagttaccggcatcaaacgcgcccggaatatcgttcgctttggtcggcacctggtagatctgtttttccgggaagcccgcggctttcagcgcgtccatggaaccggtggtacgacggcgggcggtatccagttcgtcggcggtaatggccatcaccgcggtatctttcacgtcccagccacgtttttgcatctctttatagagttcctgcccctggcgcgcgccgatttcacttgctgccatcatcaccagcggcacggattccatcggtttgcctttcgcggtcacgaactgatcatcaacggcgatgaccttcatgtcatagcctttggctttcgccacaatggcagaacccagtttcgggtccggcgtgcagatcacaaaacctttcgcgccgctggccgccaggctgtcgatggcgttcagggttttctccccgtccggcacggcaattttaattacttcaaaacccagatctttcccggctttatcggcaaacttccattctgtctggaaccacggctcttccggctgtttcaccagaaaaccgagtttcatggtttctgcgatagcggattgtgacataacggcagccagaccgatggctgccagcgctttagtgaatttgtgcatggttaactccagctttagcgttcttttatgtagggaaaaacggtttttctgttctttaatcagacagaaaacaaagcattagccgatactgttcaggatatgcttctgctggagagtagttttagcgggaaattaatcatccataggagagcgccatcacaccgcagaattacagtaattgcgtacataaattcagcggaaaatgacataaaaaaaggcgcatttgtcggacaattgcgacgggtgccagcaaaattatccataacgtcagccagcttatccttgtcgcccggatgcgttgcacatccgggcctgttcactaccagggataatagatatgttcagcgtgttcgcgcacaggcgcgtcgtcacccagtaagcgtgccgataccgtgagcgcaaaatcaaatacgtgccccagacctttgccactgatcagattgccgtcttccactaccggcgcatccacatattcgccgtttttcactccctgccacagatcgccggagcagacgtagcgccgcccgttcagcagatcgttaccccccagtacgcgtgccgccgccgaacagatcgggcaaatcagcttacccgcggcatcgtgcgccttcacaaactggatcacctccgcgctggcggccagattgacgctgccctgcggcccgcccggcagcactaccgcgtcatacagcgtctccagccgctcggtgagggtgctgtctgccaccatcgggatagcatgatagctttccaccgcgcgggtgtcagcgcaggccagggtttccacctcaatatgcagacgacgcagaatatcgatggtgacaatggcttcggcttcttcaaatcccggtgcgagtaataacgccacttttttcattttttattccttcaggtaagagttaacttcaccataaacttaatttcagtaaaattaaactgccagttcaaagccatcgcacgtaaaacttatccccggtaaatttctgccgtttcgcctaagtgccttccaggtcacagtaattatcagcgcgatctttctatgctgtagtcagttactcataacaaggatatttgctatggctattgtcggaatggttcaaaaactcaacacgcaaatgaatcttgagtttcaggcatccagtctttatttgtcgctcagcgaatggtgcgccggacacagcctgaacggaaccgccactttcctgcgtacccaggcgcagggcaatatcacgcaaatgatgcgcgtgtttgaatacatgaaacgcgaaggggcgaatcccatcgtaaaagccgccgaaccctaccatgacgactattccacccttgaagatctgttcaaaaaaatgcttgaggagtattcgcagcgctgcgccaccctcgcccacttaacggcggaagcggcggccatgaacgatgcctgtacgctcgaatttttgcggcagctggacaaagagcagcagcaggacggcctgttgttgcagaccattatggaggaagtgcataacgcgcagctgtcgggtatgggtttaccgcaaaccgatcagcatttacttaatatcgttaatttccggcagcattaatccgccactgagacccagccccggcccgcgtcggggttgttattttttgcagctcaatgttgcaaaattgtatataagcccttgattacccgcgttttaacaaagtcgatctggctcgcaaagatcaaccttacaaaatgtaatgatttagagcatcaatgtttaattacacaggtgcttcatgatcactcttgaatttattgtcattatcctctgtctgctggtgggtacccgcttcggcggcatgggcctcggcctgatcagcggtatcggcctgttcatactgacctttgtgtttggcctgcaaccgggtaaaccgccggttgacgtgatgctgactatcctggcggtgatcggctgcgccgccacgctgcaaaccgccggcgggctgaacgtaatgatgcagtttgcagagcgactgctgcgacgtcacccgcagcacattacattgctcgcgcccttcaccacctggacgctgacgtttttgtgcggcaccggacatgtggtctacaccatgtttcccattatcgccgatatcgcgctgaaaaaaggtatccgcccggagcgaccgatggcggtggcgtcggtggcttcacaaatggccattaccgcctcgcccgtttcggtggcggtggtgtcgctggtctctattctggcggcgcagcacggcatcgggcaggcctggagcatcctggagatcctcgccgtctccgtgccggcctcgctgtttggcgtggccgtcgccgcgctgtggagcctgcgccgcggtaaggatctggcggatgacgcggagttccagcagaaattaaccgatccgaaacagcgggaatttatctacggcagcagcgacaccttaatgaatcagcgcttcccgaagcaggcgtactggtcaacctggatcttcttcgccggtattcttgtggtggtattactgggcgcgttgccggaactgcgaccctcatttgaggtgaagggcaaaatgacgccgctgtcgatgaacctggtgatccagatgatgatgctgattgccggggcggtgatgctgatcgtctgtaaggtgaatgcgtcgaccatttccagcggcgcggtgttcaaggccgggatggtggcgattttttcggtgtttggcgtggcgtggatgagtgacaccttctttcaggcgcatctggaggagttaaaagtggcgctggagggcgtggtgcagaatcatccctggacctacgcgattgtgttattcctggtgtccaagctggtcaacagccaggcggcggcactgactgccgttgcgcccatggcgctgatgctgggcgtcgagccaaaaatgctgctggcgtttttcccggcgtcatacggctattttgtactgccgacctatccgagcgatctggcctgtatcggctttgaccgttcaggcaccacccgcatcgggaaattcatcatcaaccacagctttataattccggggctgattggcgtcagctgtgcctgtgcggcgagctatgcgctggtgatggcgctgttctgatcctgccggcggggtcgcccccgccttttttcagcgcggcttccgcgcccgatcttcgaaaacatccgtttgaataattcaaaacgaaggtttactttagctagtgcgcctcgccctgcggcgtgaacttcagctcaatcagcgcaatggctttctgaatggcgcggcgggtcaccggatcggcggcagccggatgggtggtgaaatcgatggttttcagctgctgcgacattttctcacgcacttcaaccggcgcgataacgtcaatgatgtcgaggatttgtttgatcaccagctggcaggcgacaacgtcagataccagttcttgatcggcactcagggattcagacatggaaggctcctttcagtaaggacgccatagtagcgggaagcgctgcgaaaaggtagtttgcccggcctgcacagcgtacatcagatataaaaaaacctgccgcagcaggtttttttatcagaacatcgcgccaggcgggacgtctttgaaagttttgcagtaggtttcaaaaatgcttttcaggatcttacgcagtttcatcttttgctccggagaaatttgttatgcaggtgttatgtttctgtgtgcacataatatgacctgcatcacaaaaatcaaccagtttgtgaagcccatcacattaaaaaacgcattgatattttagttttgttaaaaaatgcatgataaatccgtaagttacggacatttcatttctgtaaaaatttaaaattttttttaaaatggcagaccaaaaatgagtgacagcacccaaccggaggccagacgcggcgtttctcccgccgcgctgctggtcgccggggcgttttttatggagtttctcgacggtacggtgatcgctaccgccctgccggacatggcggaaagtttcggcgtcgatgccgtcgatctgaatatcggtatcagcgcctatctgatcaccctggccgtgttgatcccggccagcggctggatcgccgaccgcttcggcgcgcgtaaagtcttcgcctcggcgctggcgatcttcaccctcgcctcggtgttctgtggcctcgcggtcagcgtggagtggtttgtcgccatgcgtattttacagggcatcggcggcgcgctgatggtgccggtcggacggctggcagtattgcgcaccacccccaagcatctgctgatcaccgccatcgccacccttacctggcccgccctggtcgcgcctatcattggcccgccgctgggtggctttattaccagtttcgccagctggcggtggatcttctttattaacgtaccgctggggctgatcgccattgcgctggcgctgcgcatcattccggatattcgcgaggaggagcggcggcctttcgatatgcccggtttcctctccacggctattgcgatggtcagcctggtgtatgccatggaattgctgggcgcgcagcagccgcaggggtggctgacggcggcgatgttgctgctgggcgcgggcacgctgttttatgcgctgcgccattttcagcgcgcccgctggccgatgatacgtctcgatgccatgcaggtgccgaccttccgcgtgaccatgtacggcggttcgctgtttcgcgcctccatcagcgccgtgccttttctgttaccgctgatgtttcaggtgggctttggtatggatgcctttcatgccgggctgctggtgctggcggtgtttgtcggcaatctgacgataaaacccgtcaccaccccgcttattcgctggctgggattcaaaaaactgctgctgatcaacggcgcgctcaatgtgctggcgctgctggcctgcgccttcctgacgcccacgacgccggtgtgggtgatcctgctggtgctttatctcggcggcgtctttcgctcggtacagtttaccggcgtcagtaccctggcctttgcggatgtaccttcagcgcagatgagttacgccaatacgctgttcagcaccgcgacacagctggcggtggggctgggcattacgctgggggcgattggtattcgtatcggcgaacgggttggcgactggctctcgctgggagaggtgccggggatcagttttcgcctggcattcgtggcgatcgcgctgatttgtctggtgggcatggcggatacgctgcggctgacgaaagatgccggcagtgcggtgtcgaataaaaagggataaaaaaaggccagcgaacgctggcctttcgggatgttatgcgagcatttcacgtacgaaggcttcgatctctttatcctggcagttttcgaagaaacactcctggaaacgctgaccggaaacggcagttttcaccagctccggatcgatggcgcgcagggtgtccagatagttgtctttcaccactgccgctttcacctgattaaggatcccggcgttacgcacctgcggctctttacgctccggcggatacccttcgcctttgcggccggtgaaggctttttcgaagataaagcgcacgttcagctctgcgccccagccaaaacctttagcgaacggcaacgccagcgcgttaccgttgttgatctgcgcgaacaggaaagcatctgccggatcgatgcagtagccgcagttcacgcccggatggatattcagcgacatcagcgcgccctgaccggtgccgcacccggcaatcacgaaatcaacggctttagagttcagcaggatgctggccatgatgcctaagtggatgtaggtcaggtgatggtcattctcgtcgctcatgccgacgttgaaaaccgggaagttcttctcatccgcgacggttttcagctctttaaggataatggcgtttttggcagcctggctgttttccatcatcagtgcaattttcattgtgtcttctcctgaagcgttgcgggatgtcccgccgtgaatagcgaacgttttagaaaccttactactaagcaaacatactttcaaatttagtgaaaaatcgttttaaaaagttgcgaggtgctcacagtttttcccgcttcgctggccgttacaattagtaaggccagaaaatccggctattcaggctattggcgggaaagagaggttgtaggatgagaacatcgaaactgaatcagagcgataccatgaagagtatgcttttagccgccgcagtcctgctgctggcaggatgcaccatcactaaagagccgcaggttagcgaggtcattcagaccaccggtgtggtacgactgaattttaacgaagccatgctgcaaaatgcgcgctttgatgagtataccacccacggcaccgccacgcgtcagtgccagcaaatgggctatgccaccgccgccgcgtacggtcagccgatccgtacctgtagtgtattcagcggttcactgtgccttaatgaaaaaatcaccctgcaataccagtgtcaggggctggcgctgtcgcctgccgccaccggctattattaatctttaccacctgcgttattacgcaggtggcgcttatttataataaaaagaattattctcaggtaatttaaccttcacatctaatgcgtattattcacattaccattcaaattaattattctattttaccttttgcaaataattaaataacaaattatagtggcgccattattcattgcgcactccctggagccgtatcatgcttaaagcagaaatgatcgaaaaattaaatgagcaaatgaatctggagctttactcctctctgctttatcagcagatgagcgcctggtgcagctaccacagcttcgaaggcgcggcagccttcctgcgccgccacgcgcaggaagagatgacccacatgcaacgcctgtttgattatctggccgataccggcagcctgccgtgtattaatactattccatcgccggttgcggaatatgcgtctttagacgatctgttccgttccacttatgaacacgaacagctgatcacgcaaaaaattaatgaactggcgcacgtggcaatgaccacgcaggattatccgacctttaatttcctgcaatggtatgtggccgaacagcacgaagaagaaaaattatttaaatccgttatcgataaattatcgctggcgggtaaaagcggcgaaggcttgtatttcattgataaagaactatcgaccctcgacgcccaaaagtaatacttccggcggtgacactgtcaccgccttaaacctctgtaaatattaaattacaccatctgtaacgcctgtttgacgagactgtcattttcccttactctgcgccgcatattcgaatgtgcaatggtttatgggcagaggaaagcgtgaagaatcggacgctgggtagtgtttttatcgtcgcgggaacgacaatcggggccggtatgctggcgatgccgctggcggcggctggggtgggatttggcgtgaccttagtgctgctgttcggcctgtgggcgctgatgtgttataccgccctgctgttgcttgaagtgtatcagcacgtccctgccgataccgggctgggctccctggcgcgtcgctacctgggccgctacggtcagtggctcaccggtttcagtatgatgtttctgatgtatgcccttaccgctgcctatatgacaggcgcgggcgaactgctggcggcaagcctcggctcctggctcgacatcaccgtttcaccggtcgccggtgtgctgttgtttaccctgattgcgggcggcgtcgtctgcgcgggcacgtcgctggttgatctgtttaaccgctttctgttcagcgccaagatcctctttctgttgatcatgctggcgctgttaatgccgcacgtacacaaaatcaatctgctgaccctgccgctggagaaagcgctggcgctgtcggcaatcccagtaattttcacctccttcggttttcacggcagcgtgccgagcatcgtcagctatatgaatggcaacatccgtaagctgcgcacggtatttattaccggcagcgccattccgcttgtggcctatattttctggcaactggcgacgctgggcagcatcaactcctccacctttatgggtttactggcggatcaggccgggctgaacgggttattacaggcgctgcgggaagtggtcgcctcaccgcacgttgaactggcggtgcatctgttcgccgacctggcgctggccacctccttcctgggtgtggcgctgggcctgtttgattacctggcggatctgtttaatcgtcgcaataacgttgccggacgtttacagaccggggcgatcaccttcctgccgccgctggcttttgcccttttttatccgcgtgggtttgtgatggcgctgggttatgccggtgtggcgcttgccgtgctggcgctgctgatcccgtcgctgctggcgtggcaaagtcgtaagcataatccgcagacgagctatcgcgtcagcggcggcaagcctgcattagcgctggtgtttttgtgtgggatcgcggtgattgccgtgcagttctgtattgcagccggtttgctgcccgaggtgggttaatagcgcttcttttattgccgggtggcgcagcgcttacccggcaagctggtgcaagtgactatcagtgcaggcagcactgcttgaattttttaccgctgccgcatgggcaagggtcgttacggcccactttttcaccggcggtgaacggcttcgccacttcaatttcctgctgattgtcggcccagtagtcatacagcgccagcgccgcaggtttaatcgcctcgatgctttcttcaaaggcttccggcgtcatctgctccacacgttcgaagttctcttctttaccgtgcagttcaatggccgccagcgctggctttaacggatccggtaaggatgaccagtcgctcaggctgacgccgcgcagataaccgaagcaccactcttccacaatggtcagctcctgatcttccacgtcgcgcgttccaaacagcggttcaaactgttccggatactcggccagacgatcgccgatatcgtccatatgctggaaagcgagcatcatgaaacgctccatctccttttccgacgaccagttcggcaccttgtcagcaccgccccacagcgccaccagccactggctcggctcaaccggcaccggcgagcttagtaccgcagtgagtaagccatccagctctgagacatccataatggacgcctccgtaccgtacttcatcagtacgtcttccagccattccagctctttctcgttcaggggtccggttttcattgtgcatattcctcggtgaggtgcgaaatacgcaccataaaaaagaaattttaccacaggtgagtagcaaaattattggcgatgcagaggtaactgtgttctcctttctaccctgcacacacggttatgccgatcggtttaaggatctcacactatgttcaacagacacagccaccattccgcggaattctggcgcgatccggcgatggagcatgtagagacccgtcgcgcctgtcatagccgggcgtgttataagtcgcacagtcatcccaccttttctattggcgcagtggatgcgggcggaagtcattttaccggcgtgtcaggtggcccttctgcattgcatcccggcatgatggtgttcattccggcgggctgtgttcacgcctgtaatcccctgcctaatgattgctggagctatcagatgctgcatcttgatgccgcctggctacgccagttactggcagaaactggtccttcctcagcaggccttattcgcgaaaatgaaattcgcctcacggataaccagacggtctatgcccggttttgccagcttaatgacaccctcttttcagcagccactacggaagacaaaaatgccgcgctaatagaatttatcggtgactgcgcctgtgagaatgatcgggtggaaactttcgccgcacagctaccccagggcaacggggcactggcgcgggtgatcagccagttgcaggaaatcgaacgcccgcccctgccgcttgaagatttggcgaaaatcgccgatatgagtcggtatcagcttatcagagcttttcgtgccgtcaccggtatgacgccgcacgcttatcagctcaacaggcgcgtgaatcaggcgcgccagtggctgcagtcaggcagtgaaattaccgatatagcataccgactgggttttgcggatcaaagccattttcagcgcgtatttaaggcgcataccggcgtcacgccaggctgttatcgggcctgagtccctgcaattttattcaatacaatcatcctgtcagcctgcaccctgtaggaaaaatttcttagagggtgatggcatgatgcaacaatttcttctggtggcaaccgcacattttctggcgctactttcccccggcccggacttctttctggttgcgcgtacctcaattaaagcgggctggcgtcatgccgcctttgtctgtctgggaatagccgtcgcaaacggggtgtttattctcgcggccttcagcgggatcacgcttttccgctcgggcagcgcagggtttatcgccattcagctcgctggctgtggctatttgctgtatgtcggccagctttttattcgttttgctggcgcaagctccctcaccggacacaagatgactccggaagccgctttgacagagaagactgatctcacagatcgctggcgtgaattcggtatgggctttatgtcgggcattctcaatcctaaaaatgcgctcttttatgtcagcctggcgacgttaatcggcggtgccggtactgcgcccggactgaaagttgtctatggcgtgtggatgttcagcgttgtgctgttgtgggatttgctggtggcgatctttatcgggaatgatgcagtgctgcgcactttttcgaaagtgttacccgctgtggagcggatttcgggggtgatcctgatttgtctggcactgagcgttattgtgatcaacgtgctgcaactgtcacgataagttagtgggatgagagcaatcaggtcagaaacggcaaatttcaggcataaaaaaaccacccgaaggtggcttacacgacactgcttatcattgattttattcgatgtttcccatggtacccggagcgggacttgaacccgcacagccataagccgagggattttaaatcccttgtgtctaccgatttcaccatccgggctcgggaagaaattggaggcgcgttccggagtcgaaccggactagacggatttgcaatccgctacataaccgctttgctaacgcgccgaaaatcttcaggtcttgcgaccagcatccgcaatatgccgatgctattaactggagcgggaaacgagactcgaactcgcgaccccgaccttggcaaggtcgtgctctaccaactgagctattcccgcaatatcttgtgattagctaatcacttgattttactatcttctggcaagcagtgccgccgtctgatgcgatgcattctacttacctgacgcactgagtcaacgatattttttcaaactcaggatcgtttgctgaaatttacggcgaaacgatcacggttcaagcaaatcgccgcgcgcggcgtttaaatattgcagcatagaccacagcgtcagcaccgcagccacaaacagcaggcctacggccgcgtattccgtaagctggttaggacgccacagcagccccaccagcgccaccatctgcgccgtggttttcactttaccgatccaggacacggccacgctgctacgtttgcccatttccgccatccactcacgcagcgcagagatgatgatctcgcgcgcaatcatagttgccgccggtaaggttacccaccatacgtgatagtgctggacaaccagcaccatcgcaatagccaccagcactttatcggcgaccggatcgagaaacgcgccaaaacgcgtgctctgattccagcgccgtgccagaaacccgtcaaaccagtcagtgatcgccgcaaagcagaaaatcagcgcacatgcaaaaggagcccagacgaacggcagataaaatgccaccacgaagaacgggatcaaaatgactcgaaaaagcgttagtaacgtcgggatattaaatcgcatagtgacgggtaactgtctgttgtcagtaaaaattagctctatgttgctacatagcccttaatgtttcaacgagtagtagatcttttctgccaggccttgcgaaatacccggcacttttgcaatttcctcaatggtggcattgagtaaaccttgcaatccgcccatgtatttcaacaacatttgccgacgttttggccctacgccctcgatagtttcaagcgtactggtatttttaacttttgcccgtttttttcgatgtccgctgatggcgtgatcgtgtgactcgtcgcgaatgtgctggatcacatgcagcgccggggagtccggcggcaggttaaagccctcgccttccggttcgaagaacagcgtttccagcccggctttacgatcggtgccttttgctacccccagtaataagggatgatgcttatcccagggaacgtccagttcggcaaacaccgcttttgcctggcccaactgccctttcccgccgtcgatcagcaccacgtcgggaactttactctcctcgattgccttgccgtaacgacggcgcagcacctggttcatcgccgcgtaatcatcgccgggggtaatgccggtaatattgtagcggcgatactcggcgcgcaccgggccattggcatcaaagaccacgcaggacgccaccgtctgttcgcccatggtatgactgatgtcaaaacactccatgcgctttacttccggcagcttgagcatagcggcgagtgccgtcatacgctgatgaatggtcgactgctgcgaaagcttagtgctcagcgctgtcgcagcattggtgcgcgccagtttcaggtaacgcgcccgatcgccgcgcggtttggtctgcacgtttacgcgccgccccgcaaccgccgacagggaatccgccagcagcgttttgtccgtcagattaaagtccagcaggatctcggaaggcagcgtgcgcatctggctaccctgcaggtagaactgaccgacgaaggtttccaccacctcgccaagctcagtgccgcccggaactttcgggaaatagctgcggctgccgagcactttcccctgacgaataaacagcacatggacacaggccatgcccgcatcaaaggagacgccaatcacgtccagatcgtcgccagtattggaaacaaactgtttttccgtgacgcgtctgaccgcctggatctgatcgcgtatccgcgccgcctgttcaaagtccagcgccaggctggccttttccatacgttcgatcagcaggttcaacacctgatcgtctttccccgccaggaaaagccggacgtaatccacctgctgcgcatactcttcctcgctgaccagtcctgccacacaggggcccagacagcggccaatctgatattgcaggcacgggcgcgagcggttgcgataaacgctgttttcgcactggcggatggggaaaatcttctgcagcagcgccagggtttcgcgcaccgcatagccgttcgggaaaggcccaaaatactcgcctttcgcatgctttgcgccacggtgcgtggccagccgcggatgggtatcggcgctcaggaaaatgaaaggataggatttatcatcccgcagcagcacgttgtaacgtggctgatacagtttgatgtagttatgttcaagcaacagggcttcagtctcggtatgggtaaccgtgacgtcgatttgctggatttgcgacaccagcgcctcggttttccgtgagccgacgttggtacgaaaatagctggacagccgcttcttgagatctttggctttaccgacataaatgacggtaccgccggcatcatacatacggtagacgccgggtttgctggtcaccgtgctcaggaaggctttgggttcaaaaacttcactcactgacttgataacgtctccgcattacacagaccatgtcgaatggccagatgggtcagctcaacatcgccgtgaatgtttaatttactgaacatccggtagcgatagctgttcaccgtcttcgggctgagattcagttgctctgagatctcattcaccttctggcctttggtaatcatcagcataatctgcaactcgcgttccgacaaacttgcgaacggcgatgcggttttttccggctcaatctgactgagcgccatctgctgggcaatgtccgaggcaatatagcgctgaccggcatacacagagcgaatggcgttaaccatctctttaggcgcagcgcctttactcagatagccagccgcgccagcctgcatcactttcgccggcagcgggttttcagtatgcacggtaagcataatgactttggtgtcagcggttgagcgcgcgattttacgcgtggcttcaaggccgccaataccgggcatgttcatatccatcaacacgacgtcgacaggattagcgcgacaccatttaacagcatcttcgccacagcaaacctcgccggaaacttttatacccttaatatcttccagaatgcgtcgtatccctgcgcgcaccagttcgtggtcatcaacaagaaggacgttgatcaaaggaaatctccagaatagggataacgctactttcagttaattctgcacatattaccgttttttagcgcaagataaaaatccaaaaatgcgcagggtacgttttcggtcaggcaggtggaaacaggactgtacaatttccggaaagaaaaagtgctaaatgacgtctaaagtggccgatttaagcagcgtttattcaaagatttaaatatcaccggataaacgaagcggtaattaatgactgtcatttaacaatatttaaccagcgggataccggctataaacatatattgtgtaacagataattatactgtttatcatttatgggattaatttgttaaacggcatcaataacgatcaaaaaacaagcactgctattttttgccggccttgtggtatactccgccgccttcacattcactggcgcattcaggcgctgttacataccgaggacgttacatgaacacacccgatttcactactgccgaaaatggccctgaactggctcaggaagtctcctgcatgaaagcgctggtaaccctgatgttacaggcgatgggccaggcagacgcaggccgggtgatcctgaagctggaaaagcagattgcccagatggaagatacggcgcaggctgacgtctttgctgccactgttaagcagattaaacaggcttaccgtcagtaataaaaaaccggctgacagtgtgttgccctgtcagccggtgtaacgttcgacacgcgaaacgtatcgtctttcagataaaccctgtcgccgccgcatagcaggctatctgcgttttattaggcgcattgaattttttctgcatatttttctggtggaagttcaccgtattctccgagatggacaggatcatcgcaatctccgccgaggtcttcccttccgctgtccacttcaggatctcgcgctcgcgtttgctgaatttcatctccggcgcggccaccgtgtcatcattcagcttgctcagcgtcagcaggctcatctgcaccagaaattgcaggcgtaactcaatctcatcatcagagcgcgttttaccgcgcacatcggtgcgggatacagaaagaaagcccatcgcccggttgggcagcatcaggcactgggtgacacccttgcgcagaccgtgatcgcgtgcgccatcccataaaggctgggcttcgctaaataaacgatcgctccacggcagatgtccctgaataaaattctcaggcctcagcaccggatcgatggcgaaataattttccgcctgataatgcgaggtccatgcgacagggtaggtggtctccagggataattttggccgcgtgaaaggcacaggatgccgcacacaaagtgagaaataatcaaattccagctgctgcgtctgacgctgtagctcgttataaacctctgccgctgatgtcatcccctgaaaaagatgcagcaactcccgtcgccaggtgaaaaagtctgtctcctgcatatataccggtaaaacccctgcttgttatcatcattattatgaatgtataaaactaacacataaaacttatttataaatacaaaataacgtcctggtgtggaataacccgcatcttattgtcgattcattgtactggtcagcattaatagcggtatttcaaataccgctttagaaatatttagaataattcagaccaaaaggaaataatgaaaccgccagataaaaaacttaacttaagataaattaaagcaggatcgcctgaggcgatccgccttttttattgcatgaggaatttttcgaggaactgccgggttcgcggctgttgcggattagcaaacagatcttttgccgggccctgttcgacaatgcgcccctgatccataaagatggcacgatcggcgacatcacgggcgaagctcatctcatgggtaacgatcaccatggtgcgcttttcctgcgccagttgacgaatggtgctcagcacctcgcccaccagttcgggatcgagcgcggaggtcggctcatcaaaaagaatcacatccggacgcattgccagcgcacgggcaatggccacacgctgttgttgcccgccggacaagcgcttcggatagctggtttccttgccgctcagtcccactttcgccagcagttccctggcgcgggtggccgcctcggttttttcttcgcctttgacgatgaccggcccctcaataatgttctccagtaccgtgcggtgtgggaacagattaaaactctgaaagacaaagcccacgcgctgacgcagttcacggatagccgctttttgcgaactgagcgaccgcccggcatcaatggcaatcttacctacccgaatggtgccgctttccggctgttccagcagattgatgctgcgcagtagcgtggtttttccggatccgcttggcccgataatcgccaccacttcgccctcttccacttcgaggttaataccgtgcagcaccgtctggccgtgaaacttcttcaccaggtcttttacttcaatcgcactcattttggatcacgctcctggcggttaagctgattttcaaaataattttgcagcgccgacagcaccgtcgccatcacccagtaaatcagggacgcggccagatacatagtgaacacttccagcgtacgggaggtgatcagctgggcctgacggaacaactccggcacctgaatggtggccgccagcgaggtgtctttcaccagactgataaaactgttgctcagcggcggtagcgccacccgcgccgcctgcggcaaaatcgcccggcgtagcgtctgccacggcgtcataccgatactggccgccgcttcccactgacctttgtcgatggaggaaatagccgcgcgcagcgtttctgaagtataggccgcggtgttgagcgacaggccaatcatcgccgccggaagcggatccagttcgatcccgaactgcggtagcccgtagtaaatcataaatagctgcgcgatcagcggcgtgccacggaagacagagatataaaagcgcgccagccagcggatcggcagcagcggcgacatgcgcatcagcgccagaataaagcccagcagcaggccaaaaaacatgccgccgatactgagctgtagcgtaaataccgccccgcgaagcaggaagggcgcggagtcgatcaccagttgtatactttcttgcattatcgttcttctgttcgcaaatcagacatgggggtggtaggcgaaaagcgccggtgcgccacctgtgtgtataaacagaaccggtccctgatccttaaagcgattctgactgataccgtcaatcaagcccgccatggctttgccggtgtacaccggatcgagcaaaatgccttccagacgcgccagcagtttaaccgcttccagcccttccggattcggcgtgccgtaggatggcgcaaaatagtcgtcccacaacacaatgtccgcgcgggtctgcacgtccagcagggtatccagttccttaaccagcgtggccactttcggctgctgatccgccacgctgcgcgataccgtgacgccaatcagctccgcctgcggcattaactgcccgaggcccaccgccagcccggcatgcgtcccggcgctgccggaggccaccaccaccgaggatatgtccaccgtatcttcgcactggcgggtgatttccagcgcgctttccacatagccaagcgcccccagcgcgttggatccgcccacagggatcacgtaaggacgaaagccctgggcttcgacgcgcgtcgccagttcatccagctggcgaaccggatcggtcagcgcgtcgcacatctctatttgcgcgctgaacagatccagcagcaggcggttgccattagtgaggtagttttcggcgcgggtgccaatggggttttccagcagcgccacgcagttcagacccagcttcgccgccaccgccgccgtctgacgtacgtggttggactggatggcgcctgcggtcaccagcgtatcggccccttcgcgcagcgcatcggcggcgaggaactccagcttacgcagcttgttgccgcccatggcaatcggcgtcacatcatcgcgcttgatgaagatctcgcggcccagataatcggaaaaacgcggcaggtactccagcggcgtgggcgcgccgataaattcgaggcggggaaaacgggttaaattatgcagggacatgaaatctccggtgctgtgtaacgaatcattcattgattatgcacggtacggcgcaataaataaaaaaggcgctctaatcagcgcctttttcgttaactgccgatgattatttcgtcacgtcagcgccaaaccacttctcagacagcgccttcagggtgccgtctttctgcatatccgcaatggcggcatcgatagctttcagcagatcgtcatcgcctttacgcacggccacgcccgcttcctgacgggagaacgcatcgcctgctaccgccagcgtgtctttggttttcttcaccaggtccagcgccgccaggcgatccaccagaatggcgtcgatacggcctacgcgcagatcctggtatttggtcgggtcatcgtcataggtacgaatgtccacgccctgtacattctggcgcagccactcttcatagttggtgccgaggcccacgccgacttttttgcctttcagatcggctgcggttttgatgccgctttcgttaccttttttcaccagcgcctgaataccagagatggtgtacggcgtggagaagtcatattttttcttacgctcatcggagatggtgacctggttaatcaccacatcaatgcgtttggagtccagcgacgccagcatgccgtcccacttggtaggcttaagatcggcttttacgccaagatgttttgccagctcctgcgcaaactccacttcgaagccagtcagtttgccgtcatctccctggaagctgaagggaggataagtgccttccagcccaaccagtaaggttccgcgttctttaactttattaagcacattatctgcagcgaacgtcgtcgcgctcatacctgctaccagcgcaacagccataacgcccatcagcgcctgacgacctaactgaacaagtttcatagtcaccccgaataagaaaattttcacgatagtgcatggtgtatggcctgttggtcaaacaccactacgctacatgttattcatttttaatatatatcagaagttgcctgaggcgcgattttctgtgcggcaataaagtgggattgtgacctgaactgggcgtacttgcgcagcgcaatccggtagttattggtgctggtcaacggcagccagggttccaggacttcatcaaggaagccatcagccagctgttcgtgagaaacattattttccgtaagatggttgccaagacggcgcaggcggacaacatactcacgcaccgtgccgtggctcatttcggtctgctcaaacagatactgtttaaaaccgataatatcgaagaaatcgctctgctctttgcagtgcaaatcgccgcagaaacgacatagcgcgacccactcttgctgttcctgttgccaggcggcttcgtccagcagggtgtcgaggcgcgaaatcgcgattttgttaacgatctcaccgcgacgcaccagcgtgatgcgatcaagcagtttgtggcaatgcgcacaatgcgtctggctgtgtttaaagtctttcaggtagcggcttaagggccgtcttttagcgtgctgcaccgtcatgataactcctggttgtcaatacgttgtgcggcattcttcaggcgataaacacgtgcctataacttacccagcttggtacgtaagcgcttaatggcctggctatggagctggctcacccgcgactcgccgacttccagcaccgcgccaatctctttgagattaagctcttcctggtagtacagcgtcaggaccagttgctcacgttccggcaaggcttcgatagcctccatcacgcgatggcgcaaattgctctccagcaactggtgtaacgggttctcctgctggtgatcgtcggtcaccagctcgatgctatcgccatgctcttcccgccactcgtcataagagaagagctggctgttattggtatcgagcaacatctgacgatattcttcgacaggaatactcagccgctgcgcgacctcggtttccgtcgcgttgcgtcccagttcctgctccagctgtcccatcgcctgtgccacttcgcgggcattacgccggacgctgcgcggcacccaatcacggctgcgcagttcatccagcatcgccccacgaatacgctgcactgcgtaagtggtaaatgccgttccttgcagagcgtcgtaccggtcaactgcattcagtaaaccgatgccgcccgcttgtagcagatcgtccagttccacactcgccggcagacgcacctgcaggcgcaatgcttcatgacgcacaagtggtacataacgctgccacagcgagtgtttatccattacaccttcagcggtatacattgaattcacgataaacagccctgcgttaatgagttatcggcatgattatccgattctggagggcttttaatcggatgaatagtgggtgaaatgggcggttatttgccttcattaagccaaatcctaagcgcggaagcataaaatgtacaaaaaatacctgttaatcaacagctcagctaaaaacctgttttagctcacaatccataataaaattgcgcgtgtcatcgacaaaaaaatagcgaacggggaacattaccttgcttccccgtttcatctttatgcgcttactggtcagaccggaataaagtaaaaaacggtttccagcaccccttcggtatagtggcgcagatacagcttataatccgatcggaacgagaagaccagctcaggcaatttccagtaatcatcaacccggtgatagcagcaaatcgccagcgccggatgatgcgtaataatcgactggcgcgcgccttccagcgccgcatattcgtggccctctacgtccattttgataaaggtgggcgcttcggttaccagcgaatcaatggtatcgacgttaataacgatatcgccgttatcatcaaggtgtgaccagctgccggaggaggtgaatgtcagcgtctctttcttatttgaggcaccgcactgatgataataaatatcacgttcgtttgttaatttttcctttatcaccgccatctgccgcggctcaggttcaaacagatcgacccgatgatacgccggacagcggcgaataaactcgcgcgccgtttcaccgtcaaaactgccgacgtcgacaaaaaccggtttttccgtatgcagattaacaaagggttcgaaatagctttcctgggggcggaacgtaaaccaggacatcaggttaagatcctcttccagcctgaattttaccagccgggaaaaggtttcgcgtgaaatgtcatccgccagcaaagccgcgatacgatcgtatttctcgcgattgttccggtaatcgtcctgaaaggctgcggatgaaacaaacgcgccttcttttagcgggaaatcaacgtagtttttaaatgaaaaatagtcgataacctgtctgccgctgcttttcagcaggcgatccacgctcaccggacggccatcgacaattgcagacagcacgatggcgtgctgcggaacatcagccatttttaccaccggcaggccggcaaattcgcgctcagtggtaaaatcatcaataacgccatccggcgttatatattcagcgatgctggccgcataaggcgtacgcccgaaaatataacggggaacctctccccgcataaaggcgtcgcagagtgggcgaaggtgctcgctgcatgtattcgtcatgaaaacctcattcacaatcacttgatataaaaatcgacggcgtcgacgtcgagcaccagcacatcttcccgctgcgcgacatcaaggcgctccgggaaatagttatcgataaaaatggccggaccgctgatatacgccgatttcttttcaccttctttgaggtgaataatctcatcgaacagcagcggtgaaattgccgcgcgatgcagggtttcaatcggctcatgtacatggcgggtaattaaataaaggcgcttgccgtctatccggcactgatataaaaacgccagcaccgtgggattcggctggccgttgatgatcagcgtatcgtcaaaatcgacatacacatgctcatactgcaatgcggtatcagcgcgtgtgcggatggcgcgctcaaccagcgtgacgtgcggcgttaccagcggcgacacgtcgcgccccatataatcatgcagcgccatcagcggtaaattcaccccgcgggcgcgttgcgccaccatggtccccgcgacacggcaggagatttccagcagcttccagcgatcaaagcgatcctgtttaagctggaagaaccaggggccgcgcagagttacgcgttcattgatctctgcagcgatggtggcaatctcatcatccacaggaagcaaagtggaacgcatggcgatccccgctctgatacgctcacgagtacgcggcccggcccacaccagcttgccgttgcgatcggtaaaacagtcgacggtgacttcccggcccggcagatattccacgatcaccggcatgtccatcgtcgttatcgcctgcgcaagctgttgcgcatcggcggccagcaccacgccgttaccaccctgcccgcagtcgggtttgacaatcaccggccagtgttgtggttctgcgcccggcggatacatttcaggtacccagtccgtacccgcaaaagcctgataggtgagactctttcgccgcgccagttgggtggtatgcggatcgccgttcaccagataacagcccgctaattccgccatgcccgcgagtttttcacagacggtatcatgggtggcgaaaatcacatcaatctgttgtgttttcagcagatcgccaaaataaccgttgaatgccggatcgtgaataaaaggcacatcaccgatatagtcagaaaaatgaaaacgaccgtgatcttcaacgctggacgcgccaattaaacggttaacgtgcagggaataacgcagtgactgagctatctcaccggcattttctgaaccgcagggaaacaccagtacgtttaattttttcattattattcagtccttatcgccatcttccaccactgccctgacaatgtcgcttaattgctgcatatcgctttcgctgtaacgctggtcgcacggcaagggaaccatataattgacaaaatttgcttcaatgctgtccgctgtaacgcgatccagtacttcccgccagtaggtcgccacaaagacgccccgggcaattaatgccgcatgcaatgagcgggcaggaaaataaaacgggtaacaaaaagggccgctgacgggtaatgcaggaaagcgaaacgcattcagatccgcaagacgggcgcggagcaggcgataatttcgctcgcggatctgctggatctcgcggtaatttaccgcgcgcaataacctgtcggtcagtgccgacatgccgctggccgaaatggtgctcagcgccgcttccgcctgcaaaaacgcgccatagcctgaccgggtatcgtattcatgctgcagcaataaatgcgcggtatgactgtgcgtctcttctgtcggctcatccgcaggcggcagggttattgccgtttgcagtaatcccccgtcggcaacgccaaagaatttacgcggcgaccagagacaggccagcgcctttggcggcggggaataaaatccctgggagcgatcgataataacgctttgcgccggtaacaggcgtaataacctttcgctctgcgcctcgcagtggcctaaataatcgacgtataacagacagtcatccacgccgaatgcttcagataactgcggaaaatagtcgtcatccagctgataccagatgatttccacgccggatgccatcaccgcatcgattacgctctgacaaattaacaccggcatccagagccgctgcggacaacgggtcatcagcaggtgataaagtgcattgcgggcagagcgatattgccgtgcgtgcggataataatgtgattgcggggcaggtaattctaacgggaaatagccgccgaaagttttggttgtcatgggcggctttactcagtgtagtgataatgatccagcgcctggcgcacggcatccggagtgcagtacatcagcacgtcaataatggacaaattcggcacaaattcaggcgttccctgatcataggcaacattatttgcctgcagaaaacgcagggcgatcccttgtgccgcgaaagctgcggcagaatagagatgtcgcccaccggtactgttaacgtagatatcgccgctcagcgcgttgcacatgccgatcactttattttcggcattctccgtacggtcatagtcgagttcggatgagcggatcagccgccgcgtcaggccgagataagcgaggatattttccattccccgctggcaacaggcggtaatatcacgatcctgatgcagtaatacgtcctcgataagcggcataacgtcagaatacgccggggcgtgccggtaactctggcgcagcgtcttaagcagcttctcaacctgagtatcaaatgccagttcgccaatacgtttattggatgacgcgccgggcaccggcagcgtaaagcgctgcgcctgccccgccgctaacaacgtattgcggttgatgtagccctgtttgatgtagcaggcatcgtcataaagcacgaaaacgtccgcctgcgccagcagttgaaaatagccaatccacgggaaaagatagggctgcatgatcgacacaatcatctgcctgccctcatcaaccggcttcgtccattttaggctccacgcccaccagcgcggcggatttaatgatgtcggcgatgcgcatctgatcgtgacgcgccagatccggataaatgggcagacagaggatctcttccgccacctgattggctaccggcagcagcgatttggcggcgctgttcagcccgcgatacatcgggaagctactgatcaacggataaaaatagcggcgcgacatgatgccgttttgtttcagcagcgcataaagctcgtcacgcttcagggggtaatctttactgatgcgcaccgggaaataggcgtggttccagtcggtgctttccggcaccgagagcagcgtcatgcccggcacgtcggccagcagttcgcggtagtacgcatcaatagccgctcgcttatccagcgcgtcatcaatatgctgcaactgcattagcccaaaggccgcctgcagttcgttcattttgccgttgattcccgccgccaccacggtggtctcatcggcaaaaccaaagtttttaaggtaatcaatacgctgcttcattttggcgtcacgacagacgatcgccccgccctcaatggtgttgaatactttggtggcgtggaagctcagcacggaaagatcgccgtgattcaggatgctgttgtcctgctggcgaacgccaaaggcatgtgcggcgtcataaatcactttcaggccgtaaatatcggcaatgcgctggatcttgtcgacatcacacgggataccgtagcagtgcaccggcataatggcggtggtctgcggggtgatcagctcttcgatgcgctcggggcagatattaaaggttttcggatcaatatccgcgaataccggcgtcaggccgttccacaacagagtgtgagaggtggcgacgaaggagtatggcgtggtgatcacttccccggtcacgcgcaacgcctgcagagcagttaacagcgccagcgtaccgttggaaaacaggcagacgtgattaacgccaagataccgggcaagggcttcttcaagctcctgatggaattcgccaccgttggtaaggatcttgttctgccagattttctcgagatacggcatgaatttttcgagagggggcaaaagcggactggtgacaaaaatgttatcgcccatgagcaagcctgcaaggtaaagaggaatgttctcataatagcgaggggggcatggagcttatcggtaaaacaacaggcattttacgccctatttgaggtgaacgctcagacaggcgcagggtggacagtcgcagaaacggcccaccctgctgatggccttagccaggcagccaggctttcgcccactgggtaacgttatcgctgttcagcgtccagtcgcgtctgatttcatcatacagttcacgtcccatacgttcactggcgcctgcgttatccagatggaaacgaatcgcatccacccagtctttataacggtttttcacccgcgtgaccgaattaatggtctgataacaggccacgtcgctgcaaataaccggaatggcgcaggcaccgtattccatcaggcgcaggttacttttacaggcgttgaagatgttgtcttccaccggagccagcgccagatcgagattcagcgacgccagcttttgggggtacatttcaatatcaatacctgagtggaattcatggatccacggcagcagttttggcggacacatgccgaagaagacccactccacttcatccgcaaaggctttgatcacatcggcgatcatttccagatcgccggtatggctggagccgcccgcccagccgacgcgcggttttttaccctgctgacgtaagctggttaacccgccccaccagtcttccggcagacggttatgcatcaccacaatatccgggtgcaggtcggagaacgcttccgccagcggcgcggtagaaaccacaaagcggtccatatagctcaggcttttgcgcagcatcttaatgacatccacgctgaattccgcgcggtgcacgttctttatgggcaggttagtcagataatcatccagctcatacaccataaacgtattatcgatgcgggaaacccgcttcgcccaggcatgaaattccggggtcagctgacgctggaagataatactgtccggctggaaacgtttcagatacggaatactgaggaaggtttctgataattttccgtcggcaatggcgaggcgctccatcgcctcaaagggtttgatgacgcggtaataaccacatccggcgtaatccgccatatgagggatcaccaccggcagcggtttccaggacaacggacgccagctcagcaggctgtcagggcagaccataaactgctcgctgctgagcgacaggttggtgttgtacgccggatcgctggcgatctgcggctcccagcgtctgaacatttcatcttctgccgtctctatcgcctcctggcgtaccgcttcatccttttcactcagggccactttactcgccaccgagcggatcacagttgccgacggcgtccagacggtcagccagccctgagcgcgggcgcgcagacataaatccacgtcccagaagtcctgaatagtctcatccacgccggacagcgtgttaaagacgtcgcgtttaataaccagcaaatcgccggacaccgcgctgtagttctgatcgaaatgcaggcgacccatatgacctttatcgtcattattcgccccgaagaaggcttcccctgccacaccgtttaagcccagcacgtaaccggcatggcgcacggtgccgtcgctgtacaactgcttgccgccgacgatcgccacctccgggcgcagcgcgtggttaagcagttttgacagccagtctggctggctgatgatcacatccgggtggaggatggtgagatattccccctgcgccagggttgaagcctgattgatggtcgccgcgcggctaagcaccgcatcggtgagcgcgaccttaatgcgctgcggatcgatttccgccagcgacgccatccactgctgcatctccagcggcgcggcgccatcgcccaccacgatcagctcataaggcgaccaggttgttttttcgataagcgaggttacgcaggtgatcaaattagccagcaccctgcctgccgggatgatgatcgacaccagcggcgcagtggcgtggacataatcaatatggcaatgaccataaatatcgcgggtcaggcgcgcgtggggatagccacggttcgtcagatgacgcagcaggatctgattttcttcttttaccgcaagcgtgcgatccggagtaataaacagtggctcggccaggtgaccaatggccgaaaaaccattgttttcaatcaggcgcaccagaatatcgaattcaaaggcagctccggcctgcacatcaaatttacccacctggtttacgatctcgccgcgcagcagccagccgtaccccattaccgcagggttgcttaaaaacatatccaggctgaagtccgggcggaaacgcgcgccgatgggctgatcgttaacgtaaaagatttcgtcgccgcacaccgccagcaagcctgtggcttcaaccagcgtggttgacagagagatcaggccagaaggggtaaaagtggtgcccgccagcaccaccagatgccaggcctgcggcgcggctgccgcccgttcattcatcacatttacgatgcctgaatctgcgggcaatgtcgtgacaccctccagttcgaggtcggtgatgacaacaggcgtaattatcagcgaggaaaaatagcggctgttcaacgaggccagcgtgctgtatatcgccgtggcggtcgcctgacggccatcaatcagcagggttaactctgccgcttcacgccctgccagatgatcggcaatcagctgttcctgggttgccgtcagttttctgaccgacatccagtgctcgaacatgctttgtttcaggccatcttccagctgttgctcaatattttctacgcgtacggcggtcacatcatccagcggcgctacgcgggcaaacccaggcgcaacggtgtcgtccgcgccccaccctttgagggtcaggagttccgggaatcgtttatgggattctgccgcccttttatccttcatacgtcccagttggctgacctgttggtgcgaaaccctgaagctcgacagcggctccaccagataggccagatcgctgttgcgcagaattttggtgtacatcaccaggtcgccgagaaaatacatcagctcgccgtcaatgttacacagacgatcttcatgggcgattaacgccagcagatcttcccggtaaaacagcaccgtactgggttcaccgataaagttgacaatgcccttgtgctgaaaacggatcacatcgttaccgttcagtaccgaatcggcttttaccggcgcggcattggctctgtcgtccaccatacgctcgcccttgacatcaatacgatgacggcgcgaggtggcaatgcgaatagctggcgatttttcaatggcggccaccagcgccgacacgcagcccggcgccagcacatcgtcatcgaacagatatttaaggtatttcccttccgccatttcgatgcactgctcatagttaagcagttcaccgagcgccggtttattgcggatataacgcagcggcacagcggtttttttctgccacttttcgacaatgtccttgatctcgtcagtcgcgcaatcgtcgctgacgatcacttcgaaattactgtgatcctgagacagcgcgctgcaaagcgcctcttcaaaccaggccgatttatacgcgggtattacaatactgacgagagcgggctgtgccatggataatttcctgatgtgcttccaataccaaccgttaacctagcgcatttacgttttttcaatagcgctaaaaagagggcaaaccggggggatttctgcgggtttacgcttattcgggcataaaaaaacccggcagcgccgggttttgtttttctgcgtaagaattaacgcagcagggacagcatggtctgcggaacctggttggcctgagccagtacagaagaaccagcctgctgcaggatctgcgaacgggacatgttggaaacttctgtcgcgtaatcggaatcctgaatacggctacgagcagaagacaggttgctcacggtgttgttcaggttagtgatggtggactcgaaacggttctgagacgcacccagcaggctacgctgagagtcaacagatttgattgccgcgtcgatgtctgccagcggagtggtaccagaagctgcaccagatgcgccgccagtcactttacctttcagtacgtcaaagcctacagcttcggtggtacgtgcgttaccgttaacaacgtcggtaccggaaaccatggatttggtgttcagcacagtaccggaagaaccagcagaagccaggttgaagctgtcgctggagctgattttgatgccgatagtttcagcgtctttggaaccaacctggaagttgtaggtgctggagcttgcaccggtgttcagcactttgatgccgttgaagtcggtctgcttggttacgcggtcaacttctttcatacgttcgttaacttcagcctggatggagtcaacgtcggatgcggagttggagctgttctgcgcctgaacggtcaggtcacggatacgctgcaggttgttgttgatttcgctcagcgcgccttcagcagtctgcgacagagaaataccgtcgttcgcgttacgggcagcaacggtcaggccgttgatgttagaggtgaagcggtttgcaatcgcctgaccagcagcatcgtcttttgcgctgttgatacgcaggccagaagacagacgttcgatcgcggagcccagggaagactgagatttagtcaggttgttctgagtcatcagcgacaaggtattggtgttgatcactgccatggtatttatccttaattaatagtgttaatgctatttcggcatgtgcccaacggcctcatcgccttcaataatgttatcgacacgtgatgcagaagctttagcctttacgtcgatttattttgattatttctgcgcgtaaaaataaaaaaagcgccgataaacggcgctttttgcataaagctaaattgcgaattaacgcagcagggacagcatggtctgcggaacctggttggcctgagccagtacagaagaaccagcctgctgcaggatctgcgcgcgggacatgttggaaacttctgttgcgtaatcggaatcctgaatacggctgcgagcagaagacaggttgctcacggtgttgttcaggttagtgatggtggactcgaaacggttctgagacgcacccagcaggctgcgctgagagtcaacagatttgattgccgcgtcgatgtctgccagcggggtagagcctgctgctgcgccagttgcgccgccagtcactttacctttcagtacgtcaaagcctacagcttcggtggtacgtgcgttaccgttaacggtatcggtaccggaagccattgctttggtgttcagcacagtaccggaagaaccggctgctgccaggttgaagctgtcgctggagctgattttgatgccgatagtttcagcgtctttcgcgccaacctggaagttgtaggtgctggagcttgcgccggtgttcagcactttgatgccgttgaagtcggtctgcttggttacgcggtcaacttctttcatacgttcgttaacttcagcctggatggagtcaacgtcggatgcggagttggagctgttctgcgcctgaacggtcaggtcacggatacgctgcaggttgttgttgatttcgctcagcgcgccttcagcagtctgcgacagagaaataccgtcgttcgcgttacgggcagcaacggtcaggccgttgatgttagaggtgaagcggtttgcaatcgcctgaccagcagcatcatcttttgcgctgttgatacgcaggccagaagacagacgttcgatcgcggagcccagagaagactgagatttagtcaggttgttctgagtcatcagcgacagggtgttagtattaataacagccatgatggtattcctttgaaaaagttatcagattcaggcttccgcctacggttttctcaccgtcaacctgattatcgacagctcctccacaacctttagaaaaaaagatcatttttttaaaggcgcaaactgccggttaatgaggggctttattccgccattgttttttctaaaagactctaatcttttcgctgtcgctgccgatagaccatccagtgattgtctaaataagaaaggatgaatcaatggcatcgataagctcaatcggcgcgggtaccaacctgaacctggatactttatatagcaacctggaaaccgccgaacagacgaagttaagccctattacttctcaacaaacgtcttttaaagccaaactgaccgcatggaacgtggtgcaaactgcgctgaataaagtacagaccgcttccgatgcgctgaaaaatacctctgctatcgcctcggccaaagtgtccagcactaataccgcgttcagcgccgtgctgtctaatagtgcctctgcggggacgtactctgtagaagtgaccgcgctggcggcgtcacagtcgctgctcagcccgaaagtggccagtaaagataccgatctgggcgattccagcctcgcctcacgcaccattaccatcgcgcagccgggccagaaagatccgctgacggtgacgctcgcggcggataaaaccagcctcgcggatgtgcgtgatgcgattaacgctaaacagggcagcgtcaccgccagcatcattaaagcggacgacaacagctattacctggcgctgacctcccgtgacagcggcacgaaaaatgccatgaccgtcaccaccaatgacagcgagctggcaaaatacattggttatgacgccaccggcgctaacccaagcaatatgacgcaacaggttgccgctgccgacgcgaaagtgaagatcaataacattgagatcacccgcagcagcaacagcatcaccgatgcgccggaaggcgtgacgctgaacctgacgaagctcactaccggcaccccggaaaccctgacggtcgttaaagataacgccccgatgaccgcagccattaacgccttcgttgatgcctataactcgctgcaaaccactatcggcagccagaccaaatacacggcggttgataaaggtaccgctaccggccaggactccagcaacggcgatctgctgggcgacggtacgctgcgcaatatccagacgcgtctgcgctccatgctctccacgtcccagactaacgacggcaccctctctgccctgtcgcaactggggatcacccaggatatcaacggcaaactgacggtcgacagcaccaagcttgataaagcgctgaacgaaaaaccggcggacgtgatcagcttcctgtccggcgatggcaaaaccaccggctttgccacccagaccagcagcctgctgaaaagcattctcggtactgatggctcactgaaaaatgccaccgacggtatcaacaagtcgttgaaacagctggatgagcaaaaagagcgtgttaccgcgcagatcaccgccaccatggcccgttacaaaacgcagtttactgcactgagtcaaatggtttcctccctgacctccaccggcaactatttgacccagcaatttaacgcgatgaattcataagttatttattgaggtttgctatgtatacaaaatcgggaattcaggcttatgcaacggtcggcgtggaaagcgccgtcctgagcgccagcccccatcaacttgtggtactgctgtttgacggcgccttaagcgccatgaaaaaggcggccattctgattgagcagggagatattcccggtaaaggacaagcgctgtcgaaagccatcaatatcatcactaatggtttgcgcgcgggacttaaccacgatgtcggtggtgagctctccgcaaacctggacagcctgtatgactacatgacacgacgtcttttacacgccaatctgcacaatgacgtcagcgccattgaggaagtcacaattttgctcaacaacattgcggacgcctggaaagaaattggtcccaataatcctaatgcgcgagagtccttctaatggaagcacatgtcgggttgctccaccactatcagcagttactaatcgccagttgcagtatgcttactctcgccagagaaggccgctgggacgatctgattgaacatgaacttaactacattgcggcagtggaaagattgacgcagtttcaggatgccggagaggtggcacctgccgtccaggcgcaggtccgtccgctgctccggcagatccttgataatgaagtcgagttgaaaacgttattacatcagcgcatggaagagctgcgcaccctggtgggacaaacctcccgccagcacaacctgaattcagcatatggacgtctttccggtaatattctgttcccgagcgagctgtaagttccgcttctgaccggcgggtgacgttttttataaactgcgcccgcgtcattttttgattttcacccatacttcgttgatccccacaccggagcatggaagatgaaaaaccccaccttattgcagtgctttcactggtattaccctgacggcggaaaactctggccggaaatcgccgaacgcgcttcaggtttcaatgacatcggtatcaatatggtctggcttcccccggcgtccaaaggcgcatcgggcggcttttccgtaggttatgacacttacgatctgttcgatctgggcgaattcgatcagaaaggcagcgtcgccaccaaatacggcgataaagcccagctactggcggccattgccgcgctgcgggaaaacgatatcgcggtactgctggacgtggtggtgaaccataaaatgggcgctgacgaaaaagagtccatttgcgtcaaccgggtcaacgaacacgaccgcacgcagattgatgacgcggtgattgaatgcgaagcctggacgcgctacagctttccggtgcgtcagggccagtactcgcgctttgtctgggactacaaatgcttcagcggcatcgaccatattgaaaatcctgacgaagacggcgtgtttaaaatcgtcaatgactataccggcgatggctggaaccatcaggtggacgatgaactggggaacttcgactacctgatgggcgcgaacatcgatttccgcaacaccgcggtggcggaagagatcaaatactgggcgcgctgggtgatggagcagaccggctgccagggtttccgcctcgatgccgtgaagcatattcccgcctggttctataaagagtggatcgagcacgttcaggatgtcgcgcctgaaccgctgtttatggtggcagaatactggtcgcacgacgtcgataagctgaaacagtatatcgatcaggtggacggtaaaaccatgctgttcgatgccccactgcacatgaaattccacgaagcctcgctccagggcagccatttcgacatgagccagattttcaccggcacgctggtggaagccgatcctttccatgccgtgacgctggtcgccaaccacgacacgcagccgctacaggcgctggaagccccggtggaagcctggtttaagcccctcgcctacgcgctgatcctgctgcgggaaaacggcgtgccctcggtgttctatccggatctgtttggcgcaagttatgacgataccggcggtgacggcgaggtgcatcacgtggatatgccgatcatccaccagctggatcagttgatcctcgcccgtcagcgcttcgcccacggtgtgcagacgctctggttcgatcatcctaactgcatcgccttcagccgcagcggtacgctggaggagccaggttgcgtggtggtgctctcgaatggtgatgacggcgaaaaaacactgagtctcggggataactacggcaataaagtctggcgggattttctcggcaaccgcgatgaaagcgtcaccaccaacgccctgggcgaaggcaccttcacctgtaacggcggcagcgtcagcgtgtgggtaatagaagaggctgcgtaaaacaacgggcagcgcggggaacgcccgcactgccctgtcagtcagggtaacggcgacggcagcggatttttcgccagcgcctcggcgcattcgctggtcgggcgttcgacgcgtttaagcgtcatgcccgcatactccagctggttgccttcccgctccacaccataaatttccagcttacgggtgacgtttttcagatcgtcgccgctcagcatcagtttacccggtacggcaatcacccgctgccactggcggcagtccagcgtatcgccatcctgggtgacgatcaggctggccatcgcctccgggctgaccagcgcgctctgtgggccgtttgactgccagtaaccggcaagccccgccggtgcgggatgttttaccaccgcctgataatcttccacttgcgcacagccagccagcgccagcaatgcgccaagaattgctacttttttcatctgttatcctgctcatgaagaaaaaaaacagtgtggcattaaagcgttgcccctgccagcctttcaccgatacggcataaaattgatctctgccagataaaagggtctttctgctttgcaaacccgcgcacgcgtgtagtatcgcctcttcttttaaaaccttctgagttcagaggtcattaatacaatgtcgtggcaacagttcaaacaggcctggttaatcaaattctgggcccccgcccctgccgttatcgccgcagggatcctctccacctactattttggcattaccggcaccttctgggcggtcaccggcgaattcacccgctggggcggtcagctgttacagctgatgggcgtacatgccgaagagtggggttactacaaattgatccatctggaagggacaccgctgacgcgtatcgacggcatgatgatcatcggcatgttcggcggctgctttgccgccgcgctgtgggcgaacaacgttaagctgcgtatgccgcgtaaccgcatccgtatcgcgcaggccattgtcggcggcattattgccggtttcggcgcgcggctggcgatgggctgtaatctggcggctttcttcaccggcattccgcagttctccctgcacgcctggttcttcgcgctggcgaccgctgtcggcacctggtttggcgcgcgcgtcaccctgctgccggtcttccgcatcccggtaaaaatgcagaaagtctccagcgcctcgccgttaacccagaaacccgagcaggcgcggcgtcgttttcgtcttggcatgctggtgtttgtcggcatgatcggctgggccttgctgacggcgatggataagccaaagctgggtctcgccatgctgttcggcgtcggctttggcttactgatcgagcgggcgcagatctgctttacctcggcgttccgcgatatgtggatcaccggccgcacccatctggcaaaagccattgtgctggggatggcggtcagcgccatcggcatctacagctacacgcaactgggcgtcgagccgaaaattatgtgggctggtccgaatgcggtactgggcggtctgctgttcggctttggcattgtgctggcgggcggctgtgaaaccggctggatgtaccgcgcggtggaaggccaggtgcactactggtgggtgggggttggcaacgtgatcggctccacgctactggcgtatttctgggacgacctgtccgcgccgctggcgacaagctgggataagatcaacctgcttaacacctttggtccgctgggcgggctgctggtcacttacgccatgctgctggcggcgttcctgctgatggtggcctgggaaaaacagttcttcaaacgggcggcgcgcgtcgccattaaggagccagcatgaaagctatcgtgcctgattatcgtctcgatatggtgggcgaaccctgcccctacccggctgtcgccacgctggaggcgatgccgcagctgaaaaaaggcgaaattctggaagtggtcagcgactgcccgcagtcgatcaataacattccgctggatgcgcaaaaccacggctataccgtgctggacattcagcaggacgggccaaccattcgctatctgatccagaaatagggttaagtctccctccgcctgacgggaggcgtttttccactacagacggctgagattgtcatcaatgctggcctgaatatcccggagcgtctgaggcgttatctcccgcgcgaaacgggccttcgccctggcggtgaaaccgctggccacgtcagcaaatcgggtaatgagcgcgctgatttgctcagccgttaattccgcctcctgcatacccagacgttcgatctgctcgcgacggattgccagcgcctcgcccagcacatccatctgatgatagccgccggggccgtcgcaccaggtaacgtcataagcgggagcgagcgtccattttccggaggctgacatcagataagcaaagttcttcggatgatcgtcacggttatgaaagatgatattgaacagggcgcgttcaaaagcccgctgtttttcccgcacatcgttcgtacaaacttgcgtggcgcgcagaaagttcacatagtccatcgatccggcaagctggtaattcgcgccagtaaaagccgccaggctttgcatcggcacacgcataccgttgtggcgatcaaagcgtcggctgccaaaggccgcctgcccgcccggaagggaaaaatattcggtatcaggggtgtcgatgccgcattcgcgcaggcattcggcatagagcatttcgatggcgcacacttccggatgttcactgcgggccgggaatttgatcagccagggttgcagaccgtcctgttgcgccgtggtgaaaaggccgctggcggcattacggtagaccagagctttgggtcgtgcgccgtggggcgagccgcccacttgcagcagacgggccagaaactccccgccttcgccgtccagcacgtcctgcacttcactggcaagctgcgccagcggaatatccacatccgccgatgtggcctccgcctgatgaggcacaaaagacattgcacccatggcgttatcaccaatccaggtcagccgctccagcggcccaatgcgcgcggcattcaaaccgcgctgcctgaacagacgatccatcagcaacatgccccagccatccggcagtgaatcataaaccgggccgggtaatcccagttgatgtgcaggaaagccctgccgcagccgttcgcccttaagaggcaaggtccaggccgacagctcaaggccgcgtgtcagcgccgcctgactgtattcgaaaaagatcaccggacgggcgctcagcgccgtcgtggtcgccagcgtcccccacagccagcgttcaccccagccttcatagtaaacatccacacgatcaggcatggtcgttcctctttttgatgcgctggcggctggtgctttcttcgtaacggcgtaaatcgtccagcgtggtaagctgcggtttgaaaagttcttccagctctttaccccggccaagcaccatcgcgatacgcaccacgctttcaaaggcgatattacgccctgcttccatattagaaaccgtgttgacgctcacgcctgccctgccagccagttcggcctgggtcatttgttgcgcgatacgcatttgccgtaagcgctcgcagagcaacttaacgatctcgtcgggtttgctgaaggtaaagtcaatcatgttatcggttaccgcctgaggttgcgcttaactgaaaacattataggaaatgagcgggaggagaggtaggaaataatacccaataaaaaagatttacaggcataatacgcctgtaaaccccaataaataagaattataaaagcggtgaactacacctgcatcgacatcacgtcctgataggcggcaaccagtttgttacgcacctgaatgcccatttgcagggacacggacgatttttgcagatcggtcatcacgtcgttcagcgccacgccgggttcaccgagggtgaatttctcagcctgggtgcgcgccgcgttttgcgtatcgctgatgcgatccagtgccgcatgcagctgtccggcgaagctcaccgtcggttcgctttgcatactttgattcttcgcgatccccgccgttgcctgcaactggctgatgaccccttcaataccctgtactgacatggttttaccccacatgatttgataccaggtaagactaacagcttgtcaataagataaaggcggcaaatagcgataaaaaaccaggttatttgacccatagaaaattccgaatcatcaaataatgactccgccatcaacatggaacttttgtcgtgtttgccgacccgggagtctgttttgcttcattacacgaataacgccgtccgcccagagttaagaggtgcgcaatgagtgcgactgcaacgactgcatcacaaaataaatctctcgagtggatgaaccgcctgcgcgcgaaccccaaaatccctttaatggtggcgggcgctgcggctgtggccatcatcgtcgccatggtgctgtgggcgaaacagccggattaccgcacgctgtacagcaacttatccgatcaggatgggggcgcgatcgtcacccaactgacgcaaatgaacatcccctatcgcttctctgaaaccggcggtgcgctggaagtccccgcggacaaagtgcatgaactgcgcctgcgcctggctcagcagggcctgccgaaaggcggcgcggtcggttttgaactgctcgatcaggaaaaattcggcatcagccagttcagcgagcaggtgaactaccagcgcgcgctggaaggcgagctggcgcggactatcgaaaccctcggtccggtcaaagtcgcccgtgtgcatctggcgatgccgaaaccgtcgctgttcgtgcgcgagcaaaaatccccgtccgcttccgtgaccgtgaatctcgaaccgggccgcgcgatggacgaaggtcagatcagcgccgtggtgcatctggtctccagcgccgtcgccggactgccgccgggcaacgtcaccctggtggatcaggccggccatctgctgacgcaatccaacaccagcggtcgtgatctgaatgatgcccagctgaaatacgccggtgatgtcgaaggccgcattcagcgccgcatcgaagctatcctctcgccgatcgtgggtaatggtaacgtccatgctcaggttaccgcgcagattgattttgccaataaagagcagacggaagaaaactaccgtccgaacggcgacgcggcgcaggccgtactgcgttcccgtcagatcaatgaaaccgaacagtccggcggcagcgccggtggcgtgccgggcgcgctctcaaaccagcctgccccggccaataccgcaccgatcaccacgcctgcggcgaataatcagcagaacggtcagcagaatcagaacgcgcagcagacctccacggcagccagcagcggcccgcgtaacagctcgcgtaatgaaaccacgaactacgaagtggatcgtactatccgccacaccaagatgaacgtcggcgatgtccagcgtctgtcggtggctgttgtcgtgaactatcgccagctggccgacggcaaaccgctgccgctgactgccgatcagttaaaacagattgagaacctgacccgcgaagccatgggctactcggaaacccgtggcgacagcctgaacgtggtcaactcccagttcaatgccaccgatgatggcctggcggaaccgccgttctggaagcagccatggtttatcgaccagatgctgtctgccggtcgctggttactggtgctgattgtggcgtggatcctgtggcgtaaagcgattcgtccgcagctgacccgccgcgcagaagaagtgaaagcagcccaggaagcgacgcagaatcgtcaggaaatcgaagaatcagttgaagtacgcctgagcaaagatgagcagatccagcagcgccgcgctaaccagcgcatgggcgtggaagtcctcagtcagcgtattcgcgaaatgtcagataacgatccgcgcgtcgtggcgctggtcattcgccagtggatgagtaacgaagaacatgagtaaccttaccggaactgagaaaagcgtcattctgttgatgacgattggcgaagaccgcgcggcggaggtgttcaagcacctctccacccgtgaggtgcaacatctgagtaccgccatggcgggtgtgcgtcagatctccaacaaacagctgaccgatgtgttacaggagtttgagcaggaagccgagcagtttgcggcgctcaacatcaacgccaacgattatctgcgttccgtgctgatcaaggcgctgggcgaagagcgtgcttccagcctgctggaagatattctcgaaacccgcgacacctccagcggtatcgaaacgctcaactttatggagccgcagaccgccgccgaccttatccgcgacgagcatccgcagatcatcgccaccatcctggtgcacctcaaacgcggccaggcagcggatattctggcgctgttcgacgagcgtatgcgtcacgatgtgatgctgcgtattgccaccttcggcggtgtccagccagccgcgctggcagaactgacggaagtgctcaacagcctgctcgacggccagaacctcaagcgcagcaaaatgggcggcgtgagaacggcggccgaaattatcaacctgatgaaaacgcagcaggaagaagcggttattaccgcggtgcgcgaatttgacggcgagctggcgcagaaaattatcgacgagatgttcctgttcgaaaacctggcggaagtggacgatcgcagcatccagcgcctgttgcaggaagtggattccgagtcgctgctgatcgccctgaaaggtgccgaacagccgctgcgcgagaaattcctgcgcaacatgtcgcaacgtgcggcagatattctgcgcgacgacctcgccaaccgtggtccggtgcgtctgtctcaggtggaaaacgaacagaaagccatcctgcttattgtgcgtcgtctggcggaaaccggcgagatggtaattggcagcggcgaggatacctatgtctaacgaactgccatggaaagtctggaagccggaagatctggcgatgccgttatccgaattcgtgcccgccaccgtgcgtgctgacgcgaaagaggatgacgaggacgtcgtcgaagaagagatctccgaggagcagaaacgtcagcaacagctggcgcagatgcagatgcaggcccatgagcagggatataacgccggtctggcagaaggccgcaagatcggtcaggaacaaggttataaagaaggcctcgcccagggccaggagcagggactggcgcaggcccatcagcaacaggccccgctgcatgcccgcatgcagcaactggtcagcgaattccagtacacccttgatgcgctcgacagtgtgatcgcctcccgtctgatgcagatggcgctggaagccgcgcgtcaggtgatcggccagaccgcctgtgtggataacaacgcgctgatcaaacagatccagacgctgttgcagcaggagccgctgttcagcggtaaaccacagctgcgcgtgcacccggatgatttacagcgtgttgaagagatgctgggcgccacgctcaacctgcacggctggcgtttgcgcgccgatccgaccctgcaccctggcggctgcaaagtctctgccgatgagggcgatctggatgccagcgtggcgacgcgctggcaggaactgtgccgccttgcggcgccgggagttgtctgatgaccgcacgcctgacccgctggctgaacacgctggataattttgaaagcaaaatggcgcaactgcctggcgtgcgccgttatggtcgtctgacccgcgccaccggtctggtgctggaagccaccggcctgcaactgccgctgggcgcgacctgcattattgagcgtcaggacgggaacgaaacccgcgaagtggaaagcgaagtggtcggttttaacggccagcgcctgttcctgatgccgctggaagaagttgaaggcatcctgcccggcgcccgcgtgtatgcgcgtaacgccagcggcgatggcctgcacagtggtaaacagttacccctcggcccggcgctgctcgggcgcgtgctggacggcagcggtaaaccgcttgacggtctgcccgccccggacaccaccgaaaccggcgcgctgatcacccagccgttcaacccgctgcaacgtaccgctattgaacacgtactggataccggcgtgcgcccgatcaacgccctgttaaccgtgggccgtggtcagcgtatggggctgtttgccggttccggcgtgggtaaatccgtgctgctcggcatgatggcccgttatacccaggccgatgtgatcgtcgtcgggcttatcggcgaacgtggtcgcgaagtgaaagattttatcgagaacattctcggtgccgacggtcgtgcgcgttcggtagtgatcgccgcccccgctgacgtctctccccttttgcgtatgcagggggcagcctatgccacgcgcattgcggaagatttccgcgatcgcggtcagcatgtgctgctgattatggattccctgacccgttacgccatggcgcagcgtgagatcgcgctggcgattggcgagccgcccgccaccaaaggctatccgccgtcggtgtttgccaaacttccggcgctggtggaacgcgcgggtaacggcatccacggcggcggctcggtcacggccttttataccgtattgaccgagggcgacgatcagcaggatccgatcgccgactcggcgcgcgccatccttgacggccatatcgtgctgtcgcgccgtctggcggaagcgggccactatccggccattgatattgaagcctccatcagccgtgccatgaccgcgctgatttctgaacagcattacgccaaagtgcgcacctttaaacagttactgtcgagcttccagcgtaaccgcgatctggtcagcgtgggggcctatgcgcgcggcagcgatccgatgctggataaagccatcgccctgtggccgcagcttgaagctttcctgcaacagggcatttttgaacgtgccggctgggaagattcgattcaggcgctggatctgattttcccgtcagcataagcaacgtgaggttcctttatgacgcaacatagcgcattagcgacgctaaaggatctggcagaaaaagaagtcgaggacgccgccattaccctcggggatatgcgtcgcgcctgccagcaggcggaagagcagctcaacatgctgatggattaccagaacgagtaccgtaataacctcaacgttgacatgacccagggcatcggcagtcagcgctggcagaactaccagcagtttatttcgacattagaaaaagccatcgaacagcaccgtctccagctgacgcagtgggccaataaagtggatcaggcgttaacctgctggcgtgaaaaaaaacagcggttgcaggcgtggcaaaccttacaggatcggcaatccgcttcagcattgctggcggaaaaccggcttgaccagaaaaaaatggacgagtttgcgcagcgcgcatcattgaggaaaattgaatgatctctttgccaaaactggtaatgaccgatgcagaagccccgacttccgggctgatgaccgggaaagcggacactggcgcgcaggattttatggcgctgctgaccggcgcaatttccggcacgccggttgagggtgaaggcgcgtcactgtcgctggctgatttacagtcagcgggcgcgacgcttcagaaaggtttgctgagtaaggacaccggcgaggcggatctgcgcactccggcggctaagcttgcggatattctggcgcgtcagacggtgcaggaagaggcgctgacagaagacgcctcgcaggcgcagggcgtgacgccgctgctgaccagcggcctgaaatccgacagcctggcgctgctcaataaaaccgtgaaagccgacgacatagagacggcggatcttagcgaagaagagatcgccagccttagcgcactgctggcgatgctgcctcatcagcaaaatgcccaggccgccgcacctgttaccacaaccggcaccgccgcttccgccgccgtgacgaccactgccggcagccgcacgctgaacctggccgccgccgatccccgtggcaacgcgttaaccgacacggcggatgccgcagccggtcaaccctcccataaagacgcgggcgcggcgctgaacgcacaattgccaggcgctgacagcgcgcagcaagccgccgccccggtagccgctaacgccgccaaagccgatgcgcaggcggcgatccatgccgtgaatactacggtcagcgctgctccggccgtcagcaccgccgcgccagcgcaggccagcctgccggttgccgctccggtgatcagcgcgccgctcggcagcagcgagtggcagcagaccatcagccagaacatcacgctctttacccgtcagggcaaacagagcgctgaactgcgtctgcatccggaagatctgggccaggtgcagatcaacctgaagctggatgataaccaggctcagattcagatgatgtcgccgcacagccatgtgcgcgcggcgctggaagctgcattgccgacgctgcgcaccagccttgcggaaagcggcattcagctgggtcagagcagcatcagcagcgaaagctttaccggtcagcagcaatcgtcttcccaacagcaggcgtcccgcggcagcaatcgcggtgatttcggcgctgaagatgatgacgctctggtggtgcctgccagcctgcaatccgccgcgcgcggcacgggttcggtagacatctttgcctaaacgcaaaaggtagcgtgattatctccgtcttttccaccctttgacggacggcagacacgggataatcactctatcagcagtaccgaaacaggaagcttgtaacagatgactgactccgccattcccaaaaaaagtaagcgtgggatctggatcccgctgttggtgttaatcaccctcgctgcgtgcgccaccgctggatacagctactggcgtatgcaacagcatccggcagacgccagcgtaaaagcagaattaccgccgcctccggcaccggtcttctttgctctcgatacctttaccgtgaacctgggcgacgccgatcgggtgttgtacgtggggatcaccctgcgtctgaaagatgacgcgacccgtacccgtttgagcgaatatcttccggaagtgcgtagccgcttactgttacttttctcgcgccaggatgcgtcacaactggcgaccgcagaaggcaagcagaaactcgtggacgcgattaaagatacgctctcttcgccgttagtcgccgggcaaccgaagcaggaagtgactgacgttctttatacagctttcattttgcggtaaagacatgggcgacagtattctctctcaggctgaaatcgatgcgctgctcaacggcgacagcgatagtaacgatgctccaaaacccggtgagggttttgagagcgaaattcgcccttatgatcccaacactcagcgtcgcgtggtgcgagagcgtttacaggcgctggagatcattaacgaacgttttgcgcgtcagttccgtatggggctgtttaacctgttacgtcgtagcccggatattaccgtcggcgcgatccgtattcagccgtatcacgagtttgcgcgtaacctgccggtaccgacaaaccttaacctgatccacctgaaaccgttacgcggcaccgggctgtttgtgttttccccaagcctggtgtttatcgccgtggataacctgtttggtggcgatggccgcttcccgacgaaagtggaaggccgtgaatttacccataccgagcagcgcgtgatcaaccgcatgctgaagctggcgctggaaggctacagcgatgcatggaaagcgatccacccgctggacgtggaatatgtgcgttcggagatgcaggttaaatttaccaacatcaccacgtcgccgaacgatattgtcgtcaatacccctttccacgtggaaatcggtaacctgacgggcgagtttaatatctgtctgcccttcagcatgattgagccgctgcgtgaaaccctggttaacccgccgctggagaactcccgcaacgaggaccagaactggcgcgataacctggtacgtcaggttcagcactctgagctggagctgatcgcaaacttcggcgatgtacccctgcgtctgtcgcagatcctgaaactgcaacccggtgacgtgttgccgatcgaaaaacccgatcgcatcattgcccatgtggacggtgtgcctgtgctcaccagccagtacggcacgattaacggccagtacgccctgcgtgtagagcatttgatcaacccgatcttgaattcgctgaatgaggaacagcccaaatgagtgacatgaacaatccgtccgatgaaaacaacgaagcaatggacgatatctgggctgatgcgttaaacgaacagaaaaccaccaccagcagcaaaagctccgctgatgcggtgttccagcagtttggcggcggcgatgtcagcggcacactgcaggacatcgatctgattatggatattccggtcaagctgaccgtggagctgggccgtacccgcatgaccatcaaagagctgctgcgtctgacgcagggttccgtggtggcgctggaaggtctggccggtgagccgctggatattctgatcaacggttatctgatcgcacagggcgaagttgtggtggtggcggataaatacggcgtgcgtattaccgacatcattaccccgtctgagcgtatgcgtcgcctgagccgctgagtatgaaaacccaggcaaccgttgcccatccttctgccgtacccggttcgccgctgctacaggtcagcggcgcactgctgggcattattgccctgatcctggtggcggcatgggtggcgaaacgcgtgggctttgccggtaaaaccgccagcgcgcgcggcctgaaggtcagcgccagcaccacggtcggcccgcgcgagcgcgtggtgatcgtcgacgtggaagacgcccgtctggtgctgggtattaccgcgtcaaacatttccctgttgcacaccctgccgcccgcccagccggagccggaaggtctgaaagagaacaccccggatttccaggccgtgttgaagaatttgctcaagcgttccgggagatcctgatgcgccctttgttatcccttgcgctggctggcttaatgctgattgcgccctctgcgtttgcccagctgccgggtctgatcagccagccgcttgccggtggcggccagagctggtcgctgccggtgcagacgctggtgtttatcacctcgctcaccttcctgcctgccattctgctgatgatgaccagctttacgcgcatcatcattgtgttcggcctgctgcgtaacgcgctgggtacgccctccgcgccgccaaaccaggtgttgctgggtctggcgctgtttctgacctttttcattatgtccccggtgatcgacaagatttataccgaggcgtaccagccgttttccgagagcaaaatctccgtcgacgtggcgctggaaaaaggcgcgcagccgttaaaagaatttatgatgcggcagacccgcgaagcggatctggccctgtttgcccggctggggaataccggcccgttacagggcccggaagcggtgccgatgcgtattctgttgccggcttatgtcaccagtgaactgaaaaccgctttccagatcggctttaccattttcattccgtttttgattatcgatctggttattgccagcgtcctgatggcgctcggcatgatgatggtgcccccggcgaccattgcgttacccttcaagctgatgctgttcgtgctggttgacggctggcagctgctggtgggatcgctggcccagagcttctacagttaaggaatggcactatgacgcctgaatcggtcatgatgatgggcaccgaggcgatgaaaatcgcccttgccctggctgcgccgctgctgctggtttcgctggttaccggtcttgtgatcagcattttgcaggcggcaacgcagattaacgaaatgacgctgtcgttcattccaaaaatcatcgcggtggtggtggctatcgtggtggccgggccgtggatgctgaatttactgctcgactatatgcgcggtctgtttaataacatcccgtacatcatcggataacgcctgagatgctgcacgtcaccagcgaccagtggctgcactggctaagtatgtatttctggccgctgctgcgcgtgctggcgctgatctcaacagcccctattctgagcgaacgcactgtgcccaagcgcgttaagctgggcctggggctggtgatcacctttgtgatcgccccctcgctgcccgcgaacgacgtcaccatcttctccgccaatgccctatggctggcgctacagcagattttaatcggcattgcgctcggttttaccatgcagttcgcgtttgccgctatccgcaccgcaggggagcttatcggcctgcaaatgggtctgtccttcgccaccttctttgatcccgccagcaacctgaatatgccggtgctggcgcgctttatggatctgctggcgctgctgctgtttctgacctttgacggtcatctgtggctgatttcgatgctggtggataccttccatacgctgccggtgggcaacaaccccattaataccaacgcgtttcttgcgctggcacgggctggcggcctcatttttatcaatggtctgatgctggcgctgccggttatcaccatgctgctgacgctcaatatgtcccttggcctgctgaaccgtatggcgccgcagctttctgttttctctattggttttcccatcacgctcagcgtcggcattctgctgatggctttactgatgccccttatcgcgcccttctgcgaacatttattcagcgaaatcttcaatctgctggcggatattgttggcgagctgccgcaaaatactaatccataacgttagtgcagttttcctgaggttattcctaaaaatttattgcaggcacatctaccaggatataactggcgcggcttatttgtttttaccctcttcacataactaaacatttactttactttaagatgattcctggcaaattatacgtaactttacgggatagtaagttcgcctgaaagtcttgtgttgctcaaacgctttttagattattttcatccggttggctgatcgtacagcattcaggcaggggtgaattatcgttacgcattgagtgagggtatgccatgtcaacgattattatggatttatgcagttataccaggttgggattaaccggatacctgacaagccggggagtaaaaaagcgagaaatcaatgatgtacagacagtggatgagcttggatctgcctgcgaggcgctaaaacccgcagtggtatttattaatgaagactgctttattcatgaccaggaactgagcctgcaaattaagcaaatcattaatcagtatccgaaaacaatgtttatcgtgtttatggcaattgctaatatccactttgatgaatacctgctggtacgcaaaaacttattaattagttcaaaatcgattaagcctgaatctctggacgacatcctcggtggttgtctgaatacggagtcaaagggcacgggttccattaatctccctacactctctttaagccgtactgaatccagtatgctgaaaatgtggatgtccgggcagggaaccattcaaatatcagatcaaatgaatattaaagcgaaaacggtatcatcacataagggtaatattaaaagaaaaataaaaacgcataataagcaagtgatctatcacgtggtgcgtctcaccgataatgtgaccaacggtattttcgttaacatgcggtgagagggtaagcgggcgctcccctcccccgccggagggtttactgttcctgcttctcaacaaatatcccgtccggatgcccgagttcattaaagaaccagatgcctaacgggtagtcctcaagggataccagatacatggtgccctcactgaacggctcgatggccagaaccactcccggacggcgaggacccccgtccgttttcaccgtaaccttatcgtttaccttcattttcatcctcctgaatgcatttttgccagtgtagatcaaatccgctgttctgacagtgttcatctgccttattgctgcttttctccaccgtctatacttaggctgtcggggcgaaagaggtaacggcaatgaaaggcgatcacggcactaaaccttctggcgaaggtgaaatcaacgttgacgctctgctggccgccatcaatgaaatcagcgaaagcaatattcatcgtatagacagcgatgacggacaacgggtgagcgttgacgggcgcgattatcatacgtggcgggagctggcggaggcatttgagctggatattcgtgattttagcgcatcagaactgaaccgctgacatcaggatataaaaaaacccggcctggggaggccgggttaaagcttgcgattgcaagaagcacttgaaaattcgttacaccaggaaatctgatgcgggagagactgtatctactattgatatagctgacaaggatatatttacaatggtaataattcactaacatagaattcataaaggttataattggcaaggtcgcgcggcagaagacttgcagcgttgcacctctgacaaaaagccttacaaaccttcacagtatttaagaattttcttagctctgcgccattttattctgactacaggagccgcttttatgccagcccttcacgacccgctactgattttcaccgacctcgatggcactctgctggacagccatacctgggactggcagcccgccgccgaatggctgagccgccttggacagcagcagatcccggtcattttatgcagcagcaaaaccgccgccgaaatgatggcgttgcagaaaagtcttggcttacaggatctaccttttattgccgagaacggcgcggtgatccatctggatacgcactggcaggatcacgccgattacccgcgactgattaacggtgcgtcccatgacgaggtggtacaggttctgattcggttacgcgagcagcatggcttcaaatttaccctgttcagtgaactggaagaccgggtactggcggaggttaccggcctgacgcctacccaggcgggcctggcgcggctgcacgaggcttctgagacgttaatctggcgcgacagtgatgaacgcatgaacgccttccgcagcgccctggaaggcctcgggctgcgttttatgcagggggcgcgctactggcatgtgctggatcagcgcggcggtaaagaccaggccgtaaactggctgaccagtcagtaccgccagcgcgttggtcatccccacaccactatcgggcttggcgatggccccaacgacgctcctttactggataacgtcgattttgcggtagtggtgaaaggccttaaccgcgacggcgtcacgctcgctaatgacgatccagaccgcgtgtatcgcacgacgttaaaaggcccggcaggctggcgtgaagggctggatcactggcttggcgattcctgatcttcatcgctggcgcatacctgattgcgcccgctgcgcttggcacggtaaagccggttatcggcgatggactgcaacatctcaaaattggtcatctcatcggccacgccgctgctgacacccagcgacgcggtcatccttaaggtacggcctttcggcagcaggatctctttcgcggcgatgcgcgcccggatacgttcagccagggccttcgcctgcgccagcgtgctgtccggcaaaatcacgcagaactcttctccgcccacgcgtcccgccgcatcagtggatcccagcgtgttttctatcagccgcgccacgtgcgccagcacccgatcgcccgcctggtgtccgtgacggtcattgacctgtttaaaatggtcgaggtcaatctggatcaccgataacggctcgccggtttgctggctttgcgcggtgagttttttcgcctgctcaaacagcccaccgcggttgctcaggcgcgtcaggggatcgtgccaggcctgccatcgcagggagttttgcatctggtacatattgcgaaccatccggcggatcaccatccatgacagcagcaccatggtggtgaacagcagccagagcagcgcaatcacaatgctgatggtgccaaaatcgccatccagaccggcgctcagggagtgaatacggatcagtacaccgtcgaaatggcggaggttttgccagctgacaaactggctgccgagatgcagattaccggtggtctcatgggcgactgcctgtagcagctcatgccgatctgcctcgctgaacgcttccggcgcggcatcgttattcgtcgaggcggtgattaacctgaactcgctgtcatagagctgatactcgccctggtcttcatcggtaagggagtcttccagttgcttcttaagcaggaccaccgggaactgtagcgcaatggtgccgtaccagtaatcctgatggtcgagcggaatgctggcggtgacgtaagcgcccttatggccggtatgggcaaaccagcgcacattgcgttcgtgattattatgttgcgactgaccgctgaaccaggacgaattaatgatcctctggtagcgggtaacgatatcatcggtgcctggcggagcgctggttgaaagaaaatagcccgcgcgggagacgtacatcgcgcgttccggcgccaccggataaaccgaagagaggcgcatcatatagcccatttccagcgcggcagtcatttcataattcagggcgggaatatcgcggctcagcagcggatggcggcggacaaagtcatcgcccacgccgttcagcgccagcgtacgccgggcgtctacatcaatctgccagaacggctgctggcggacggtggaaaaatcatgttgaacattgttgaggacatcaaaagcgagcggggtttgcatcgcggtctgcatactgttgcgatagaacagcagcagattcacgccggtctgcaactgtcgatccagcgcagaggcggctttatccagagtggtctgctggctggcggcataggcatcttccagcaccacggcctcgcgccaggtgagcaaggttgagctaatcagcacgaaagcaaaacagaggttaacgatccgcgcgggatcaaaagagtggcgcaacttttttaacagcactacgagtttcctgaatgtcataagttgtgccggtaaatctgcccggcagcgccgggcaggagaagattaatgcgccgcaccgcgtaaccgtgcgacagcttttaccaccgccacaacggccaggccaatcacaaagcccagcactagatttgccagcataggtaaggttgcctgcaccaccgcgccgtgcgcggcagccgcgtgttcaatggcatggtgcagcggggcgataccgtgcaccacgatcccgccccccaccagaaacatcgccagcgtaccgatgatggagagcgccttcatcagccagggggcaaccaccagcaggcccttgccgacagatcttgccacagcaccgggtttctccgccagccagtaacccacatcatccagtttaacgatcactccgacgaggccgtaaacgccgatggtgaccaccagcgcgatacccgacagcaccagaacctgattcagcagcggcgcatcggccacaatgcccagcgtgatggcgacgatttctgccgacagaataaagtcggtacgcaccgcccctttaattttatcgcgctcaaaggttttcggatcctgggcggcaatagccgccagacgctgctgtcgcgcttccggcgtctctttgtgcttacgggcatgcagagtatgcagtaccttttcaacaccttcaaaacataaaaatgccccgcccaccatcagcagcggcgtgatcgcccacggaataaaggcgctgatgagcaacgccagcggcacaaggatcactttattgagcagcgatcctttcgccacgctccacaccaccggcagctcgcggttagcgcgcacgccggacacctgctgggcattgagcgacaaatcatccccgagcacgcccgccgtttttttcgccgccagtttgcccatcaccgaaatgtcatccagtaaggtggcaatatcgtccagtaaggttaataaactacttcccgccaaaatacattccttctcttttttgttgatataacaatgagtatggagcataaacgcccggcgcgaaatgcccggcgtaaagtcaacaaaaaattaacattcccccgacgagtaaatgactcgccagctaactacttttgtcgtttactgtaagccttcttactgttccgccgtgagggcgtatgcgtttcaggcagcttttaccgcttattggttctcttttcgcgctttatattatctggggttccacctactttgttattcgcgtcggggtcgaaagctggccgccgctgatgatggcgggcgtccgctttctgacggcgggcgtgctgctgatgaccttcctgctgatccgcgggcatcgactgccgccgctgcgcccgttgctcaacgccgcgctgatcggcgtgttacttctggcggtgggcaatggcatggtcacggtggccgagcaccagaacgtgccgtcggggatcgccgcggtggtggtggcgacggtgccgctgttcacgctctgcttcagccatttttttggtatccggacccgcaaactggagtggcttggcattgccattggcctgtgcggcattgtgctgctaaacagcggcggcaacctgagcgggaatccgctgggcgcggtcatgatcctgatcggctccctgagctgggcattcggctcggtttatgggtcgcgcattgaactgccggtcggcatgatggcgggggcgattgaaatgctggcggcgggtgttgtgctgctggcggcgtctttctgtagcggggagacgctgaccgctctgccgacgctgtcaggctttgtcgcggtgggttatctggccatttttggctcgattatcgccatcagcgcctatatgtaccttatccgcaataccaccccggcggtggccaccagctacgcctatgtgaatccggtggtggcggtgctgctcggcaccacttttgccggtgaagtgctgtcgccggtagagtggctggcgctggggattattattcttgcggtggtgctggtcaccctcgggaaatacctgttccctgcccggccggtggtggcctcctgtgagatcaggaaatagtctgtattccctgcgtatcgatctgcgcggcctcgccgccgccgcagatccactcctccagccgcacgcttaacctttcatcgctcagcttctgccgcccgcgcagggcgcactcccacaccaccagtacccgccagccgtccgcgcgcagctgcgtcagatcgcgcctgtcgcgcgcaacgttctggccgatcttcgccagccagaaatcggtacgcgtcgccgggactttaaacagataacagttatggtgatgccagaaacagccgtgggtgaagacgacgcagtggtaatcatcaatcacaaaatccgggcggccaggcagcgtggcgtcctgcacgtgaaacgccagcccgaggtcggtgagtaatgcggccagccgctgttcaatggccgtgtcatgcgtgccgatggcacgcatatttttactgcgcgttgctttgtcatgcacatccgccatcgccctctcctttattgtcggctataacgccagtgtagcagtcagagcggcgcaactctttaaaagcaaattgccgttgcgggccggctcctgtttatgtcattatttcgccgttattaacctgcatgactttttatattccttcatttcgttatcatgctaatgccttgatgtcgccagcctgtttgggctggctttttttttgcccaaggcgttaatcatacattatataaatactaactcaccaatcaataaaatccatgaataccagcaacataaaatacgctaataattaataaaaccgcaattacataattggcgattatgattgcaacccattgatattgatgcgataaataccaggaaattaagaaacaaattgcaatatataatatgatttacttacacctttcctttaaaaaaatatgaactttatagaatagtatcgggactgtgatttaacctcaaatcacatatattcatatagattattattcatatgatgcgaagggattaaataatgaaaagaaaagtactggcaattattgtgcccgccctgttaatggctggcgcggctaacgcagctgaaatttataacaaagacggtaataaactggacctgtacggtaaagtcgatgcccgtcatacgttctctgataacccgggcgatgatggcgatgaaaccatcatggagctgggcttcaaaggcgaaacccagatcaacagcggcctgagcggttatggccaggtgctgctgaaaaccatggcaagcgacactgaaggcagcgacaacaccttcgctaagctggcattcgccggtctgcgcgccagcgattttggctccttcgactatggccgtaactacggcgtggtgtacgacgttgaagcctggaccgatatgctgccggtattcggtggtgattcctacacctggaccgacaactttatggttggccgtgcgaacggcgtagccacctaccgcaacactgatttcttcggtgcggttgaaggcctgaactttgcgctgcagtaccagggtaataacgaaggtagtaacacgaacgaagatcaggaaggcactaaaaacggtcatgacgacgtgcgcttccagaacggcgacggctttggtctgtcttcatcctataacttccagggcgcgctggaaggcctgagcctgggcgcggcctatgcgacttctgaccgtactaacgaacaggttgcggcgggtggagtgaacgatcgttacagcaaagctgctggcggcgataaagcagacgcctggacctttggcctgaagtacgatgcttataatgtatatctggcgatgatgtacgctgaaacccacaacatgaccccttacggtgatgagggtatcgcaaaccacacgcagaattttgaagcggtggcccagtaccagttcgacttcggtctgcgtccgtccctggcgtgggtttactccaaaggtaacgaccttggcggtaacagcaccaaacacggtactgactatgtcgaccaggatctggtgaactacatcgaagtgggcgcaacctactacttcaacaaaaacatgtccacctatgttgattacaaaatcaacatgctggatgaagatgacagcttctacaaagataacggcatcgccactgatgacgtagtcggcgttggtctgacttaccagttctgataaccgcttgtgctaaagcccgcccctgtgcgggctttttttatggccgcaatttgagaataaagcggtagcaagataggtgcggggagactactatccgggttcagcaggaataaaggattttctcaacgggacgtcggtcactgaaacgaaacgggataagtgattgaataatggcggagagagggggatttgaacccccggtagagttgcccctactccagttttcgagactggtccgttcagccgctccggcatctctccgttctgatggttgccatcatgccaggttctttggcattttaacagaccctgtccctgcaattgtgttcaagtgacgagtttgcgagcaaagcgatgattaaatggccctggaaagcaaatgaaacggcacggactctggcgctcccctgggaaaatgcgcttgccgtcccgatgttatcgactctgaccccggaggaacaaaaccggctggttcagcttgccgatcgctttttgcagcaaaaacgcctggtcgcgctgcaggggctggagctggatgagctgaaaagctgtcgtatcgccctgctcttctgcttaccggtgctggaactgggcatcgaatggctcgacggttttcacgaagtgctgatctatcctgcgccttttgtggtggacgacgaatgggaagatgacatcgggctggtgcacagtcagcgcatggtgcagtcagggcagagctggcagcaggggccggtgatcttaaactggctcgacattcaggattcgttcgacacctccggctttaacctgattattcatgaagtggcgcataagctggatacgcgcaacggcgaccgcgccagcggcgtgccgctgatccccctgcgcgaagtggctggctgggagcatgatctgcacgccgccatgaacaacattcaggatgagatcgacctggtgggcgaaagcgcggccagcattgatgcctacgcagccaccgatcccgcagaatgtttcgccgtgctgtcggagtatttcttcagcgcgcctgagctgttcgctccgcgtttcccggcgctgtggcagcgtttctgccagttttaccgtcaggatccgctggcacggctgcgcggcaatagtactgctgttaacgatgaaccgccttatgttcactgaaacagcaatttgagctaatattcgccagttgaatcagcaagttaaatttgctgttgacacaaatatcgggggccagtagtattcgccccgttcacacgattcctctgtagttcagtcggtagaacggcggactgttaatccgtatgtcactggttcgagtccagtcagaggagccaaattcgagagccccgctcagggaaacctgagcggggtttttgcatttccgccgcagccaattccttgtttttcattttcttgccgtcgcacgcaaaaaattcacaaaatctaacaattcatattgctaatgataaccattatcggcaaaattcttattctcaaaaaataaatgttccctttcgtgctgattttattgatctaattccggcgtgatgccgcctggcgttcacgcggattatgtataaaaactaaggaatgataatgaacacctgcaaaaagacgctctgggcgcttaacccgctatttctggctatgataacgcccgcgctggcacagcaaaccagtgaacaggatatggtggtatccgccagtcgcactcatcgcaccgtagccgaaatggcgcaaaccacctgggttattgaaggcgcagagcttgaacagcaggttaaaggcggcaaagagctgaaagacgcgctgtcgcagctgatccctggcatggatgtcagcagccagggccgcacgaattacggcatgaatatgcgtggccgcgcaattgtggtactgattgacggcgtgcgcctgaactcctcgcgcaccgacagccgccagctggacgccatcgatccgttcaacatcaagcatatcgaagtgatctccggctccacctccctttacggcggcggcagtactggcgggcttatcaatatcgtcaccaaaaaaggccagccggacacgcaggtggaatttgaagccggcagcaaaaccggatttaacagcagtaaagatcatgatgagcgggtggcaagcgccatctccggcggaaacgacaaaatttccgggcgcatggctgtggcttaccagaagtttggcggctggtatgacggtaacggcgatgccacgctgctggacaatacccagaccggcttgcagtattccgatcgtctggatgtgacgggcaccggcacgctggcaattgatgatacacagcaattgcaggtcgtcagccagtactataaaagccagggcgatgaagactacggcctgttcctcggggagaatttctcggcggtaacgggtaacggtaaagcttatgccagtaaaggtctgaattcggaccgtattccgggtaccgaacgccacctgatcagcatgcagtactcgaatacggatttcctcggccaggagctggtgggccaggtttattatcgcgatgaatccctgaccttttatccgttcccgactgtcgcaggcggcgcggtgaccagcctctcctcctcgcagcaggataccgatcagtacggcgcaaaactgacgctgaacagcaaaccgctggacggcctgcagctgacttatgggctcgatgccgatcacgagcgctttacctccaaccagatgttcttcgatctggctaaatccagcgcctccggcggtctgaataaccagagcatctataccaccgggcgctatccgggctatgagatcaccaacctagccgccttcctgcaatccagctacgacgtcaacgatctggttaccctgagcggcggcgtgcgttaccagaaaacgcgtaatgccattgatgatttcatcggttacacgcagcagcaggcgattgccaaaggcacggcccgctcggctgacgacatccctggcggcaccaccgactatgacaacttcctgtataacgccgggatcctgttgcatctgaccgaacgccagcaggcgtgggtgaacttctcccagggcgtggaattaccggatccagggaaatactacggcaacggcacctaccgcctggtcaacggccactatcgtctgctgaacagcgtcaacgtcggacaatcgaaactccaggggatcaaagtggattcctacgagctgggctggcgctataccggcgatgccctgcgcacccagttggccgcctattattccctgtcggataaatccatctccattaaccgcagcgacatgaccattaacgtcgatgacgataagcgccgtatttacggtgtggaaggggcggtggattactttattccggaaacggactggagcaccggcgtgaactttaacgtgctgaaatccgaaacccgcgttgacggcaaatgggataagtgggatgtgagttacgccagcccgtcaaaagccactgcttatgtcggctgggcgccggatccctggagcctgcgtgtacagactacgcagtcctttgatgttagcgatgcaaatggcaataaaatcgacggctacaacaccgttgatctgatcggcggctatgccttaccggtggggaacctggcgttcagcattgagaacctgcttgataaggattacaccaccgtctggggccagcgcgcgcagatgctctacagcccgacttatggcgcatcctccctctatgaatacaaaggtcgtggacgcacctttggtgtgaattattccgtccagttttaagtcctgaacccgctgcccggcttctgccgggcagatcacccttcgctaaatctgataatcaatcgccacgtcgtccggctccatcgcctgacgtttgatctcatccagcgacagcccggcattacacagttcgataaagcgccagacatagttgcgctgcagctggccgcgcttcagccccagccagaccgtattggcgtcaaacagatgacgggtatccagacgcaccaggccgccggattcgagaccgtcgccggactgctccgccaccaggccaatgcccagccccagctccacataggtgcggatcacatcggagtcctgcgcactcagcacaatatccggcgccagccctttgcgcataaaggcttcgtcgatacgcgaacgtccggtgatcccctgacgataggtgataatcggccagcgggcgatctcctccagcgttaacggattgacggtatttaacggatgatccaccggcagcagcagattgtgatgccagcggaaccaggggaaggccaccagcgccggatcgttgctcagccgctcactggcgataccgatatccgccccgccattgtgcagcagagtttcaatttcctgcggcgtaccctggatcagttccagacgcacttccggaaacagggcgcggaaagatttgatcaccggcggcaggctgtaacgcgcctgggtgtgagtggtggcgatggtcagcacgccggtggcatcgttggtgaagagatccgccagccgccgcacattgctggcctcgttaagaatgcgctcggcaatgaccagcagtgccttacccggctcggtcatgcccagcaatcgcttgccgcgccggatgaaaatctcaatccctaactcttcttccagttcgcggatatgacggctgacgcccgactgcgaggtgtaaagcatattggcgacttcggtgagattgaaatcccgccgcgccgcttcacggattattttaagttgctggaaattcacccttctctcccggccttcagacataacgctattgttagagtctgaaggccggggtaacaaataataaaaacctgcatcttatgtcgaaaaggaataaccctagcccaccagcagcagctcacgcgcctccagcgacggacggctgaccagcgacattaagatctctttcacggcctgggcctgcggcgacagcggcccgcgtgcggagcagttcagtgacagcggcaggctcatggagggcgaggtgatccgcgccatccagccgttagtggcttcgcacagggaacgggcagcggattccggcaacacggtgccgcccatcccgctggcaatggcggcggtcagcgtgccgatggactcgatctcgccgataattttcgccgtcaggcggcgcagggaaaaagcttcatcaacacgcaggcgcaccgcgctgtaatcccgcggcaggaatagattcatgtccgccaccgccgccagatcaacgctctgacccggacaatcgcgggtacccacgaggtaaagatcttctttcagcagcggctggctggtgatgcccgcgcccggcgcgcgctcatacagcaccgccatatccagctgaccgctcagcagtttgtcattcagcgacatgccgctgttttcatgcagatagacggtgacgtccggcaactccatacgcaccgcctgcaataacggcatggtgatggacgaggccgccgtgcccggcgcaaggccgatcgacacctggccgcgcagcgtctggccgacattatgcaccgccagctgcgcctgctcgcactgacgcagaatggtgcgcgcatgcgcatagagaattttgcccgcttccgttggcgtgacgcctcgtttggtacggatcagcaactgctgatccagttccccttcaagggtggcaacttgctggctcagggcgggctgcgcgatatgcaggacttctgcggcctgagtcaggctgccaatgtcgacgattttcacgaagtatttcagtcgtctaaagttcatattgcctccggtacggaataacagtgccacgctggcagtcatcatgtcggaggagttgcaagatgcttgccagttttggcaaagcctctctggtcgctcgtaacccaccagataataagagattctgattacccgctacgttttcatcactgaaacagcggtttgaaagcgttccatcaggaggcacccctgcactgtactggtgcacgaatacgggtttcggtgaggaaatcagcggattgctgaatttgtcagcaaacggttgtcgacaggcaatccaccctttgacaagcccggatcgcgccgctactattcgccccgttcacacgattcctctgtagttcagtcggtagaacggcggactgttaatccgtatgtcactggttcgagtccagtcagaggagccatatttaagaagcccgctttttagcgggctttttgctttctgttagttacgatcctgtcagcgcccgcttcgggattagccagccaacacccccgtcaggcaatgttttatatgtgcgcaggcgataagccgcctgcgctgcggcctggaatgcttattcgcgcacgatagctcctgcatcctttttgattgccggcccctctttcacttccagggtcagcccccgggtttccagctctgcattgcgaatgcgtagcccctgaacggcttcaatattcacattactgaaatggaatccgctcagcggcgcttccggcgtacctatgataaaggcagccgctttgctgtctccggtggatattaaattctccactgtgatattgcgaaagtgcggcgttttgtgtttgtcgaagggttgtttcggatcgctgtccggcggataaatctgctcgccaagggtaaatccgcccgccttaagcagcttcgtaacttccgcttcgacaataggcgctgctttatagtacgcagagaagaccagcggcacctcgacatcatgcatggtggtattgcggtaaataatattttttacctcaccgcccttcccgcgcgggcttttaatacggatgccatacatcgaaccttcgaaggtattattttccaccagcaccttattcacgccgcctgcgctttcactgccgatggaaatgccgcgcccctgtttcagggtattgttggcaatatagatattctccaccacgccgtccgggaaacgcggatcggctttttccgctttaatggcaatatgatcgtcattgcagtcgatgtaattattggtgatgcggacattctgactgtcgataggatcaatggcatccgtattgggagcatgccagggtgaaagaatgcgcgtaccgttaatatccacatcgtgcgcatagcgggtcactatatggaagcttggcgaatgcgtcagggtgacgccgtcaatcagcacattgttcgagcgcgtaatatagatcaaccgtggccggtcagtgccgccctttttcccggtagcgcgaatattttcccgccagcgctcccaccataccgccccctgaccatcaattgtcccctcgccgacaatcgccacattttgggcatctgcaatactgataaacggcagccagccgttttccgcttcagcatatttcgttttattaccggcgcgataagcggcctcttccgtagaagccaccagcgtggcgtctttctcaagtttcagctggatattattcttcagaaaaagcggattggttaagaaattgcctttcggtatcagtaccgttccgccgcctgctgccgcacagtcatcaatggctttctgtatggcatcggtattaagcgcgatctgtaaacggtggccttcagcgccatattcagtgacgttgcagaccttatcgggaaattttaccgcgcttgccgcctgcgcagcatgaagcggtaagatgcccgccaccgcagcgacggcccacagaggcagagtacgaggagacatagtgttgtcctttttatcttatggtgagttgttttgtaaaattagcaccactgtttctttttattgagtgtggggatcacgctttatcgcttgtcgttcttttgccagaaatcagggttgattttttgtgcaaatgactgaattgtagcccatcgtcatcagatattgttcagaatgacgggtaccgacaacataacaacgagggactgaatatgaagaagaacatcaccctggcacttgccatcacggcactcctcggcggcgcggcggcaccggttgttgccgcgcccttcccggccacgccggatcaagccataccggtcagccagtatgtgacccaggtgaacgccgataaaagcatcaccttccgcctgttcgctccggacgcaaagcgcgtatcggtggtcaccggctccagcccggacagacttgcttcccatgatatgagcaaaggcgaaaacggcgtctggacgtggaaaagcgacgtgatggccccgaacctgtatgaatattactttgatgtggacggcttccgctccgttgatacgggaagccgcttccagaagccgcagcgccaggtgaataccagcctgatcctcgtgccgggcagtattctggatgaccgtgccgtgccgcatggcgatctgctgacggtgacgtatcactccagagccctggcatctgagcgccggatgtatgtctggacaccgccgggttatagcggccagggcgaaccgctgccggtgctctatttctatcacggctttggcgataccgggctttccgctatcgatcaggggcgactgccgcaaatcatggacaacctgctggcggagggcaaaatcaaaccaatgctggtggtggtgccggatactgaaacggacatcactgacgcgatcccggaaaattacccgccgaaagagcgtcgcaagaccttctatccgctgaatgcaaaagccgccgatcgcgaactgatgcaggacattatcccgctggtggatgcgcgctttaacgtgcgcaaggacgccagtggccgcgcgctggcggggttatcccagggcggcttccaggcgctgttctccggcatgcaccacctcgacaatttcggctggctgggcaccttcagcggcgtcaccaccgccaccgtgccggatgcgggcatcagcgcgcagcttaacaagccgcaggaggtgaacaaacaactgcataacttcaccgtggtggtgggcgaaaaagacgccgtcaccggcgaggatattgccgggctcaaacgcgagctggaggcaaaaggcatcaactttgaatataaaaactatcctggcgcaggccatgagatggacgtctggcgtccggcctatgccgaatttgtgcagaagctgtttaagtaagtaagaagaataaacgggtatgacattttttatctatggttaagaagggatttagatggctgcggttgaagcattaaaaatgaagtatccgggcgcagaggcctggcaaatgggtgacagccctgaactggccagcgagcttgccgaacttattaaaagaggtatcaaaacggcctcctgcggctcttttgcctcttaccagcaggaagcgtctgccccgcggattgggagttataacatcatcctcgatggccagaatgtcccggtctgcgtaacaaggctgatgtcgatgcgactggtacgtttttgtgatgtgacagaggcgtttgcccgcaaagaaggtgaaggcgatttaagccttgaatactggcagaaagagcatcagcggtttttcaccggggaaggacatttttctgaggagatggagcttatcgcagaagagtttgaagtggttgaggtgctgtgaggtgaaatcaacggggcagcgtgtcatcacctgccctttatagccatgttcgcgatgagtgaggagcggacatttgcaaagtcttacttacaccgtggcggtttgagccgcaataatgtaccggagaggcggttacagctccccaggcaaaaccaaaatagatcgaccacaaaaatcaaaccgtttgatttttcgccgcttcaacgagagaatccttataaaatgcatggaataaggaaggaacggaatgttcactctttacatgagatgggatgcagagcgggaactggctccaggtgatattcagttcattctgtcgccacaagatgcgctggaaatggcgagcatcttttacgaactggattaccttgaatacgaccataacaaccgcattctgcctcacagcgtcccgaagcgacgggaaggggtttaccaccgattcgcaacacaaccctacaaacgcaagcgtcttgctgaatacgacggactctatgatgaggtgaaatggaatctggagcacggctggatggtcggagttaaccctaaagaaaaatgggaccacttccgcaatccgttctatttcgatgatgacagtaatctgatttacgactgcttcatggatacatatagcgagggttttcagcaggcagtgcgtcaaatctatgaatatagcctcagcgagcatcagggaagaaagccgcctccgaccattaaacatcactattccgatgccccgatacagcacgcccaggcgggtaaaactatcaacagcaaagcagccggacgtcttctggctgcgggtggtatctataacggcaatgtcgaggggttccatcagaccgcacagcagctcggtggtgatgcgccagcaggctacgatcaggtcatggacaacaagggattactcattactgccgcttcgacagcagccgtactgacaatgggaaaagttaacgtcactggagaactagaagagctatcgtcattaagcaaaatcccaacatttgaatctcctgctttaaagggttttacctcagagtcagggacattactgaatgctgaacacgccgttgtagattacagaaagctatctacttactctttagaccctactcatccaactggagggcataaagcgagggtgttccagtcagcgctgggttataacccaacgaatgctgacattttaggtgcacgagttcaggagggagtattgtgggcaccagcaaagatgctagatccaattaattttgggcaaaaaatggctgtagacatgccgattttaggggtaaatggcgaaacagcgatagtccgaacgggctggatctatgaaacagattcgttagtaccaaggctaaccactatttttgtgaaatgagagagctactgatgaaacgagccgaacttgatgtggtagttttagctgaggacttgcctggggaaggcttagcaaaagggatgatcgggacaatagtcgttgtatttgaaaacccgacactcgcttacctagttgagttttgtgatgaagaaggccgaacacttgctctgcccgcattgttaccagaccaggtgattgattatcttccgccagagagatccaatgtaccataaacccgctgtacggtttgaatgaaaagacctcattccaactgcgggcttaaggaaacgcccgtcaggtgctccgaggctagagggtagaagcgaaaacgcgaataggctttttctaatactgatcatagcgacacatgaaacctcaatacggataagtgcggtttaaaggagtattaggttgtgtaaatatccctgcaaaaccatccatccaattttagaaagactttgacactccaacgtccgcttctggcacagagcggacaggatggctgggctaaaggtctgcttagagcgaagagcggacgtccggcatgagttctttctggtaaacagtaatgtcagtcaatgaagtaagcacgtaaccgctcgtcctgacagccctgctgccggatgattttcactgaggcctggctcagaaattcagtacgatccgcgttcttcagcctttcacttccatcatttcagctgtcttaaaccgttcatctatactgactcttgcagtgcaatttgcacaggaggccgcgccgctgtcaacgttttcattttgctgacaaagtaagaatgggcattgcaggaggcaacccagcgcgcaaaggataagcttttgaatgacctgagcgtgtgaatgccttaattaggccgtttgttctcggtttacccccctcaaagcttaaggaataaaaaatttttatttatcctggagataactaatgaaaataaccgattttgtttattccgccttaattggcgttgtcgccagttgccgctcgatgacgccgatggcgaccctcgctgcagcacgcattgccggacgcaacacttctggccgtctcctgctgctggaccgtccgctatttaaatttggcgcgttagcgatgggtataggggaaatatttggcgacaagatgaagtcagcgccagaccgcactgtgtttttgggcatgacagcacgtgtggccagtgcagggattgcgggcgccgcgttggcaccccgcggagaggaaaaaaccggggcagcgatcgctatctctgccgctgtaccacttgcatgtgtcactcttgcggcacgcaaaaaggccatggtcgggatgggtcagaccaggagtggcctgattgaagatacgctcatcgtcgctatcggagcagcggtggtcttcttcgccacgcgcccgaagtaaacgcactcagtctttaaaggattatcccgatgaacaatcctgaaggggtcagagacggcttctggtacagcgcggactgactcccgggcagatgtccgcctggttccaaaagcggacatgcctgcttaacagacttacttcaacagcagccgtaatcccagaaaggccataacgcctccgcttagtttatctataaacatgcggtatttaatgtaagcctgacgcggcccgtccgttgataataagcaggcaacgacggcataccagagcacatcaataacgaatgccattgtgggcaggatgatgtacataacaggctgaatatttttgctcagcgccgcggaaaaaatactggcaaataccagtgcagtatggggattgctgatttgcgtgaatacgcccgtcataaacgcttttaaggcgctcacttcctctgttccggcagtgtcatttaaccgatttgaaggacgacgaaacattttcaacgccagccataaaagatagcaaccgcctgcaaccttgagtccggtgtaaagtgatggaaccagagtcagcagagtgtgaagacctgctaacgctatgcccgcaaaaacaaacgcaccaaaacccataccagcagcgactgaaaaagctgcccgtctcgaactggacatggccgttcgggcaacgagaagaaagctcacacccggactcattgcgccaaacaggatagctacgccaatagcggagagcgcgatcaaatcacttgtcatccatcttctccatcattaattaatgtcagacagccccatcattgcgcgaaccgcacaccccatgaactgctccggttaataacataacacgatcttaataacgtccgcttctggcaccaggcgcagcgtttacacacaaaatcaaagctgcctgatacaggactttttcaacgtaaccggatccggatggcgaagccagaggatcacggaaatcatcgtgacaagcagacccagaacaacagagacaagcaacgtgccgggaatgccagcgcgctcaagcagaaaggcatacgccgagggtgccagagccgcaagaaaaaatgccggggacagcaggatgcctgttttccgggcatagtgctctgaaccgaacagagtaaggggaagtgcagcctttactaccgtgctcagcccgttcacggcgccgtaacccagaacgaacaccgccgtcgctgccggggtaaaatgccccgccaggcctgtcagaaaacagagcggcaacgcgataccggtaataagattcaggcgtagcgcactgatgcgtgcgccggacatcacgtccagcaagcgggccccgacctggcctgcgccccagagcatccccgccagggctggcattccataagcggccagtatctgtggaaagtgcgtggacacaccggttgacacgaagctcagcagggcaatcaacgtcgcataccagagtccgctgatcatcgtccgccggttttccgttgcccttccctctccggcgtctgacggagcggcaacgggaagcgcaggactgccgtctgagggaacagcgcaaagaaaaagcaggctaaccagccctgcgccagcgtaaatgaagacggcatgccgccagtcggtgatgcgcaacagggccgcccccacaggccagaacaccgctgaagcgaggccgcccagcagggtgaccagtgaaatggaccggcgggcgtggactcctgccattgccaccagtagtgcaaacgcagcgtcatacagggcaaagcgcatcccggcacctgtcaggacccaggcggcaatccacatcgcggcagaatgcgttaaagccatcaggagacatccgccagagatgcaaagtgttcctgccatcatcatcgtacgcccgccagcgcgcgccacaaaaaggccggtcaggggcgataccagtcccataaccagcatggccactgttaaccctgaaaacgtcaccactgcagaccagcccgtctccgccataacagccgtgccgaacgctcccggcatgtagaaggtaattccccagttaatcagctgcgtcatgccgatgcaaaaaacggtgcggcccgttagccgtccgccactcaatctgcatattccggaaaggtggcgtcgccctgcccgagggtgcgctgcatgataaccgtatccagccagcgcccgtgtttgaatcccaccgatctgagcgtgccggtgatgctcaaccccgcggaacgatgcagggcaagagaggcggtattctcgctgttacccaccaccgccacaagctggcgaaagccacggttttcagccaaggttatcgcacgggacaacagctgtttgccgatcccctgccccttaaacaaggggtcaatatatacggagtcttcgagggtgaagcggtaggcatagcgttcacggtaaaaagacaggtagcagtatccccgaacctgcccttcatcaatcgccacaaaccagggcagccctgcggcacgcaccttattcagacgggccatcatttcagttacatctggcggtctggtttcaaaagtggcggtgccatgtaatacgtgataagcataaacccgctgaatgccgggaagatgttgttcatctgcttcagttattttcatcggtacggctcctgttccggtcagaaacggagactaacccggataactatattcagacagatcgtgggacttatcagcggtataaggaaaactttggcatggcaatcctgaatctcgaccacctgactaccttcagactggtaatcagccggggcaccttctccggggcggcagaagcgctcgggctgtcgcagcccgccgtcagcctgcagataaggcagctggagcaggcgctgcaggtccggctgatagagcgaaccagccgggggataaagcccacgcctgccgggatcactctctgtgagcactgcataaaaattgacgctgctgtcggtgcagcggtggaatccgtgtccctgcattcagacgatatcaccggtaccgtgactgtggggacaggcgcaacggcctgcattcatctcctcccccccctttattgcaggagctgcgacagacgcatcccctgctgaaagtggacgtacgtaccggcaatacgtcagatatcgtgcgcggtgtggaggaaaatcgcatagatattggcctggtcaccctgccggcagcaggcaagtgcctgagtgtggccccgctcggaacggaagagtttgtgatcatcctggaaaaggatcccgcagagcagaatataaaaccgctgtctgcggacgatcttttatccctgccgctgattgtatttgaacccggaagcggaacccgttccctgattgatgagtggtttcgggatgccggacaggttgcccgccccgtaatggagctgggcagtattgaagccatcaaaaggatggtccgcgccggtctgggctacagcatcgttccccgcatgtctgttgaaagtccggaagaaagccgggggctgagtgtgtattcaatggcacctgccctgcaccgcacgctcgggacggtaatacgggaagatcggattgtcagcaggggaatcaaagcagtactgaaaagactgagcgccagtttcacttaaatatatctggaaacgttgatcggctccctgcattgtgcggaaggatcgattgccgtttagtcatctgagataggtatgatggtaataattaataacgatgcctttgcggattcagaactaaggacataccagagaggtttaaatgaaagtaaccgctaaaaatgaaaatgggacgatacaacaacttgaagtctcatcgttgattatcacactggacaacggtgaaaccattgagatcagcgatgaaaacaaaaatcgtccaggcgaaatacctgaaggtgtgacagtgtggggaggtaaaatgcctgaggaaggggcgactttagatgaacttaaaaatacaacacgcgggcttggggtgtatccactggcagccaacatggtgcacatttttccctatactctgaggaagtcataatccctgctaagccgcgtccgcgatgcgtatctggcgcagcgcgttgatttccgccgtcaggtacgccttatgaatgaagcgaaatgctttgatgctcgcaagaatgctggaacagcagcgttgcctctaattttttaaatatgccctgcaactttccgactgtgcgaacacatcatcatctctgcacgccgtctggatggcattgacgacgttgccattgccaatcggtgtccagtaattatctactatcaaatatttttgccgctgcttcggctcccggagatgtaagcgagtcaaaaatgacgctattttcttcatataaacgtttttagggctggttttgtattcagcaaaaaccacaatatattccggaaccatataatcccttgccaccagcggcgggatgcgaaaattcacttcagacttagcgcctagctcattaccatccatctctttatattcataggctggcatataggttgtattaccacctggtattgtcacgccgccattgtgcacgttggcatgaatatctttggtaattttgaaaataaattgttgatccggatcgggcgttatcctgaattcatctatcacctgatcaacagagttattattgcttaactgaaattcataacctctgccggaaggcttaaggtatttaacctgcacatcccccgtcaaaaaatcatatgcaaagcttgcaagtaatgtaagcgcccccgtagccagcaaaaactgaccggcacgcttagcaaatttccctatgccgcgggaggtttttttatgtgccgcctgattagtcctttgcgtactacccggaccattttgtttactccgttgggttctgcttttattgtttttcctgcctgccatgtcaaaacccatattttctgattttcattattgaacgtaaaagatcatccgcagttactgattacctgcgaatgatctttccaggcgatggtgatgctaattaatcgccgttttttcctccatcttatcatgtgaaatttttcataaagccctactaaaaatagtaattttttcccataacgactcatcagcccgtcgtgtcagggcggatcctgaaccagatggcgtacatggcgggcaggaacaccagcgtgataatggtgccgccaaaagtgccgccgatcagggtgtaggccagcgtgccccagaacaccgagtgcgtcaggggaatgaacgccagaatggcggccatcgccgtcagcagtacgggacgggcgcgctgcaccgtagcttccaccaccgcatggaacggagccagcccttcctgctcgttgtggtggatctgccctatcaggatcagcgtgttacgcatcagaatgccggagagcgcaatcagccccaccagcgcgttaatgccaaacggctggttgaacagcagcaaggtcggcaccacgccgatcagccccagcggtgcagtaaggaacaccatcaccatcgccgacatcgagcgcacctggaggatgatgatcagcagcgtcagggcgatcatgatcgggaacaacggtgccatcgctctggtggccttgccggactcttcaatggaacccgcctgctcaatacggtagccgggcggcagcgtgtcgatgatcggctgtaaggatttcaggatagcggtcgagacatccggcggttgcaggtgttcggcgatgtcgccgcgtacggtcagcgtcggcatccggtcgcggcggcgcagcagcggatcttccatctgcacggtcacttcaccaatctgcgacagcggaatgcgctgcccgtcggcccccaccagcgtaaagccttcaattctggccggatcgaggcgaatatcccccgccgcgcggcccgttacctgcaccgaacgaatgtcttcccgcacgctggtgatcggcacgccggagagcaggaactgtaactgctgcgcgacggcgttcgacgtcagccccaccgcctggaggcgatcctgtttcagggtgaaatgcagcgtcggcacgcgctggccccagtcggtattgacggtgcgcatcatcgggctggcctgcatcactttctccacccgcccggcgatatcgcgcagcgtggcggtgtccgggccgaccacgcggtacgccaccggatagggggagtacggaccaaatacaagttgagtgacgcgtacgcgggcttccggtgccagcccggcggcgaccgcgtcacgcaggcggaatttcagcgcttcacgggcttgctggctgtcggtcagcaccacgattttggcaaacgacggatcgggcagctcaggggccatcgccagataaaagcgtggcgatccctggccgatgtatgaggtgacaattttcgcttccggctgttgttgcagccaggcttcaattttcgcggtggtggcgctggtctgctcaatggcggtgccataaggcagctgcacttccaccagcacttccgggcggtcggaagtcgggaagaactgttttttcaccagccccatgccgaggatcgccacgctaaagatggcgatcaccgcgcccgcgactatccatttgcgggcgatgacgcgggtcagcaggcggcggaaacggttgtaatggcgtgtgttgtaaatggcggcatgtccccccgccacggttttgatcgccggcagcattttcaccccgagatagggcgtaaacaccactgccaccacccaggaggcgataagcgcgatgccgacgatccagaacatattgctggtgtattccccggcggtggactgggcaaagccgttcggcataaagcccacggcggtaaccagcgtcccggccagcataggcgcggcggtatggctccaggcataggccgaggctttgatgcggtcatagccctcttccattttcaccaccatcatttcgatggcgataatggcgtcatccaccagcagccccagcgcgaggatcagcgatcccagcgtaatgcggtcgaagtttttgccggaggcttccatcaccacaaagacaatcgccagcgtcagcggcacggcggcggccaccaccacgcccacgcgccagcccatactgacaaagcacaccaccattaccaccagcagcgcgacgaagaatttgatcatgaactcgtcaacggcggagctgatgtttaccgactgatcggtgaccttgctcagcgtcatgcccaacggcatttcagcgttgatgctggcggtttccgcgtccagcgcttttcccagatcgaggccgttccagccttcacgcatcaccacccccagcagcagcgccggttcgcgctgatggcgcaccataaaggtggccggatcttcatagccccgctccaccgtcgccacgtccgacagcttcagcgtgcgcccctgcgccaccagcggcgtgtcgcggatcttctgcaacgtgtcgaatgcgccatcaaggcggatgttaacctgcggcccctgtgtatcaatggatccggcaggcgtcaggacattctggttattaagggccgcgaaaatcgcctgcggcgaaatccccagcgtggcgaggcggtcatgggagaaagagacgaagatgcgctccgcctgctcgccaatgatattgacctttttgacgcccggcacgtgcagcagccgctggcgcagggattcggcgtcgcgcaccagcaggcggtgcggctcccctttcgccttcagcgcgaacagcgcaaaggtgacgtcggagaattcatcgttcaccatcgggccgataacgcccgcgggcaggtttctggcttcgtcgccgagctttttgcgcgcctggtaaaattcctcctgcacctgcgagggcggcgtgctgtcctgtaaagagagggtggtaaaagccatgcccggacgggtgaacgtctcggtacgatcataccatttcagctcctgtagacgtttttccagcggttccgccacctgatcctgcatttccagcgcagtggctcccggccaggcggtgatgatggtcatctgcttgacggtaaacggcggatcttctgcgcgccccagttgaaaaaacgacagtatccccgccacggtgatgagcaggatgaggaacagcgtgatggagcgctcgcgcaccgccagcgccgacaggttaaatttaccctgactcatggctggctcccggctgcgcccgccgcgatacgcacggcttcgccttcatgcagcaaatgcgcgccgagggctaccacctgctcccctgccgtcaggctaccggtgacctgtgccgcgtcatcccccagcccccgtacctgtaccggtttccagcgcacagtggcgggcttaccaacaatctgccagacgcccggcccttttccggcatcataaatcgccgccagcggcacctgcataagcgcatcccgggcttcgccttcggcaagatgcagcgtcacggtggagccgaggggggctgcggccagcgcgccttgcagcacatagcgggcttcaaaggtgcgggtgacgggatcggcggcatccgaaagcagacgcagcgtggcgggcaccggcgggtttttactggcgtagaggctggcctgcgcctcgctgccgatggccggacgcagggtttccggcagctgcacgatggcttcccgctgcccggcccgggcgagtctgaccaccggctgcccggcgctcaccacctggccgggttccgccagggtttccatcaccacgccgtcggcgtccgccagcagcacggcgtaaccggtgctgttctgcgcgacattcgcctgcgcctgcgccgcgctgaggtcggcgcgggcgctgtcggcggcggctttgatctgatcgtatgccgaaatcgacaccgcgccggttttcaccaggctgcgatagcgggcttcgtcggcagcggcttgacgcgcacgggcgcgggccgcagaaaccgcctgttgctgcgcctgcgccgtcaggttcagatccacaggatcgaggcgcatcagcggctgaccacgcttcaccgtctggccggtatccaccagccgctcgaggatcttgccctgcacccggaaaccgagatcgctctgcacgcgggcgaccaccaccccggtaaaggcgcgggactgaccggcagcgctcaccaccgttgccgcccgtacctggggtggctgcgtgcgcggatcgtcctgactggcggtgtcaccgcaggccgccagggccagcggcaggaagcaaacagcaagggagacaggtttaagcctgaacatgggatacctgattaaatggaaggaacaatggcggcattcttaaactagtgacaaaaattgtcaatggtcacaaagcgagacattggaacttatttttgttcgatcgggccagttgacagcaagtgaccgtttgataatgtagtcacatttgcaccgtggctgaacgggggaaggatgaaaaggacgggtattctcgggttagatgcgctgaccgaagcgctggtcagggatctctttctggcggatccgaatgcgcaggtgtttctctcccccggcaccggcgagcgggcgcaacggttgtcgcaggaatttccctgctggacgctggacgatccgcaggcgctggtggatgaagtggacgtgctgattatcagttctgacgcggcatcccggccagaactttatgatcgtgtgcagctgcgccgcgcgttgaacctggtttcactggtgccggaggtgtcgtctcaggctttgcgaaaacgcttccgccaggcggagtgaagcggcaccgtgccgctgaacccggcgcacagggtcagcgtggcgaagaacgccacggcataacccgccgacagccgatccatgatcagcccgaacagcggcgatccggcagtctgccccaccgccagcgtcagaaagcagatcatcagtcccgtcgccgggcgttccggcagcgctgaaacgccccacatcagatagatgccggagatcgtaatataggccgcgccgaacagcgccccgccgataagcgtcagcgcgggcgtcgtgctctcaaagccgatcagcagcatacccaacgccatcgccagcaaaaacagccggtgcatgagatccataccaaagcgcgccaccagcgttcccgccgccgcaccggcgatgcccgccgcccccgtcaccatccacagcacgcctgcgccggtatcgcgccactccagccgcagcgcgaccagctgactgccgaacgaccagatcgccgtgctgcccgcgcccattaaaaacgaggcgacgatcagccgtttcagggacgcgctgatcggcggcagaccgccagcgcggttgcttgcgccaggcgaactgcgcggcacaaaacgcgcagcggcaagcgccattgcgaacgccaccgcggcaaaaagcccgaacgccagccgccattgtccgcccatcgccagcgccacggggcctgagagcaccacgcccgcgcccgtcccggcattaatgatggtgttagccgcgccctggcgatccggctgaaccgcagccgacaccgcggccgccagcggcggcgagactaaccccgtactggctccggcgagcatcaccgccgccgccagccacagcggggatgacgccagcgcaatgccggtcatgcccagcgctgccaccagcgcggcggtcagcgccaccgtgcgcggaccgatgcgctccgtcagaaaagccgccagcacaatggtcaggcagtaacccagaaaggatccgccggaaatcagcccgctcagcgtcggggaaagggagagatcggcgtcgatgcgcggcaaaaacagcccgaaggcaaaacgcgcaaagccatagcagacggcgatcagactgaagccggtggtgataagccaggcgtttttactcatgatttagcccccgccagcagcatcgccgccgtatcacgcgcggcagccacggtgcccacgccgcggtaaatggccgccgccgtcgcgccctcaaagaggatgaggatctgctccgccagccggtcgtcctcatggccgatttcacccgccaccagcctgcggatggtctgccaggtcttttctttatgggcgcggatcaccgccgcgatttcgggattgtcgccgccggtttcgccgtacgcccgcagaaacagacagcccagacagccctcttcccgcagccagttatccagcgcatcgaacagccctttgatgctctgctccttcagctgcgcgaaaaagcgctgatcccgctcctccagcacccgcacgatcagcgccgttttgctgccagcatgtttatagagcgtgcggctcgacatgcccgccgcctgcgtgagccgatccatcccggtggcattaaaaccatgccggtaaaacagggatcctgcggctgagaggagtttgtttttaatgtccataccttaaaagtaaaacgatcggtttactctgtcaaactgaccgcctcgcctgataccggacgccgcagcgccgattttcagccttatccccacccttttgtttcacaatcctgtgacatactatcggtatggcagtacatgtgtgaaacaaggagataattatggataacaaggcgagccttaccccggaacaggcccttgaccggctcgaagcgctgtatgaccaggcggtcagtgacttacgcgatgccatcgcgcagtacatcgataagggcacgcttcccgacacgctcgcccgtgcacaggggaaatttgtgtacccgttgctgtcggtcagctgggacggtaacgcgccgaacgcccggaaaacccgcgcttatgcccgctttacgcatcccggcagctatcgcaccaccattacgcgcccggcgctgttccgcccttacctgctggagcagctcaccatgctgtatctggattacggcgcgcagattgaagtgggtccgtctgaacacgagatcccttatccctatgtgattgacggatcggcgctgacgctggaccgttcgatgagcgcggatttaacccgccactttccgaccaccgagctgtcgcagattggcgatgaaaccgccgacggcatttatcacccggcggaattctcgccgctgtcgcactttgacgcccgccgcgtggacttctcgctggcgcgtctgcgtcactacaccggcacgcccgtggagcacttccagccgttcgtgctgttcaccaactacacgcgctatgtggatgagttcgtgcgctggggttgcagccagatcctcgatccggacagcccgtacgtggcgctctcctgcgcgggcggtatctggatcaccgccgaaaccgaagcgccggaacaggccatttccgatctggcgtggaaaaaacaccagatgcccgcctggcacctgatcaccgctgacggtcaggggatcacgctggtgaatatcggcgtcggcccgtcgaatgccaaaaccatctgcgatcatctggcggtgctgcgcccggatgtgtggctgatgatcggccactgcggcggcctgcgtgagagccagtcgattggcgattacgtgctggcgcatgcttatctgcgcgacgatcacgtactggatgcggtgctgccgccggatattcccatcccgagcatcgccgaagtgcagcgcgcgctgtacgacgccaccaaacaggtcagcgagatgcccggcgaggaagtgaaacagcggctgcgtaccggtacggtggtgaccaccgatgaccgtaactgggaactgcgttattcagcgtcggcgctgcgctttaacttaagccgcgcggtggccattgatatggaaagcgcgaccatcgcggcgcagggttatcgcttccgcgtgccgtacggcaccttgctgtgcgtgtccgataaaccgctgcacggtgagatcaaactgccgggtcaggccaatcgtttttatgaaggggcgatttcggagcatttgcagatcggcatcagggcgattgatctgctgcgcgccgaaggtgaacgtctgcattcgcgtaaactgcgtactttcaacgagccgccgttccgctaacggcagaaaagcaaaaagcccgctaaatagcgggcttcttaaatatggctcctctgactggactcgaaccagtgacatacggattaacagtccgccgttctaccgactgaactacagaggaatcgtgtgaacggggcgaatattaacggcgctctgtggccttgtcaaagcctgatttcaaaaaaacgcgcgattgccgaattattccgcaccccgttcaaaaagagcgcagcttaaggccgtcactccgcttttttctgcatggcgcgcggatatttccacagccagcggccgctgaccatacgccagtagaacagcgccccgcgtaccgcccagtcgaggaacatccccagccagacgccaatcacgcccatgccgagcacgatccccagcgtataacccgccaccacacggcagccccacatgccgagcatcgacacccacatggcaaagcgggcatcgcgtgcgcccttctgcccggcaggtaatacccaggaggccgcccagatcggcataaaggcggcgttcagccacagcaggatcttcaccacttcctgcacgtcctgctccggcgtataaaacgcggccagcagcccggcgaagggcgcggtgccccaggcaataatcgtcagtccgatggtcgacagccagaacacatggcgcagctggcgttccgcctggccgatctgtcctttaccaagacgtctgccggtaataatggtggacgccgaacccagcgcgttacccggcaggttgattaatgccgccacggagaaagcaataaagttaccggcgatgacgttggtgcccatcccggccacaaacatctgggttaataatttgccgctgttaaacagcaccgattcaatactggcgggaataccgatgcccatcacttcccagataatggcgaagttaagcggcttaaagtaacttttcagcgtgatacgcagcgccgggttaaagccaatcatcagcacccagatgatcgccagcgcgccgatatagcgggaaatggtcagccccagccctgcgccggcaaagccaatccccggccaggagaacaggccgtagatcaggaagctgctgataataatgttgagaatgttcatgccgccgttaatcagtagcggaattctggtattacccgcgccgcgcagcgccccgctgccgatcagcgtaatggccgccgccggatagctcagcaccgttaattcgaggtaagtcagcgccagggctttcacctctgccgtggcttcgcccgccaccacatcaataatttgcgcgccaaaatagtggatcaccgccgccagcagcgcggcgaacagcgtcatgatcaccagcgattgccgcgccgccgagcgcgcccgccgccggtcgcgtttaccgagactaaaagccaccaccaccgtggtacccagatcgaccgccgcaaaaaaggccatcaccaccatgttaaaactgtcggcaaggcccacacccgccatcgcttctttgcccagccagctcaccaggaaggtactcagtacccccatcagcagtacgcaggtattttcgaggaagataggcacggcaagcggggtgatttcacgccagaaaagtacacggtaactttttcgtttagcgtaccagggcgtgcgggcgacggcctggcgtaaagcggcagtgacgttcaaaatggaccttagtgagaaagtgaaacttcatttcaaatgatgatggagaaatgctaatcctgcaaagtatttcccacaaattttgctggtatttccggcaaatcggcgacgggttcgccagacgaacgcgagagcgtaaaatgcggtttgacaaaaagtttttcgccgctaagattagctcccacacgattcctctgtagttcagtcggtagaacggcggactgttaatccgtatgtcactggttcgagtccagtcagaggagccacatttaaaaagcccgctttatagcgggctttttgctgtctgcaattcaggcggccttactcgttgccccactgattcaggaaattggcgatctcatcaatccgctgctcgttaatacccgcttctgcggccatctcctgctgcgcgtcctcgctgatctcttcgccattcatcaggcgggtgatcagtaactcaaaataacgcgccagcgcatcgcgttcggtttcgcttaccggcgtttcggtttccgtcgcgtactcgtcggcgatgtcataatatttgatgggtacttcattgctcatatctggccctcaggggttttcgcattaagcgtattagtatatcgcacgtggcgggcataaccgcagcgttcgtttacgcgccgcgctcagagcacggtaatattcatgctgttaactatgctgcgcattttctcgtccagctcaccgtcgatcaccagcgtactggcaaggctcagatcgccaatggcgaatgccgaggccgagttgattttttccggcgaggccagcaccacggtttctgccgccctttctgacagcgcgcgttttacgcaggcttcttcgtaattgccggtggtgaaaccggcacgttcgtgcacgccggtgacgcccatgaaaaacagatcggcattgatacggcgaagggactccatcatcgccgcccccacagtgaccatcgaatgcttatacagctggccgccgaggatgatcacctccaccagcggcagattgatcagcgcggcggcaatggtcgggctgtgagtcaccacggtgaacgccagatccggcggcagcagtttaaccatctcttcagacgtggtgccgccatccagaatgacaatactccccggctggatcagggtgatggctttactggcaatattcttttttgctgccatatgcacgttttttcgtgtttccagcgaccccgtcgccgccgacaccgccagcgcaccgccgtgtacccgttgcagtaatccttccgccgccatctcccgcaaatcccggcggatggagtcttccgaaatgttaaaccgctggcttaaatcgcgggacagcacctgcttgtcccgcgccagcatatcgaggatcagttgtttgcgttgccctgacagcatgttttcacctttcacgaatgatcttgattatgcacgattgtgcatgatagcgtatttcctgtcaccttttaaaaaggaaataacatgtctgcacaacccaatattcgccatctccgtgaagagctgctgtccgataactggtacacgcttaaaaaatacactttcgaactgcaacggcgcgacggcagctggcaggcgcagagccgcgaagcctacgatcgcggcaatggcgcggccattctgctgtataacaaagccaaaggaacggtggtgctgacgcggcagttccgcctgccggtgtacatcaatgggcatgatggtttgctgattgaggcggcagcgggtttactggatgacgcctcgccggaagcacgtattattgccgaagccgaagaagagaccggctttaaagtggccgccattgaaaaagtgtttgaagcctatatgagccccggctcggtgacggaaaaactctactttttcattgcggaatatgctgatgaagatcgcagcggcgcgggcggcgggctggcggatgaaggagaagatattcaggtgctggaatggccgtttgaaaaagcgctcgccgccattcgcagcggcgagatccaggacgccaaaaccatcatgctgatccagcacctggcgctacaggcagtttttgagaagtaacaatcacagcggggtgtgatcaccccgccgggggtcagcaaaactacagcaactggccgccggaaatatcaaaggtggtgccgttcgcccaggccatgtcatccgacaaaatggcggcaacggcgctgccgatatcatccggtgaacccacccgccccagggcgatcccctgcgcgacaaaatcattcaccgcttgattatcccgcaccaccccgccgccaaaatctgtggcgatcgcgcccggcgcaatggcattcaccctgatctggcgcgcgccaagctcaacggcctgatagcgggtcagcacttcaagcgccgctttcatcgcggcatacaggctgtatcccggcagcgtaaagcggacaaaaccggacgagacattaaggatgcgcccgccgtcgttgatctgcggtaataattgctgcgtcaggaataccggcccacgcagatgtgtggcggcaagggaatcaaattgttccattgtcgcctccgtaaagttcgcgaacaggccgttaccggcattgttgatcaggaaatcgaaacgctcgaggccaaaagtgttcctgagcgtatccgccacggcctctgagaatgccgcaaaaccggtcgtctctgtgatatccaggggcagcatcaccgccctgccacccagcgcggcgatctcctgctccaggcttgcggcttccgccgcgccgctgcggtatgtcccgataatatccacgccgcgtcgggcaagatgaagggccatattacgtccgaggccacggcttgcgccggtgattactgcaattttattcgtcatgggctgtctctcgtcaggcgcaccggctggtgcagggttgagccgccatgataagtaacccccggcgtctgacccacgcctgaaacgctcagtttattgcctgattgtctcagtggcttgtgcctcctgcgggcgcaggtataatcgcccgatgaaaaacaccctcgccccgcatctggatctcgccctgcggcatgcctcgccgggcacgcccgcgacccgcattccacgccttgaactgaccatcggccagggctctggcgaacgcgcgccatgcctgtaccgggcgatgatctgctttattttgcagggcgcaaagcaggtggtcattaacgatcagatcctgagctacggcagcgaacactatctgatcagcgcgctggatctgccgttgagcgggcacattttcgatggagaagacaggcagccttatgcggcggtgtcgctggtgctggatgcagcgatcctcgcggagttagcggccaacatgccgccggtgcgtgagcgggagcagagtggcatcggcattatgatcaacccgctcaataatgtgctgcgcgatgcccttctgcgcctgatggcgctgctggatacccccgctgatatccctgtgcttgcgcctatggcggagcgtgaattgctttatcgtcttttgcaggagccgcagggacaactgctgcggcagatcgcccggccagagggcgcactgaacggtgttcgtcgcgcggtggcgtggatccgcgatcactcccgtgagcgcctgcgcattgaggatctgtgtgaggtcagcggcatgagccgcgccagcctgcaccgccattttctgactattaccggcagcagcccgctccagtatcagaagcagctcagattacaggaagcccgccagctgttactcaccggcgagcatcgcgccgctgacgtggcatttattgtcggctatgagagcgcctcccagttcagccgcgaataccagcggcagttcggcgcgcccccggcacgggacgcgcgtcagatccgccagaccatcacctgacccagactcagcccggcccttcgctgcctgccgccagcagcggtaccagcacatcgctgactggcgttgcaatcccctgtgccctgccgtaacgctggatcacgccgttgcggatgtcccactccagcgggcggttggcctggcgatccgccagaatggaggtgcccagatcggcgggcgcaccctgaaagcccgcgaggatctcctgcggcacctcatcgcccagcaccgccccctgcgcccgcgccaccgtcagacattcctgcagataggccagcgtcagcgcggaaatatcgtcgcgtctgaacattccggcacgacgattcgccagcaccatcagccccgccgccgcgttctgcaacagcttgcgccaggcaatggaaagaaaatccccggacagctccaccgcgcagcgcgtgccgctcagggcatcggcaatgcgcctggccgcaggcacgtccggcagggtcagacgcggtttggcccgcagccagacggaggcatccgcttcccgctgggccggaaaccacaccaccgagggcaccacggtcgcgccctgcacataaggctcaagctggctttgctgctcaacgccgttttgcagcgcgcacaccacggtgttttcgtcgcacaactgcgccagccaccgcgcgctgtcggcgtcctgggtggttttcaccgccacaaacagcagatcgaccggctggctgaccgccgccggatcgttaagcaccgggccgggcaccaccacctccccgtcgtcgtcacgcagaattaactgcggatgggcggtgcgcccgcacagcagcggcgtacgtcccgcttcatgcagcgcagccgcgatagtggtaccaatagcgcccggaccaagcagggcaattgcaggacgatcggacatcatgtgctctcctgttctggttaattaccccacagtgtatcagcagccttgcaaagccatcagtcctgaatcttcagcctttgtaacgcgcggcggcttccgcctggttgatgtcggccatcagcgcctgtcgactggcgtcgagggcatcccagcgggcggcgttgcgtaagggaggaatggtcacaggctcacggcgatcaaacccgaccagcgcggcatccaccagctcgcccgcgttcataaattgtgtcgagtgagcgatgtcgatcccggcgcgcgcccagatctcggtgtaggtcccggctggcagcaccgcctgcacatacacgccggcaggggcgagttcgacctgcaatccctgcgacagaaacagcacaaaagctttggtcgcgccatacacggacatggcaaattccggcgccagcccgaccacggaactgatgttaacaatagcgccctcacccgcctgaacaaatcgtggcgcgacggcgctggccagccgggtgaccgccgtgacgttcagcgcgataaggcgctcaatggacgccgggctctgatccgccagcctgccggtctgcgcaatgcccgcattgttgaccagaatgccgatctgtttgtcctcgcgcaggcgcgcttcgacacgcgcaacgtcatcggactgagtgagatcggcggcaagcacatcgacgctcacgccggtttcctgttgcaggcgcgcagccagcgcatccagtcgggctttgtcgcgcgccaccagcacaagatcgtggccgcggcgggcgaaacgttcagcgtaaacggcaccaattcctgaggaagcgccggtaatgaggacggatggagtggtcataacatacccttcttgaatgcgttaacggtttccggcgtgccgggtgatggtgcgggttaatgatgatgatcgtaatctatcctgtcaacgtttttgattatggtcatcatcaatgtatacttgccgcaggaatgttcagcattgaaggcgaaacaatgaaagtgtctaaagagcaggtgcgtgaaaaccgcaggcgtattgtggaaacggcgtcggtgttgtttcgtgaacggggctatgacggcgtgggcgtggcggagctgatgtcggcggccgggttaacccacggcggtttctataaacattttgcctcgaaggcggatttgatggcagaggccatgcagtgtggttttacgcattcggcagaccattccgccgggataaaccgggagcagtttattactcgttatctctcgcgccagcaccgggataacaagggccagggctgcgtgatgtcggcgctgggggcggatacctcccgccagtctgagacgattaaagcgacttttgcggcgggtcttgaacagcaactggcgcagctgagtcaggagccggacgcggccggcaagcggcgtgccgatgtgatcgacacgctggcgcatctggtcggtgccatggtgttatcccgcgcctgcccggatgactcgccgctggcggatgaaattctcgcggtatgccgcgcccgccttctggatgagaacacgccggagcagtaagcttcccggcggtgtcattatcagagccaggtttcgtgcagatgtcgccacatcacccggccatccgcaccagtttcaaacaccgccgtggcaaagcgcagcgtttcgccctgacccgggatcgtctgtcgctcctgataagtgacggtagcgccggtgtcgctttccgctatcagttgcagatcttcaatggcgatcgtcagccccgcccgcacaccgcgctgggtgcggaacagattatcgaccgcggtaaaatccatgatggcaccgcgcggcgtcaccatcgagaacgccgggcaaaagcgcgctaataacgcgtcgcacaccgtatccggcgtgtgtgcatcacccagacagtcgcggatcaacacgtgggcatcccgtacttcctgaaaataacgattcattgttgctcctgattaagttttaaaaccacgtgctgattggcgatccgcaggcagcacactatggggatgagggcgctgcccgctgctatcgcaaagcacagatgatacgcctgcatcaccggcagcccgcctgccgccagtaagccatacagcaggctgatgacggtcacgccgcagcagaaactgagctgacgattgatgttccactgggcgctggcatccgccagatccgccccgttaatctgaataaacgccgcactttgcgcggtgctgctgcacagactgctgccaaagcccatcagggtgaaggccagtatacacagcggcacatccgccgcactggccgtcagtgccagcaggccgatccctgccccatgcaccagacaaccggtgataaacagcgggcgcggccccaggcggttgaaggttcttcccgtcagggtgatcgccacaaaagaggccagcgcccagggcagcatcattgcgccggtgaccgtggctggcatcgttaacaggttttgcagataaagcatggcgacaatactgacgccggtaaaaatgccgggcacgaactgatagatcagcatcgcagtctgcaacagcggatctttcatcagccgcaggttaagcagcggcgcgggtttgttcagggcatcccgcacatatgcggccatcacaagtaatccgagcgcgaacagcaacgccccctgccacagataaagccgctcgcctgcaaaggttaagccggtgaggatcaggatcagcgccacgccgccactgagtaacccgcgcagatccagccgctcacccgtggttgaaggcgcatcgggtttaagccaacagcctgccagtattaacgccaccagcgccagcggcaggctcgccagaaacactccgcgccagtgaccactttccacaaaaagcccgccgagcgcgggcgataacgccggagccagcagcgccaccagcatcaccgcggacgagagttttgcccgttcatggctgcgataaagcgcgtaggtcatcgtctgcccgatggggatcagcagcccgccgcccaggccctgcacgccgcgccaggcaatcagcgaataaatggatgaggcgcttcccgcgccgcaggtgcccgcgataaaaatccccagcgacagcataaacaccagcttcgcgtcgatgcgccgcgccagccagctgctgagcgggatcaccagcgtcagccctaaaatataggcattactgatccacgccagctcgctgacgctggccgcgaactggcggccaatctcgggataagccacgctggcgataaacatgttcaccagatcgataaaaaaacccagcagatatacacaggccacccgcacacgatacgtcatgtttttctcagcattaacaaacagagcgcgcactataagcgccgtacggcggcggataaattcccttcccgtggttttactgtcaaaataattttgacaatcagaatacccgaaggaattaacgatggtgaatatgcagcggctggagatgtttgtggcggtggcagaggccggaagttttacccgcgccgcgcagacgctggggctgacgaaagccgtggtgagttttaatatcaaacagctggagcaggagctgggcgtggcgttactcacccgcagcacccgcaaagtggcggtgaccgataccggcgaacgcttttaccatcgctgccagcagttgctacaggacgccgaacgggtgcttgacgaggtgcgcggcgatcacggtggcctgcgcggtttactgcgcatcaccaccaccccggaatacggcgcgcgcgtggtggtgcccgcgctggccgactttgcggcgctgcacccgcagctgcgcatccagcacgtagcctcctcgcaaaatgacgatctgatcgccgggcgctttgatgtcgccatccggctcgggcaactggcggattccacccatcacgcgaggctcatcgaccagtttgatatttacccggtcgcctcccctgcttatctgagcacgcttcacgatggcggtatcagcactcccgaacagcttgccggggcaacgtggatcgcccacagccgtctttcctcgccgctgaactggcaggttgtgcaacccgatggcgatatgctgctgtttgcggcaagccagccgccttccattatggctgacagcgcggcggcattgctggcatttgccctgagcggcgcgggcgtggcgctgctgccgtcatggctggtgcaggacgcgctggcggcaggaacgctgatcgccgtgttgccggatcaccgttttccccgccagggcatttatgcgctctacccgaatacccgccacgtgccggagaaggtcagagcctttattgattttttacacgcccgcgtcagcgtgtgaggatttccgggaggcaatcctgaggaaattacagtaatagccgatggaggcggtgaggcagagcatatagccgaaggattcgctgccctcctccacggcgtttttcacgatgcgcacgtagccgtccgcgaggaccgcatgccatatcgcctgcataccaaacagccgggagaagaccagcaccgccagcagaccgctcagcatcacgccgtaccagggcgaacggatgtactgcgtcagctgtgccagcgtctggcgatgatgtttgagcggaagaatgaccgcgcagagtgttgccagcagcgcaaaccatacccagctgccatgggaaatcagatcaaagaccgcatccagttcgcggatcagcatagtcaggaagaagccgccgaccagaatattgcagtagcgcagcagctcatgctttttcgccagcaggaaatgaatggcgacgatgcccgctaataccagctcctgcacgatttcggtcagcgaaacttccggaatatcgtggtcaaaaatagcgatatcgccccacaggcaaagtacggcaacagagctgagcgccgccgcgccaagaaagaaaagaaaggttctgagtacagccattactaccacccaaaatgtacaaaggcagtatgttaggttatgggaaggggaaattcctgttcagtttgtgcgatatagcggtggggttttggcatgtcaggctggtggcgcggatgtggggagtggggatatggcacggtgatgggagagggttttgttggtatagctggcttactaaacaaacaagccggggaacgggggaaattttaaggctgaggctggttagaattattagctgcgaacgttgagatttaccattatgaccgctttaagtgaggagtgggcatattgagtcaataagcaaaaatgaatataagacatactcgttctaaagtaaaaatagcatcaagcataattaaattacccataataccttagccatcagaaaatcaccccctttttaaacaataaaaagggggtggtcttaggaaaaatattgcgcaatatcattctcaatttttagtatgcttattctaaatatagtaaactcgtcaagcgttatgtctttagcatgagcatctgacctatacttatttataaaacctaaggaatcgaatgtttctttctttgatgtttcaaatatattttcaaaagacccccattctttagatattatcttcctcagatcttcgaaataaattgttgatagatttgggtcaaaaatctcattaaaggatttagaaacatactctaattttctatttttacccagtatatccaacactgcatctttcgctaagtgctctccatgcatagattttaatgtcgttttaattatagtccttaatcttttctcaactgcattacgcctttcagatatttccgcccacttttgctcaacgcttgtttccaccttcctgtatttatttatttctaacagataactcctcatggaatcaatgataaaataataactatcattatcttttcctaaaataccataccccaataaatgagccaatgaattttgttttttgctggagttttctttgaaggtttcgttatcttcatttgctagagtaatgagaagttcatattcttcattataatgctctttcaatacacctataatcatttctaagtaattaaaactgttctctccaaaatctttcacagcatccctataagatatcttccctatgctgacaggttttttttgactgaaagatcttctagcaattatgctacaaacttgacgaataagaaatggatgaccaccgtattcttcgttaatattagtatatatcgcttcctcaaaattcacgcccattctttttccgattcttcttatcatgtctcgtgtggaccgaatgtcaaaacctggcagataagtaggggtgaaatgattaaataatgggttatcagaactgtctattcttggcgtttcaatgcacgaaggatttgtgccaactataagatatgctaaatttatacctacagtttgaaaaactgttctcattgattgccaaaaatatagaaaatctgaacccttactccaatgctcagttggggatgtaatcctagaaatattttcaatttcatcaaatattaagaataatttcttccctttttctttgttaatgtctctaacaaatctcgctaaaatttccgcagcattcttttcagtgaactctttttcttcaggaaggtaagattgaagataattatcttctttcgttttcttgcatacataatagatagcctcgttccattttcttttattaacggatggactttggcagtcaatggtagtaacaatttcgccatttttttgtagatttctagatatggcattaataagagaggtttttccagtttttcgcaacccgaaaataccagaattattaccacccttcattcgattgatagttgataatataatttcatttcttccaaagaaaagccaatcacttttcagcggcgcttcgaatgaaaaaagatctctattatataaatatttctgaactctgttcctaaaaaagtagccatcggaatttgctttttgcgtttcagcatatgtgaaaggaattatattggctgtttcaggctcctttttaataagttcactgatattttcttctatattttgatctttactaatcaaaatacagcatgttttatcaactcttaaagatgaaagctgtttcgctgcttgttcaatagcatcaagtgtgcgtgattggaaatttgtatactcgctaaaaagaacaattacttccctatcaaggttgaacatttctatgtaaatatcagttgggcgtaacagtataaatttatatttactgtttgatgtaagtgttattatccccccgccattagtcacataaaactcttttgataaaacattaattatgtctttttcttgctgactaaagtggtcttctctaacagaagtatgcttaccgggatagacatttatcgattcagtcattttttccatcttcagttaagggtgtatactcttttatatcctttttttaagcacaaatctaatggattaagagaaatcccattttatagagacatagcgaaatccagtgttgtgttattctttgtcggtaaggttgattaacccagcaaatacaaggcccaacctattgatttattaatgattttccttctgtcatgtctctagccctaactgaagaaaacaactaagcactaccttaaggaacgcaggtttgaattgacgaacgtataagtaattaaattgttttttgccgctagaagactgttgcggtaaccggataaactcagttgtaatttgacccatatcacagcaaagcaaagcagcattaacttgcatgcgccaatacgaacggtgcttatcggtttctgcaagttaacttttgaatagaatcctatacattgtcaaaaaatattgtctcaactcccacttctagcacaatgcagacaagcaaccttcccaagccacactcccaggtgccacgcccatcccccgcagcacctgcccttatcccctaccccctcacctcatcaataaatctcactccgtccgccgttcttacccagcgcggggcgttgatttcctcggtcataaacgccatcagatccgccagtagccagcgcagttgttcttcctgctgtgacgtcacgctccggcacagcaaaacctgcgtcagggcggcgcagtattcgccaagggtatcggaatcaggttcaaaacggggaacgtcgttcggcagcgtatccaccgtaaacctgtcctgctgttcaggcgggatcggctcacccagttgcggtttaagcagcgcgaagacggcacaaaggcgtccacacagcgccatacgcagcgcgggatcaagtgactcagcctgcgcttcggcaagctgatgacaatagtcggcaagcacggtgaattccgtgtcgtcgtcaaagggaacggtgagtaacgggtgagtctggtcaaagcaggtggtcatcaggaagcctccggtggcgagtagattaaacgtttatcaccagtatgaagtttcaggaggccaatcccggcacctgattttgcaggtgcggctgcacgataccgctttcagataaaaacggcaatatcagggtgttaccggtgaaggaatttgcgtagcgtctcgcaggaagattatttcccttacatccttacatgctcaataaatgcccgcagctttggcggcatatgctttctgccggagaaataaaggtaaaagcccggaaaggtcggcagaaattcatccagcaccgtcaccagctcgccgcgcgcaatatatggcgcgtacgtctcctccatgccaaagctgatgccgcccccggcgcagacggtgcggatcatcacccccatatcattggtggtcaactgcggattaacgtccacatcaaattcctgcccctgccaggcaaattcccagcgatagggcgacacgccgggggattttcgccagccgatacagcgatgatccagcagatccttcgggtgctgcggcgtgccgtactgcgccagataatcaggcgaggcgacggcgatctgccgctgcatggcggacaccggcaccgcgatcatatcctgggcgatcacctcccccagctgcacgcccgcgtcaaacccctgctctacaatgtcgtacgcctcatcggtgatggtgatgtccagttcgacatgcggataagccgcaatgaacgacgccagcatcctgccgtcaataatgcgttcggcaatcgacgacaccgccagccgcagctggccgcgcggtgccgccagctgatcggcgatatcgctcaccgcgccgttaagctgttcgatggcgggcgcgacctccgcataaagccgctggcccgcttcggtgaggttgatgctgcgcgtggtgcgctgcatcagggagatgttcaggcgatcttccagccgccgcagcgtctgactgatggccgggcgcgtcacccccagccgttcggcggccagacgaaaattgcgcgtctgcgccacgatcacaaacacctcaagcgcgtttttatccactgtcattggttagccatcgttaccagtctgttaagtaatgagcggattatctttatagtctgccgggcgtaagatcaccagcgttaaccgaacaggagaagacccatgacgaataaagtgatcttaattaccggcgcatccagcggtattggtgcaggcatcgcccgcgaactggcaaaaaccgacgcggtattactgctgggcgcacgtcgcgaggatcgtctcgccacgctggcggaggagttgcgttttaacggcgcagaggtggacgtgaaagcgctggacgtcactgaccgtacctctgtggaggcattcgccgccttcgcgctggaaaagtggggacgcattgatgtgatcgttaataacgccggtattatgccgttgtcaccgatggcgtcgctcaaagttgatgagtgggatcagatggtggatgtgaacattaagggcgtgctgtatggcatcgcggcggtgttgccgtcgatgctggcgcgggaagcgggccatatcattaatatcgcctcgattggtgcgctggcggtgtcgccgacggcggcggtgtactgcgccaccaagtttgcggtgcgggcgatttccgatggtttgcgccaggaaaacagccagctgcgcgtcacctgtatccatccgggggtggtggaaagtgaactggcgggcaccatcacggatccgaccgccgccgaagccatgaaaagctaccgggcgattgccctgcaaccggatgcgattggccgcgcggtgcgctacgccattgagcagccggatgaggtggatgtgaatgagatcgtggtgagaccgacacgcaccacggcgtgataaagaaaacggcctgcatcgcaggccgtttagtcgttattttttcagcaggcgcggcagctggttgtccagctccagcaggcaggcgtccatcatcttctgcgtttcctgagtgactttcgcgtagttactggctttccagtcattgagcggtgcggtcacgcgggtcggggcgcactctgatatcacataggcgctcagcatgttgccgccttccgggcgtttaaagaatttcacgcggtaggttaaatcataattgctgttgctggcggacatgtcggtatagaccagcgaccactgcgcggcggcaataaacagcggttgtttgtacgcatagccgttgccgtttttattcagccagtcgcggatttttaattccgctttcgggccgaaatacgcggcagtcggctccggcatggtgtcaatggacgtgcctttatagccatctttgtcaaacgagttaccgccaatcccgccaccgagggcagccgtcagcaccgccagccccatgcccgcgccggagtgcgctggcgtgacttcgcgcagtttcacgtccgggtaccggttatcgttcatatcaacgggtgcaaaaatggtggcaacctcgagcgaactgccgtttgtcgcctgcactttgtgtgagttgaggttccctgcgcagccggttaaaaaggttaaagacagtgcgcctgccactactactttattcatcattggttttattccctgtaagtaaattgcccttgcccggacatggttatctgaacttacaacggacaaagcaggaaaacctttagggatttttgaggatgcttctgcgggggcttaatgcagagcgcatagtgttaagacgataaaatttcacgcttttgccagtcatacggtctgtacaggacgttacgatacaactgtaacgtcctgcagcattgtcggcgaatgcggcaagttacagctcagttacagcactaccttctacaaaggttttacgggcaacgttaccaacgacattcgttgaaatgccatcaaatgccccgcctattacaccgcctaccagtgggatcattttgcccaggttgatcgcccctttttcaccaaacttggttaataatctaaaaccaaccagtttgttaatagcaaaaattgtttctttcgaaatgctcttaattaactgggtagacatcttcgagccaatgactatgccggttcctttaaggatatcttttgcggcattaccggcaaggcaggtataaaccagtgctttaacacgatcgtcttttacatcgtacccgcccatgatagcgatagcggtgatcatacggatctgaacataaattacggtcgcgatgctcgccgggatggcgaccggcatggtaataattccgccaagcccggatacaaagccggtagtgacggattttgtattttgccatctaatcagagaattcactttctctgttaaatcgccctctcctttcaggtagttttcggccatttcataggctgaatctgtacccggaatacttccgtctaaggctttatcgtaagcccagttaagggcttgcatgatttttccttcactaagcttttctgccattcccctgaccctttaaaaagtgaaaacctaatctgtatcgacactgataaaattttctttaaggttaagggcggttttataagattacctaccagaaaagggggtattgtttttgctgcctgtcccgcttcccgaatacgatggcgtttttcaggcgatgctgcggaaaatctcaggcattcaggccgtggcgtcagctcactttccgcacttcggtatcttccggcgataccgccgcaccatccttgccctgcaccttcatcggcggcaggggtttacctgtgcgcctgtcgataagcgttgaatgcggttcgccaggcgcaaacagatgctgctcgccccactgacgcagcgccaccaccaccggaaacaggctttgcccctgcggcgtcagcacatagtgctggtaagccgatccgtccggggcgtcttcacgggccagaatgcccgcctccaccagcctgtacagccgatcggtaagaatgttttttgccaccccgaggctgcgctggaaatcgctgaaccggcgcataccatcaaacgcgtcgcggacgatcagcagcgaccagcgatcgccaatcagatcaacggtgcgcgccaccgggcaaggggcgctgttcagcgcagtactggatttcatgattactcctgaaatgggtgggacttgcattggttgcattttaaaactactttagctgacacacaatcggttttgttttgcaaccagaataggaaaatcctgtgaccgcaaatgcctgtactgctcctcccggagtcgcccccctgtcacgcagcctggtatggcttttcgccatcgccagcggcctgagcgtggcgaatgtttattacgcccagccgttgcttgatgccctggcgcgggatttcagcatcagccacgcggcggtgggcggcgtgatcaccgccacgcagatcggctgcgcgctggcgctgctgtttctggtgccgctgggggatttgctggagcgccgccgcctgatggcgatccagctgctggcgctgcttatcgcgctggtggtggtcggccttgcgcgttcggccccggtgctgctggcggggatgctggccgtcgggatgctcggcacggcaatgacgcaggggctgatcgcctgtgccgccagcgccgccgcgcccggtgagcagggccgcgtggtgggggcggcgcagggtggcgtctttatcgggctgttgctggcgcgggtgttttccggggcggtgagcgatctggcgggctggcgcggcgtctatttcagtgccgcgctgctgatgctgctgatcgcccttcccctgtggcgacggctacccgtgctgttaccggctacgcatggcttaggttatctgcccctgctggcctcaatgctgacgctgctgcgcgaggaaaaggttctgcgcgtgagaggtatgctggcgctgctgatgtttgccgcgtttaacattttctggagcgcactggtgctgccgctgagtgcgccgccgttcagcttttcgcacacggttatcggcgcgttcgggctggtgggggtggtcggcgcgctggcagcgtcccgggccgggaaatgggcggatcagggacatgcccggcgcaccagcgcaatggcgctggtggtgctggtgctagcctgggggccgttgtcgatgatggaaagttcgctgctgacgctggtgatcggcatcgtcctgctggacctgggcggccaggcgctgcacgtcaccagccagagcctgattttccgtctgcgtccggaagcgcacagccgtctggtcgggatttatatgctgttttacgccgtcggcagcgggctgggggcgatcagcaccactctcacctgggctggcgctggctgggcgggcgtgtgcctgctgggtgcggcggtcagcctgctggcgctggggttctggtggataacagacaaagcggccgcggcatgaaaccgcgccgcgagatttacacgcgatccaccggctccgggccgcgaaaggccctgcgccattcgcttgggctgacgctgaatcttgctttaaagctttgccggaacgagatcggcgactgaaagcctgccatcgccgcgacgctttcaatgctcttgtcggtggtttccagtaattcctggctgcgttgcaggcgctcggcggtcagccattcgccaatagtggtgccggtggctttgaaaaaatgacgcgtcagggtgcgtcggctcatgctgacaaaccccgccagcgcgtcgagatcgtgcggcttatccagattgcgacgcaggtagtccatcagttcgttcattttgctgtcgcgcgtggaccccggcaccgggcgctcaataaactgcgcctgaccgccttcccggtgcggcggcacaaccatacggcgcgccacgcggttggcaatcgccgagccataatggtcgcgaatgatattcagacagcagtcaatcccggcggcggtacccgccgaggtgatcaggcgctcatcactggtgtacagcgagttgcggtccagatgaacgtcgggaaagcgttcggtgaaatctttttcgaactcccagtgcgttgcggcgcgatggtgatccagtaaccctgcgtaagccagcacataagtgcctaaacagagcccgaccacttcagcgccacgctgccaggcgctgataagtttatccagcaattcctgagcgggtttttcgtcgggtttattccagaagggaacaataatgatgtctgccctgtccagttgctcaaggccgtgctcaacgttaatcgacagcccgatatcagacagcactacgccaggtttttccgcacaaatttctacgcggaagagatccggctgcggcatcgcctgtccgaataaaatacagggtaccgaaaaatggaagggactgaagccggccgtggcaatcacggcaaccgtaagagcagacataacctttatcctgtgatcagaaagtcagcgtttcaccgtcggcgggaataagtaccttatcctgaatcccctgttcaagcgtaaattcacgcagttcggcacgggtcagcagacagtgatttatggattccatgtgcgaggccacaatagtcgcagcaggcaacatcttatgcgtgcgcagcgtgtcttctttgcccatgataatcggcccgtaaagatcgttaacagcataaccggtattcagtaccaccacatccggctggaagcgctgcaaactgcggacatagggtttgacccacacggtatcccctgcgatgtagagcgttttttcatggtgatgcgtgaacaccagcccgcacgcatcgcccagtaaatcaccccacagcggatcggcatacagatcgttgctgccgtgctgaccgtcggttttataaatggtcaggccatcaacaaaagcgttttcttcccgtaatacccgcacgttcaggaaaccctgggagcgtaccagcgcggcgtcactctcattctgtgtatagataatcatctctttaggtacgagctgttgtgcggcttcatcccagtggtcggtatgagtatgcgtcaggatcacagcatctaccgccagcaattcttcaaccggtaccggcaactccaccatcggattgcgcaggtgcggacgcgcgttcccggcaaagccttcccaggcctctttttccgccagcatgggatcgatgaggaattttttcccggcatagtccagcacgagggtggcattacggatttgcgttaatttcatttatggctccagtgattagtcagattcaggcttactatacgaggagcagtaaaggatacgtgacaggctctggggtcattcgccgatgaaattaggtcaatatcaaccggcgtatcccgcctacggcagcggaataatcgccttttccttcgcgagccggcgacgcttattgtgcaaggcaagcaggcgggtgccaccgatacatgaagctggagcaccaatgcaatctgtgagagatcaaaaccataatgtttcatggcaacggggggggcggtaagacccagcaccattattccaaatccggaagcgccacacagtaaagcgacaagagcagcaggccgaccgacgccattatgtccataaagagaaatgaacctacatagggcaccgtaaacaggggtatcagaacaggtgaacgtgagccgaccgccagccaataagcaatgacattaggccaatttatccgcgaccatgctggcgggaggccagaaacgtcatcgcacccgcagacagcagtaatacgccgctcagcccgaaagcgctttgccatccgaggctgtcaaacaccagaccacctgccgttgagccaagcgcaatcgaaagctgtatgacggcgaccatcagaccaccgcctgcttcggcatcctcgggcagcgttcgtgccagccacgtccaccagcccgtcggcgcggctgtcgcaagcaggccccacaggcttaacagcacagcgacagtccaggtctgttgtccggtcagcagtaacgctccggcgataatggccatcagcaatgggatcataattaacgtcaggtaaaaccgccgattcaggaggattgttacggtcagcgtgccaataaaccccgcgatccccatggcgagcagaataaaagacagccccgatgcgtccactcgggtgacggtttcaaggaagggtcgcacataggtaaacaacgtaaactggcccataaagaacacgccgcaagccagcagtcctgttgcgacgacagcgcgtctgagcaggcgaagcacagaaccgccggatttttgcgctttgctggcttccatcgtgggcaaactgacgcattgccagataaaagcggcgaccgcaaggggcaccaggcataaaaaagcccctcgccagcctacggttgcccccagataactgccgagcggagccgccaccaccgtggccagtgcgtttccgccgttaaagatagccagcgcccggggtacctgatgttgaggaaccagacggatggcggtcgccgccgacattgaccagaagccaccaaaggtgatgccaatcagcgatcttcccgccatataagcccagtagctggacgcgagggcgataatcacgccggatacggccatcaggaaggtcagccccagcagcagatattttcgattcagatcaccggcaagcctggaaatagtcaggctggtcaatactgcaaaagcacctgaaatagcgatcccctgaccggccagcccctcggaaacctgcaaatcttttgctagcggcgtcagcagagtgacaggtaaaaattcagaggcaataagcacaaaaatgcacagcgtcatggcaaagacaccgccccagtgcgcggatgatgttgtgtgtgaggcatcagaattcagtacagacatgacaatatctcttaatcttttcccggccagacggaaacagataaaagccacctgcgcatcgcaggtggcttttctggaataactggctcagcgtgttactttaaattggttttgaagaactgctcgaatttcgcgaagggtatttttccggccgcgttgtcatataaatcaacgtgatttgcccccggaacaatcactaactctttcgctttactgccaacggcgttaaaggcatcttccgcaaaatagcgtgagtgtgctttttcacccgtaacaattagtgcaggaatggtaatttccccggcataactcagcagcggcagattcataaacgacaacggcattgtcgcattccatgcaccggttgaattgacagagcgactatggaaaccacgcggcatccggtaatagtcataaaactctttcagtaccggatgtggatcggcgggtaaagcctccggcaggatccgcccggcggcactggctttgccattctcatcgacataaatatcatgcccgcccggcgcggcagtaccgctttccgcatccttccagcgctgttcgttcaaatactgcaagacggcacggcggtcggcggttgaatagcggtctttgccctcgcccacaccatgacccatggcgcgactcatgtcgtacatgacactggttgcaaccgccttaacgcgggtatccatcgctgcgtcactcaacgccatgccgccccagccacagatcccgagcagaccaatacggttgcgatctacctctttttgtaagcccagaaaatcgaccgccgcgctgaaatcctcggtattgatatcaggagacgcgacattacgcgggtagccgccactttcgccggtataagagggatcgaatgccagagtgacaaatcccttttcagccagcgtctgcgcatacaggccgctggattgttctttgaccgcaccgaaagggccgctaactgcaatggccgccagtttgcgatctccccgatcttttggaatataaagatccccgactaaagtgatcccataacggttctgaaaggtcactttgcggtgatcaaccttcgcgctttccgcaaaagttttatcccacttttcaaccatcgacacgggcgcattgggattcgttgtttgtgcatagctcatggtcgtgactccgcttaatgatgcgcatagcagcatggcaggtatggagagtgacagttttctggtgaaagccttcatgacatgtttcccctaacaataaggtgtggtttgtagtggtctgatacgggcaatgctgctgtgctttattgccatgcgctcattgtaatgagctgttattgtgatgattagaggggtataaatgctaagattaatatcatattgttataaatagcgacgaggcagaccggtggcgaaacgggaaaactataacgatctctatctgtttatgctggtggtgcaggaagggagttttaccgctgcggcacagcgacttggactggcgcagtccgggatcagtcgttcaatacgtgagcttgaagagagactgggcgtccagcttctggttcgtaccacgcgcaaattatccttaacccaggctggcgaacaactctaccggacggtgcagtccgggtttgacgcgctggacaaagggctttccaccctggcctattatcgcaatacgccttccggcacggtgcgtatcaatgccagtctgcacgctattgataaagtgctgcttccgaagcttgcgatatttaaagagcgctatcctgatatcaggctcgaactcatcaatgaaagccggtttgtcgatattatcgcggaaaggtttgatgcgggaatacgactggggccggaggtcgccagcggcatggttgcagtgaggatcacacctgacatggagatggcggtagtaggtacaccggagcattttcgtcgctacggtttcccgcaaacgcccgcggatttggtgatacatccctgcatcgcttaccagtttggcgatggcaatctttatgcctgggaactgattcaggacgggaaaaaaatcacccacaggccgcaggggcagtgggcgtttgcagacagctatatggaagcaaaagcggccaggcttggtctgggcctggcatatgtcccggaggaactggtggccgaagacttagcgcgaggcacgcttatcagagtcatgcagcggtacagcctgcgcctggacggttcgtttctttattaccctcaccgcaaggtgtcccctgctttgcgggcagtgatcgatacgcttaaaatgtaagcgtggttttgctgcactacacgtaaaagcggggaaaaaacgcctccccgcttttcagcactatttctgctgctcgttacccagcacattacgaatagcgtcagcgccacagcgatcgtccgagtctccgccgccggtgcccgcaaggccaatggccccgatcacctggccgtggtatttcaccggtacaccgccgccgagcagcaatagctcattcacggtgttcaggttaaccgtatccggagaggactgcgcttttctggcaaactctttggtcggcgttttggtggacagcgccgtgaaggccttacgccacgccgcctgggtattatgcggcccgacgttgtcatcccgcatcagcgataccaggttgccgccgcgatccaccacggccaccacgccctggcgatccatgccgtgacagaccgccagcgcctccgttgccagtttattactcagcgcctgtgtcatgtcgtaaaccgtggcaggcccggcggcaaaggccatgaccggccccgtcgccagcgccagggcaagcataagacgtttcatttatgctcagctcccgcggtaggtggagtaaccgtactggctcagcaacagcggaacgtggtaggtggtggtggtattgctgatatggaattccaccgggatttccgggaagaagctttcctgtttctgatccgcgaagtatttgccggttttaaaggtcacgcgatagtcgcccgcttcgaacggtttgcccggccacagcgccgccacgcggccatcgtcatcggtgctggcggtgttcagtaccttccagttttcaccctgtttctgctcaagcgtcaccgccacgtgcggcgccggcaggccggtttgctggttcagcacgtgcacgctgatcgggttcttactggcagcaaaggtcacgcctggtgcggccagcagcattgcgagggataaagcagcgatggaatttttcatggttgatctccttgttaatcaccctgctgttatacccccgtggtcgcgccgattgcctgtcagaaagatgaccatattgtcatctgcggctgaaacgctggggcgacctgaaatttcgtggcaaactgatttcatgaaactgttactgattgaagataaccagaaagccagcgcctgggtgcgcaaagggcttgaggaagcgggctatattgtggatcacgcggcggacgggcgggacggcctgcacctggcgctggagcactcttacagccttgtcattctggacattatgctgccgggcatggatggctggcaggtactgaaaaccctgcgcaccgccagcaacacgccggtgatttgccttaccgcccgggattcggtggaggatcgcgtgaaaggcctggagctgggggcgaacgattaccttgtcaaacccttctccttcgctgagctgctggcgcgggtcaaaaatcagctgcgccagcatcagccgcacagcaccacgctgcgcgtggcggatctggtgatggactcggcgcgctttcaggtaacgcgcgacggcataccggtatcgctgacacgcaaggagttcatgctgctgtggctgctcgccagccgccacggtgaaattctgccccgcacgctgctcgccagtgaaatctggggggtgaattttgacagcgaaaccaacattgtggatgtcgccatccgccgcctgcgccgtaaagttgacgatcccttcccacagaagctcatcaccacggtaaggggcatgggctattgtttgtccgatcaggagccaggccgtgtatagcccttccctcaccctgcggctgaccgccattttcacgctgatcatggcgctggcctgcggcggtatcagcctgatcctgtataacgcgttacgcagcgaactggtgtggcgcgacgatcagacgctgatcaaccgcgccgcccagttacggcaactgctggaagacggcgcgcatccggcgtctctgccgctctatttcaaccgtatggtggatattcgtcaggatattctcagtatccgcacacagcatgagcagaacgtcagcattaaccataccggcgtgacgctgccggagatgtcccccaccccggtcagcaccccccctggcgagcagcagctacaccgctgggtcaacgcggatcagaccgaagcctcggcgctgagcctgcaggcccgttcgcaggaagggccggtgaccattacgctggcgcgggtggcgcgggagcgggcgatgatgctggagcagtatcgccagaaaagtattctggtgtcgctggcggcgattttactctgcgctgccatcagcccgttgctgatccgccgcgggctgcgggccattggccgcctgagtcaaatcatggcggaaaccggcagcgatcgcttaacccacaccgtgccgcttcaggcgatccccaaagagctgttgccccttggcgaggcgctgaatgccatgcgccagcgcctgtcgacggactttatccgtctgacccagtttgccgacgacctggcccatgagatacgcacgcccattaacgtgttattaggccagaatcaggtggcgctgggccatgcgcgctccacagaggaatatgaggcgttgctggaagggaatattgaagagctggaaggcctgtcgcggctgacggaaaacattctttttctggcgcgcgctacccaccacaatattaaactcaataaagaaaccttcttactgcatgacgcactggaaaccataatcgatttcctggagccgctggcagaagaaagggaaatggtgatcgaactccacgctgaaggcagcctcaccgccgataagatgctgttccagcgggcaatcacaaacctgctggtcaatgccatccgctatgcgccggacaggggcacgataaccattaacaccgttcatcgcggcgatgtcatcgctatcgaagtggcaaacacgggcgaagagctggccgagccggagaaagtattcgaacggttctggcgcggcgataacgtccgccacaccgccggcagcggcctggggctgtcgctggtgagcgctatcgccgcattacacggcggcagcgcgtattaccgtcacgagcatgggaagaatatttttggggtacgactgggtggctgaataagagctaatagcggacgttctgtccctgtgctaagggttgaatgctgaaataagggtatgagaatgagcattacagcgatacgtgaatggcatatgaatgactatacgattagcacagacccggaaaaactggatgtgcaggcggtgcatcagtatttaacgagatccacatgggctaaaggaatcgatctggaaaccgttgtggcctccatcggcaacagccttaactttggcatttatcataatgactcccagacaggctttgctcgtctgataacagattatgccactttcgcctatctgtgcgatgtctatgtacttgagcaataccagggcgaaggtctgggaaaatggctgatggcgtgtattcatgaccacccggttttcgaaaaattacgcagaattatgttgttcactaccactgcaccctggctttatgaaaaatttggctatgaacccgttaacagggaaaattacgcgtggaccattacacgacctgatatctaccttcaccgataacagtggaaccggcatgacattagccagtgttcaggcgttgcatagcgtgtcggcatcagggacaaaagagaaaaacaggcaggctgcgtatccacggtaaagcgcgcctgtttgtattattttagaaaccacgtgttataagcccggacctgatattagaaaaattccatctggtcgcagggatgttctctgcacgcgcccatttcgccgcaggagtaaagccaggcgttttcacataaaaatcaaagcttctggatacattactcaccgcgagcgtgatgtgattgagggcttgcagcataacggatctcctcagcagggtgcatggagttataacgccagcataaaagcgcgtcgcgcaacgaatgagcgagaagcggttatgttagcgatggaatactatctgtatgaaaacaaacgtatagcttgatcgcccttgttcatgattgtgccccggcgctaaacacgcgaggtaaaatccttaagatcggggcgtcagatgtctgcttagagcgagaagcggacgtttgcacctcatgaacggacttcaatataaaatttttccagttatgcactggctatgagggtatctattgacatgaaatctatgccaaaatgaattaaattaatcatttatggagtattgtaaatcatggctattgtgtttattcctgcccttgttgcgctacttgaagccaaagagaaggacttcggacgagaattgacccgagaggatgttgagtcgatacgagataatgctactgctattgagttacctgcagagattgccagagacatgatcaaaagccgaggctatctcgatattgatgcgcaaaatgcttgggatgagtggttactccataaaaaactatgaatttttaagagcattgatatgctgcgaatagaagttctctaaatcggcaaactactctgtaaaggaattttatgattttcggtgatccctatcgctttgcaatcaggattgaatatattccgcagtagggcgattctataaagaatggtttcttttatttctttttgaacgggagtatgtaccctaatgacatccgcacatcgaccttattcgttgattatgatgacattattgatcctgaaaatgctcttatagctatgccatgtgatgatgaaatatttaatgcatcaacagataaagcttttgaatatctgtatacaatagcttacccacagcccacgccagaggatgaatatcctgatggaatttgtaagttcaatgcttcacccacgatcattatagaatctggagcatgtttttttgccgtttcgaacaaagacttcgttagaatcttaggcggtaaggtatcagaattagttgatcatggagagaggcgcgtttggcaagacataaagtgccctattatagaagatataactatagaaaaaattgaaatgaataaaataatttcaagcttcagggagtataccaattctttattacagatagatcgttaatgacgttcaagggccaagagttttgaatttaaaacatttatatcctcatcttagaaaattacaacaagggcgtttgtaacgtccagcattcagcttaactatgcaagaatttctcctactcaataagcataaaacatgttgcaaacttccgcttttggcacaaagcggacattcttattgagtcgaaggtccgctatgagcgaaaaacggaccttctcgttcttacaagctagtaaagtaatgttatttacttctgctttgcttgttcctctcctgacaagccatttaaaacagtggagtcaattctaaatatggtggtagtgctctctaccttgtcgcgttagtctgcctgtctctaatgaatacaagcaagaaaattacacacaggagaaaaacggtgatttcaaaagacaatgctgagcattatacctggggtgatgattgcgacggttggtatctggtaaaccggcaggatatgctaattattcacgaaaaaatgcctccaggtacgcacgagaagcgacactttcactctgtttccagacagtttttttatgtccttgagggtactctgatgatggaactggaaggtgataaacatgaaatcacctcccggcagggaattgaaatcccgccgggggcaaaacatcaggcccggaacgacagccatcaacccgtcgaatttattgtcatctctcatccgacaacccggggcgatcgttctgatctctcttcctgttgataaaagctctccgacagcggttttgaaggaatacccataattatcccgcacctgcccggctcggctggcgggcctgaccagatgtgaaggcctgtttgatatctatcaggacgttcagtcgcaaggggtaaagcctgaaaccaggtgcttaccggggcgccgctggcggtgtggtgtccagcgccattttcagggctgatatcaggaaactgaccggttcatccggcggaacatcctgacgcaggatgatgtgtaaaggcgtgacccggcgagtgccgtggctgaggggcaatggtttcagtatacctgccgccagttgttgctgaatataggcctgcggcagccagccatatcccagaccggccacgacagcgcctgccgccgcatccagagtagagaaatcccagttgtggctatcccctgcggcagtgtcaccgccatctgttatttgtatgcgtggccaattaccaagcagtgcttcggtcagggggccggataccgacagcagcggatgatcgcgatgggccacggctataaaatccacgttcatcagccactctccccggccagcaatattttgccggtcagtcacgatcatcacatcagcatcgtccaccgcaggcatggaggggaacatgctttccgtgacttccgtcagcttcacccgaatatgcggccagcgttgttggaattgttgcagggcagagaaaaggcgctcccggggatagataacgtccaccaccacattaagctgcgaccgcatcccatcctgcaaagtcgcagcctgtgcctccacataactaaacgttttcaggagtgggcgtacctggctcagcagcgtggccccggttggggttaatacagtacggcgcccttccggcaccagcaacgtcacgcccagtagcgtctggagttgcgcgagattgtagctaatcgaagactggctgcggtgtagcgtttcggcggcgcgggcaaagctgccggtggtgaagacacaatccagtattgcccattgttccagggtggttctgttcataatgattcaattattagattaaattcatcataatttagcgctattcatccaaatattaaagcattagactggctttatcgaacagaggagacctgatatgagcaactttgataaacatgatttaagcggttttgtcggtaaacatctggtgtacacctacgataacggctggaactacgaaatttatgtcaaaaacgaacaaactctggactaccgtattcacagcggcctggtaggaaatcgttgggtcaaagatcagcgtgcttatattgtccgcgtgggtgagaatatttataaaatctcctggaccgagccaaccgggacggatgtaagcttaattgccaacctgggcgataaactcttccatggcactattttcttcccgcgctgggtaatgaataaccctgaaaaaacggtttgtttccagaatgaccatatcccgcggatgaaccagtaccgtgatgccggtccggcttatccgacggaagttattgatgaatttgccaccatcacctttattcgtgactgcggtgcgaataatgacagtgtgattgcctgcgcggcgagtgaactgccggaaaatttccccgataacctgcgttaaataagaaagcgttacatttaaaagaaaccggtcacgacgacggtttcttttttttctgctaaaccacaacattgccattaaaacgtaagtttgaccgccgttctcccactgcttactcagcatgaagcagagccggatgcccccaaatccttttcccgctcctctctgagaaaatcaatgaaggcgcgtaacggcgcagacatgaacctgctggaaaaatagagccaggggccttcaaacggctgccaccattgcggtaacacgggttcaagatcccgcgagttgaaatggggctgtagccagttttcaaacatggcgataacgcccttgccgcgtcgtgcaaggtcgatggccgcagaggcaccgtcaacgccaatagtgatatagcccggcggatcaacagtgatggtttcaccctggcgctcaaactgccagggaaccagcgcaccgctcgaaaatttcatgcgtatacagttatgctcaaggagatcggcaggatgagcgatcgcgccctttgatgcgagatacgcgggggcggccgccagggctaatcgctgtaatctgggacctatggggacggcaatgacatctttcgccagatgttcgccatagcgtatacccgcatcgcagcccgcggctatggcatccaccagacggtcttcgaccataatttctacccgtatttgcggatgttgcgagagaaaacggtcaagcaaaggcggcagaatgtccaccatgacggcccccgtcacgttcagcttaagctcaccgcgcacacattgccgggtactggtgacatcattgagggccgctctcatttccatcagtaagggcgcgatacgcccggccagcgcctgacctgcctctgtcgccgtgacgcttcgcgtgctgcgggtaaaaagcggtacgccaaggctcatttccagcgcggatattttttcgctgactgtcgatggcgataagccaagttgcttcgccgccgtgcgaaaactcctctccttaaataccgccataaaaaccgacagattatccatccccgtcgcactgctattgttcgccatgtcgatcagcctgttctcattatgcctgattatcaaacactatcaggcaggctataaatgcaaaacacaaaaaccgctttttactaaaaaagccacacacaaccgatcatcaggaagcgaacatgaaaaacaaaaacgttcttatcactggcgcaaacaaaagtattggttttgagaccgccagggagctgggtttactgggatataaggtctggctgggcagtcgtgaccaggatcggggccaactggctgtgaacagtttgacgaaagacggtatcgacgcacagcttattattatcgacgtgacaaatatgctgagcataaaagaggccgctcagcggatacaacatgaagacggtaaactggatgtactgattaacaatgccggtattttaggctcgcatgatgttgcccctggcgagcaacctattgatgacattatggccgtctatgatacgaatgtatttggtcttatcagagtgacccaggcgtttattcccctgcttaaatgcgcgcagaatgccagaatcatcatggtcagcagtggtctgggttcgctggaatgggtgtctgatttaaatcatccctactcccgggtgcaggcaatggggtataccagctctaaaagtgccgttaatgccattacggtcgctttcgctaaagggttgatggctgagggtatcagcgtaaatgccgttgatcccggttataccgccacggattttaacggccatacgggctacagaacggtggcggaagcggccaggggaattgtctggctggcagaggaggcaaatgcagacatcactgcgggcttctattttgatcaaaacagagccccatggtaacaggaacttacggttacttgcctggtacgctcatagcatcccgttattgccatggcgtaaaaacgccggacgttcattgagccgcgcgaaccaggcttcaatggctggcacatcaggctttgcgaacggcgtcattttccagcggtttaccgacagcccgagcaccacatcggccagggtaaaggtctcgcccgtcacccagtgatgagtgcgctgtaattgctgttcaagaatgccgatacagtggttccactggttaatgcctgcggcaatggctgccggatcgttaaaggccggatccctgcgccccagcgccgggaagacatagcgccaggcgttattaaactccgtcgcctgccagtccatccagcgctcgacatccgcgctggcacgcggttcgccgggcaacaggtcgtcacgcccggctttgcgcaccagataacggcagatggaatttgattcccacagcacaaaatcgtcgtcaatgatcaccggcaccatggcattcgggttcagggcgcggaactcatccgtttccgtcggggtaaatccgctgccgtaatcttcctgcagatagtccattttgatttcttcgcaggtccacagcactttgcgcacgttaatggatgtcgttttgcccagtattttcagcatgcctggcaccgttcagtaagaggttattatccgggctactttttacaaaatagcttagtggcggccgcggccatcagcccgataaacggcatggtggcggcaccggagatgaaattatgctgatcgatctccttttcccggcgaatatctgcaagacgtgccagcgcatggttttgatcggtggcactgacttcttcaaactgcttttcatatccctgctcagacaacggtaacgcgccccgggcgtccgttctttccagcaccacaatatgtttacccttctgataaaaacagtattccggcatgagatatctcccagacaagtgaaggcaataatacagcataattaaaatgcggcagatggaaaagtcttacttgcaccagactgtaaatataaggtttttgttttattcaaaataatatgctgcattaagttaaattttcagtaaaagaaaagaagtatgcaataacacctgtcttgctgtattaaagccagtatgcactgctgactatgcaaattttcttgtgaaagtgttatctactgcttagagatttatacaatatagcccatagattttgccattaacccattgtaattcattaacatttgcaagatactagcagtataatatttacatgctaaaaaagtgtcttcatcctggatgcctaacaagattctggcacttttaataaaataaaatacaaccaaccttcatattgacaatattcaaagcatcaataatgcataccagcaaaggataactcatggaaaacattgataatattttgaaagaggccatcaataaagctaccactgaaagagggaaaatttctatactcattgctggtcgatcaggggtggggaaaagcacgctaataaactctgtttttcagcaaaaaatggcagaaacaggacagggacgaccagttacccaaaatacaagagaaataacaaaagagggtgttccacttacaatttttgataccagggggctggaaatgtcgcagttccaggaaacacaatctgatcttgaaaagctgattaaagagcgagcctcagacagagatacaaaccggcatattcatgttgcatggctatgcatacaagaagatggacgtcgcgttgagcaggctgaagtcgatttgcataatatgctgtcccaacatatgccagttattgcagtgattacgaaagcaagaagtgataatgggttcaaaaatgaagtgcagagcttacttccggaagtgaaaaacgttatccgtgtcagagctattgaggaagagatggatgatgggcatatcatcaaggctatggggctagaaagcctgatagaactgacctcagaggttattcctgagggaaagcgaagggctctggcggcggcacaaagagccaacatcaattacaggaaaactcaggcacataaaatagtagctggtgctgctacggcagccgctgctgcaggcgcaagcccaataccgttttcagatgctgccattcttgcccctattcagattggcatgatagcgggcattacatccgtcttcggtctggagctatcgaaaggaacacttagcactctggttgcttctgcaataggtgtaggcggagcaacgtttttaggacgtactgttgtggttaacattttaaaatgctttccagggtttggaaccattgctggtggcgcaatctctgcagccactgccagcgcaataactattgcactgggagaagcctacattgctgtactcgttgagattttttcaaaggatccagatgctgaaccttcagccagtgaaattggagaaaagctcaaagataagatgataaaagccggagcataattcaggaaaaggatccgctgacgacgccatatgtgtgctatcagcggttttttatcatgtttgttcgagtagattgtcctggggatgaatttcataattaaccatttaacttcgcccctctaattcatgttcctaatttattaaatctaagaatacccgccaccccaccaccgccatcggcaggatgagtaataccgtccatcacttgcacggtttcaaaatcaaagggagataccccctccagacaggcaacgttgatgccatactgctcaggattagatcgccgttgatggaaggtataaatgccacagatggagcaaaaataatgcgccgcttgtcgggtattaaaacggtattcggttaagacgtctttgccgcttaatatctccagtcctgcgagctgagcggagacagccaccgccccccgcatccggcataaagagcagttgcaccggcgaatcgtattaaagccatcggataattcaacggcgaatcgcactgttccgcaatgacaacgccctgcaattttatcagtcataaagcccccgtgaggcaaacatagtctgccgcgaatgaaaaaacgataaaagggacgccatatgtgtgccaacaaaccctgacaaatcgttagtgaaatctgtttccggagcggtgctcataacccatccttttcacagtggaggagctttaacagtaaaagacaattatggatgctgccaggtggcgttgtaacaagtattaagacgtttcgcagataacgtacggacggcagagcacagcgaaaaatccccgccatggtgcatggcggggatttattttacggcttaagcgccatcacttcgcgcggctggcgataatcgcctccgccacgttgcgcggcgcttcagcatagtggtggaactccatgctgtaagtcgcccgtccctgtgacattgagcgcagcgtggtggcgtagccgaacatttccgccagcggcacatcggcgcggatgatctggctgccgaaacgctcttccatgccctgcaccagaccgcgccgggagctgagatcgcccatgatattaccggcgtactcttccggcgtttccacctcgacatgcatcatcggttcgaggatcgccggatcagcgcgtttcgccccctccttaaagccgaaaatcgccgccatgcggaacgccatctccgaagagtcgacgtcgtgataggagccaaaggtcagcgtcactttcacgtccaccaccggatagcccgccagcaccccattattcagcgcttcacggatgcccttttccaccgacggaatgtattcccgtggtaccacgccgcctttggtggcgtcttcaaaaacgaagcccttgcccgcttcctggggttccagcgtcagcaccacatgaccatactggcctttgccgccggactggcgcacaaacttgccttccacctctttcaccgttttgcgcagcgtttcgcggtaggtcacctgcgggcgaccgatgttcgcctcaacgccgaattcacgtttcatgcggtcaacaatgatctcgagatgcagctcgcccataccggaaataatggtctgcccggactcttcgtcggtgtgcagacggaacgacggatcttccgaagccagtcgttgcagggcaatacccattttttcctgatccgctttggtcttcggctcaatggccagcgagatcaccgggtccgggaactccatgcgctcaagagtgatcaccgccgccggatcggtcagggtatcgccggtggtcacgtctttaagcccgacgcaggcggcgatatcgcctgcccgcagctcgtccacttccagccggtcattggcctgcatctgcacgatgcggccgatgcgctcttttttgcctttcaccgggttgtacaccgcgtcgccttttttcagcacgccggaatagacgcggataaaggtcaactgcccgacgtaggggtcagtcatcagcttgaacgccagcgccgagaagggttcattgtcgtccgcatgacgttcgatggtgtcgcccttctcatccacgcctttgatggcgggaatatccagcggcgatggcatcagttcaaccaccgcatcaagcatgcgctgtacgcctttgtttttaaaggcgctgccgcagagcatcggctggatctcacctgcgacggtgcgggcgcgcaacccgacgatgatctccgcttcgctgagatcgccgctttccagatagcgatccatcagggtttcggtggcttctgccgccgccgagaccattttttcccgccactgctgcgcggttgccagtaaatcgtccggtaccggcgcatagctgaaggtcatgccctgggtagcgtcgtcccatacaatggcgcgcattttgatcaaatcgaccacgccgctgaagtgctcttcgctgccgatggggatgacaatcggcaccggattcgctttcaggcggtcgatcatcatctgcaccacgcggaagaaatctgcgccggggcgatccattttgttcacaaaggcaagacgcggcacatggtatttgttggcctgccgccagacggtttccgattgcggctgtacgccgcccaccgagtcatagaccataaccgcaccgtcgagcacgcgcatggatcgctccacttctatcgtgaaatcaacgtgccccggggtgtcgataatattgatgcggtgcggttcaaagctgtgatccatgccgggccagaaacagctgacggccgctgaggtaatggtgatcccgcgctcctgctcctgcgccatccagtccgtaattgcagcgccatcgtgaacctcacccagtttgtggctcacgccggtgtaaaacaggatacgttcggtagtggtggttttccccgcatcgatatgggcagaaataccaatattacgatagcgttcaagggggatgggtcggggcatgatgcgtccttagtcagtttgacagtaagcgaccggcatggtcgcgggagttaaccaggatcatcatagtccaattgtacgagtatattcgaactattttagctatagttatagttgataatctggtgcgcctggcgcgtggtattgcccgcagccttccagtatattatccggcctgctgtaccctttgtctgaccattacggagcgctatgatcgccaatcaccctgaacgtgaacaaatccgccttgaaaatgtgcttttcgcgctgggcaatcccctgcggctggacattgtgaaaaccctggctgatgagggcgaacaggcgtgcggcgcgctgcgcagggatgtggccaagtccaccatgactcaccactggcgcgtactgcgcgacagcggcgtgatctggcagcgcccgcaggggcgggagaatttaatttccctgcgccgcgaggatctggatgcgcgctttcccggcctgatggatattttgctgaacgtgatgcatacggaataaacaatcatgacgggcacagacgcccgtcggcaggccggtaatcagagactgaagccataatgagaaccgtcgggcagctcaatatccagacgcagcttaccgcccgccgcctcaacgtagcgttttaacgatgaaagttttaaatcgcgacctggtttctccatgccagccaccgttggctgtttgacgcccagcgcctgcgccatgtcattctgggttttgcgcactttttcacgcagctcggcaagatgaatattaagcagaatgtccgccgcctgcgcttcggcgtttgccacgacgtcaggattttcctgcgccagaatttgcgtcagcgttcttcccatcagattaccccttacggttaatttttttcagatgttcggcatactcttgttcggcaagcggcagcatcacatcataaaagcgtttctcattgcccaccttactgcctgcgcacaggacgatcccggtgcgcataacatcgaaggcaaaaaaagcacggatcggatcgccgcgactctggatacgcagctccttcatattggcgtagcgtgaacctttgatggtgtctgcataaggcctggccagctgcggccctttcgccctcaacaccagcagcgacgccagaatgcattcccgatcggtttcattttgcatgctgtaccaggtatcgaatctgtccgttgtttcaattacccacatctgcgcccctcaataatataggtcaaaagttatataggtgcaaacctataaaagagaatgtgcacaataaaatgccgcattacagccagacagttgtcacgccggaaggcgccttcagaaaaatcgatggttgttgcagagcatgcggaataaatgcggtgaggatcggaaagacggatgccgggcggcatatgcccggcgctcgtatatcaggtttccggcagctcaatatggctgtcagcgagcgtacccatctggtgatgcatggcacaggcggcgtcgataaggggcatcgccagcgccgcgccgctgccttcgccgagccgcattcccatattcagatacggcacaagccccagctgcgcgagggcgattttcgcgcccttctccgccgataaatgtgagggaatgagatagggcttcaccgctggtgcgatacggcaggccgccagcgccgaggcgtaagagagataaccgtcgagcaccaccggcaggccgcaggaggccgcgccgagcatgacgccggtcatgcccagcagatcgtagccccccagtttcgccagcacgtccagtccgtcctgcgcatcaggctgattcactgctattgcccgcctgaccacctccgctttatggggcaacttcgagggcggcagattcgcgcctatgccgaccacgtcttcaggctgcgcgccggtaaatacgctgaccatcgccgcggctggcgtggtattcgccatacccagctcgccgacgccgaacaccgtcacgccccgggccgccagttcgcgggtataacggatgatgtcaagcagcagcgcctgcgcctgttcgcggggcattgccgggccaaccgcgatgttgccgctgccgcgcgccattttcatattgaggatgccgggaatgggatcgctgtcgatccccacgtccaccaccagcacttgtgcccccgcctgcgctgccagtacgcagacgccggtattgttgcgtgtcatgttggcggcctggattgcggtgacaaactgcggcgagacggtcaccccttcctgccagaccccgtgatcggcgcacatcaccacaatggctttatccggcagcgcggttttgcctttcagccccggcagaccggcgagctgtaccgccagcgcttccagccgcccgaggctgcccggtggtttaagcagcccgtcgatatgccgttgtgcggcgaccatggccgcgtcatcaggagccgggatcggcgggaatagatcgatcagtgtctgcatgatggttctcagtgtgcgggctagcgaagcagcgccagcataaaaatgacttcacccagttcgatggcggcaccgagcgtgtccccggtctgcccgccaagcgtgcgtttgagcatcaggccgagcaggtaaatggcgacgagcgttatcgccagcgccagcagtcccgttatgcccaacagcatcgccgccagtaaagcggtgatacccagcgtgaacaacgtctgcgccagactgattttgccgataaacaggttgccgagtccctcctcgcgggcatagcgatgcccgtacatcagcagcacggaaccaccgcgtccggcggcgcaggcggcgatcagcaccgtcagcaccggcatatcgcgcagggccagttcggcgatgaccagcactttcgccagcagcacgacgatcagcgccaggccgccgtgggtgcccagccgactgtcgcgcatgatcgccagcatccgctcccgcgtacgggcggaaaatacgccgtcacaggtgtccgccagcccgtcgagatggaaaccgccggtcagcagcgccagcgccagcacgctgaacagcgccgccagcgggaagccgcaccagccgtctagcaggataaacaccagcccgccaagcgcgccgagcaccacgcccaccagcggaaaggtgacgataccgcgcacgtactgctctaccgccagtccctgcataaagcgttccggcaccgggatgcggctcataaaggcaagcgttgccagaaagagtttcatttgattttgactccaataccggacaccaccagccagacgtcatcggcggcctgcgccagccgctgattcacccgcccggcgatatcgcgaaaatgcctcgccagccggttttccggcacaattcccatccccacttcgttagtgaccagaaccaccggcgacgggcaacgctgacaggcggcaatcagcgcctcgagctgctgctgcacgctggcttccagcgcctgataatcccagccgttgggattgctgtcgccgcccagggcaaacagctggttggtgatgagcgtggtgatgcactccagcaaaatcgcctcctgcggatcgttatccggggtgatgatgtcgtccagctgctgccagcgctcctcggtgcgccagtgcgccgggcggctatcacggtgatgctggatccgggcggccatctcctcatcaaaaatctgcgaagtggcgatatacagcacccgtggtgatgcgctgaccagcgtttccgcatgacggctcttaccgctgcgcgcgccgccggtgacaagggtgatcatgctggctccttatgctcgcgcataatccggtagattttttcgatgtcgatatggctgcgcatggcctccgccagccggtcaaactgctgcgctttgtgatcctgccagctgaagcctgacgccagcggcggcagatttttgcgctggcgcaggccgttgatcaccgcgcgggtgaaggcatcgctgtcgaacaggccgtgcaggtaagtgccaaacaccagaccgtcgtcgctcaccgcgccatctgccacgcgttgcccctgtttttccagccacagcgccgggcggcagccttcgtgccgcgtggtgtcgcccatatggatttcatagccgctgagcggcatatcgcgggctcccgccagccagccgggaagcgttgtgccgctgcgcgccgtcacttttgtggtggttttctgcggcgcaaagatcgtctccaccggcaggaagcctaagcccggttgcctgcccatgtgtgactccacgtcatcggtgatggtttcgccgagcatctgatagccgccgcagatgccgaacaccggcaccccggcgtgatgtaactgcaccaccgcctgcgccagcccacactcccgcagccagtgcagatcgcccagggtatttttactgcccggcaggatcagcagatcgcaattttccagttcatcggaatgacgcacgtaccgcagccgcacgtccggctgcgcggccagcgcgttaaaatcagtgaagttagagatatgcggcagttgcaccacggcgatggtgatctcccgttcgccggtatgccggtatttgccgcgttgcagggccacgccatcttcatcttccagatcgatgtccagccacggcatcacccccagcacaggcacgccggttaacgcttcaatttgccgcaggccggaggtgagcagcgccacgtcgccgcgaaatttattgatgatcaccccttttacgcgccagcgttcgtgctcctgcaacagcgcgagggtgccgtagatggcggcaaatacgccgccgcgatcgatgtccgccaccaggatcaccgggcatgcggccatttccgccatacccatgttgacgatatcacggtcgcgcaggttgatctccgccgggctgcccgcgccttccagcaccagcacctcgtactcctgcgccaggctctgataaacctcgataatctgctcacgcagctgcggcttgaagtcgtgatagctgacggcgtccatgtggctggcgactttacccatcagcacgatctgcgcatggcggtcgccggtgggttttaacagcaccgggttcatgcgcacatcaggctcgatacctgccgcctccgcctgaaaaatctgcgcgcgacccatttcgtggccgtccggcgtgatgccggaattaagcgccatgttctgcgatttgaacggcgcggtgcgcaggccgtcctgccagaaaatccggcacagcccggcgaccagcatacttttacccacatccgaggcggtgccctgcaccataatggctaagggttgcggtgattgattcataattgccatccggagaacgccagatgcaccagcgcgaacagtaccagcgccagggtagaggcgacccacatcagttgtacggcgcggggaatgtcatccacatggatctcacgacgcgcgtcgccaatccagggtttgtctacccgctgaccaaaatagttattcggaccgcccaggcgaatacccagcgcaccggcgaccgtggcttccggccaggcgcagttggggctgctgtgattacggcgatcccggaaaccaatccgcagggcgctggcggcatcctgacggcacagccaggccgcaaggctgaacagcagccaactgagcctggcgggaataaaattcgccacatcgtccatgcgcgcgctgaccataccgatggcgcggtatttttcgtgcttgtagccgaccatcgaatccagggtgttcaccgctttaaaggccatcgccagcggcgcgccgccgagcagtaaaaagaacagcggggctatcacgccatcgacggtattttccgccacggtttccaccaccgcgcgctggatttgcgcaggctgaagtgcggaggtgtcgcgcccgacgatccatgacagtttttcccggctttcttccagcgtgccgtgacggagggccttttccacggcgcgggcgctgtcgtcgaggcaacgcgtcgccagaatggtgtagatcatccatacctccaccagccagccgacccacgggtgcagcgccgttgccagcgtgatgacgccagaggcaacgccccaacttatccccaccaccagcagccacatgatgccgccgccgatgcgcagggtaatatcctgcctgcaaaggcggcgcacctgccgctggacgatcgtaatgagcgtgccgatccagcgtaccggatgcggccagtgcggcggatcgccaagccagcggtcaagcagccaggcggcacaccaggcaagcagcgtcatggcctttgccttagggaaagggaaaactgaacgatcatagatagccggtaaaagtggaggtttgtcatcactttacacggatgcgcgacgggggaacagaacggtgagggagagtccctcaccgcaaaggaattactcggctttaggttcgtgggttttcatttcacccatggtcttgagctttttggagatctcgcgacgctctttggagatctcggcgtttttgatgatgtagtcatcaacgcgatcttcgtaatcgcttttcatgctggcgatgatgccctggatggcttcaacgctcatgcccggcttgatgtaatcgctcaggttatccagcagcagcacgcgtttctggttatcacggatctttttctcaacgtcctggatttcacgctggagtttgtttttacgacggaacagacgaacaaattccagaacatcctgaaacgaaggcttagtagtttccatttttacacccctgctaatataagattcggattcgtaaaagcacccaccccggctcaacactactttcagcggctgctaatgacaatgcttttgtgcctgcgggtatcataaccctaatttatgctgaatcgaaacaacacgcacgcatcccctgcacaggtggagcttatttgcgcagtgcgcgacaaatcaaatgcgacagcagttcaagctgacgcgccagttccatacttaaccatacatagccgtgcatcggcgtttccgccagggtttctccctgatgcgcctgaataagctcccgcagttcacgggtgatgtcgttaagcttttcgctgttcgccactatcggctgcgggttaccctcgtagagcgcatgggcaatggtcagcagagtctgctgcgtcatgttttgcatgtcacgcagggtatgggcattcagcatcaccatatggctggcgcgcgaggcccagtgggcattgatttgcagctccagtatgcacaccatattgcggctcaccgtctggatcgcctcaaagatggatttttgaatacgcgtctctttgctggcgggcgtgataagcccgcgcattttcaccacgtcgttaaggatggtttgcaggtgcttttccagccgcggacgttccaccaggttcggtgaaaaccccgcctgatagactcggttaaaggcggtaacataattcgccatctgaatgcgccagtggataaaggcgcgctgaggccagatactggtaaaaagcatcgccagcagggaaccgagaatgacatcgcccccgcgccacagcgccgtgtgcatatcccccgcgggggcacccaccaccaccgccagggtgatgccaatcagcagcgcctgatagggctttttgccgagcgccagccagccgcagaggaacatggccgccgcgcaccacagcaacatcaccggcagcgaaatcaactccagctttaacgccaccagccccagcgccgagccaaaaatagtgccgccgatgcgctcccaggcgcgcggtaccacgttgcccagaaaagagatcggccccatgatcaccaccagcgtgatcagcggccatgtgccttcgggaacctgaagtaagcgcaccagtaagaacgtcagaataaacgccagcgcgatccgcaccccgtggacaatacgatagtgacggtagagacgaatttcaaaagggctgagtgatttgtcggggcgcacacccgttctccggctaaaacaacaaaggcgcaattgtagcggctttttaccaggcgatttccgcgttatggcctgaatgatggcaaaaatgacgatttactcgccagtcgcgccataaacgcctccaggatcaattctgaaggctgggccaaaacgccgtcagagcacttttggctcgacggggatatgcatgtcgatctcccagtgcccttcgccgctgtcgacattaagatagatctcaaagcacggaccccgtgcaatctggtaattctgatccgctaacagcgtgtcgaagaatccgtcccaggcctgctggaaatcctcgttttcaacgcgcgcgcgggctaccgcataagcgccgccgggcagttcggtgagcatcacaccttcgctgttttccggcaggacaaagtcttcatccaccgcgatcaccacatcggcacgcagcttttcagctggtacttcatcgggattgtcgtaataggccgcgatccactccaggggctgcagctgcttactcttcacccacagggtcagctgttcgaagccctgctttacggttttttcccacggccccaccagatgaaaaccggcaatcttacgcgaatcaacgtctttgatttgatagtccattgctgcctccgacgaatttaactgtatggatacacactataaatgatgcaaaatcactctacacccaccagtttgtcagtatgcgagcaggctcgcatactcgccagtcagtcagctgaatgcttaagattaatgatggaaccagtcgtttatgcgcgagaataccccgcccttacccacgctctccagggtgtacagcggccagtgggcgatgactttgtcgcgatcgtaaagcgcgatctcccccacctgctgatgcgccgctatcggcgcctgtaaatctttgttggtcagggtgtattttgccttaatgtaaggcacttccgatttgggcagcgccagccagaaatcctgtccggtgccgaccgccacctgtttcttatcgccgaaccagatgcgctcgctgccgaccttctgcccctggcgcagcacctgcaccgtatcaaaattctgctggccccagtgcagcagtttacgcgcctggtcttcgcgtcctttcggactgtcggcacccatgatcactgaaatcaggcggcgctggccgtcaacggcagaggcgacaatgttgaagcctgcgccggaagtgtggccggttttcaggccatccacgttaagggatttatcccacaacaggccgttgcggttctgctgggtgatcccgttccacgtcaggcttttctcactgtacatatgataaaactgcggttcgccgtggataatagcgcgggagagcaccgccagatcccaggcggagctgtgctgccccggcgcatcgaggccgtgcacggtttcaaaatgggtgtcgcgcaggtgcagcttctgcacgtaatcgttcatcatcttcacaaactgcggctggccgcccgccacatgatccgccagcgccacgcaggcgtcattgccggaatcgacgatcagcccgcggctgagatcgcgcaccgtgacgcggtcgcccggtttgataaacatcagcgaggagccgtcaaacaccggattgcctttcgcccaggcgtccggaccgaccgttaccacctcgtccggggtgatgcggtggctgtcaatggcgcgatcgacaacgtagccggtcatcagcttggtcaggctggccgggttgcgctgttgatgttcattgcccgcggttaatacctggccggtggtgtaatccattaaaacccaggacgcggcctggatttgcggtggctgaggggtgacgggtaaatcggcagccagcgcagaattcacgcaaacagcaatacatgatgcggcaataaacaaacggcgtttcaacgggagatcctctgattcaggtaaatggctgacctttttacggaatttcttatgtcgttactccgtttaattgcaaagaaatgtgacagtggcgcgcggagtctggatgattgctcgcaaaatcagcagccggatggcatttatgtcggaagaagcggcgggatggtttaccatagacaggtcacttcaaaacaggatgaactcactggtgtctgattccgctccgcagccaacttttttatttcacgattacgaaaccttcggcaccagcccggcgctggatcgccccgcgcagttcgccgctttgcgaaccgatgcggattttaacgttatcggcgagccggaggtcttttactgcaagccggctgatgattacctgccccagccgcaggcggtgctgatcaccgggatcacaccgcagatcgcgctggcgaaaggcgataacgaagccaccttcgccaggcgtatccacgccctttttacggtgccggaaacctgtgtggtgggctacaacaatgtgcgcttcgacgatgaagtgacgcgcaatattttctatcgcaacttttacgatccctatgcctggagctggcagaatcacaattcccgctgggatctgctggatgtgatgcgcgcctgctatgccctgcgtcccgacggcatcaactggccggaaaacgacgacgggctgccgagcttccgcctggagcacctgacccgcgccaacggcattgagcacagtaatgcccatgacgcgatggcggacgtctacgcgaccatcgccatggcgcagctggtgaaggcgaagcagccgaagctgttccagtatctttatgagcatcgcagtaaacataaactgacggcgctgattgatgtgccgcagatgacgccgctggtgcatgtctccgggatgtttggcgcgtggcgcggcaataccagctgggtggccccgctggcctggcatcctgagaaccgcaatgcggtgattatggttgatctcgccggggatatgtcgccgctgttaacccttgaggccgatgcgctgcgtgagcggctttacaccgcgaaagacgatcttggcgatgacgccgccgtgccggtgaagctggtgcatctgaataagtgcccggtgctggcgcaggccaatacgctgcgcgccgccgacgctgaccgactggggattaaccgccagcactgtctcgacaaccttaaactactgcgtgaaaacccgcaggtgcgggaaaaagtggtggcgattttcgccgacgccgagccttttgtgccgtcggaaaacgtcgatacccagttgtataacgggtttttcagcgatgccgatcgcgccgcgatgaagattgtgctggaaaccgatccgcgtaatctgccggcgctggatattacttttgctgataaacgcatcgaaaagctgctgtttaactaccgggcgcgtaactaccccggcacgctggatgaggcggagcagcagcgctggcatgcgcaccggcagagtatcttcacagaggaatttttgcaggcgtgggtgcaggagctggaaatgctctacagccagcatgaaggagacgctgagaagcaggcgttactgaaagcgctgttccagtatgtgcaggacattgtctgacctccctcttctgagggcggtacagaaagcaaaaaaccggaggcgttaacctccggtttttttatacgtcatttagcgggtgctgcttttactgcgggatatcttcgtactgcggaaccggattgcggaagcttttagtcacgcaggccagatacagcagaccgatagcgccccagatgaggccaaggatcatggagctttcttccagattcagccacagtgcgcctaccgtcagcgcgccacacattggcagcaccaggtagttgaagtgatctttcagcgttttgttacgcttttcacggatccagaactgggagatcaccgacaggttaacgaaggtgaaggccaccagcgcaccaaagttaatcagcgccgtcgcggtcaccaggtcgaagttaatcgccagcagcgcaatcgcgcccaccagcagcacgttccatgccggagtacgccatttcggatgcacgtaaccgaagaaacgggtcgggaacacgccgtcacggcccatcacgtacatcagacgggatacgccagcatgcgctgccataccggatgccagtacggtgatggtggagaaaatcagcacgccgaactggaaggttttacccgccacgtagagcatgatttccggctgtgacgcatccggatctttaaagcgcgagatgtccgggaagtacagttgcaggaagtaagaggccacgataaacaccaggccgccaatcagcgcggtcaggaagatggcacgcgggatcacgcgctcggcgtctttcgtttcttcagacagcgaagagataccatcgaagcccaggaacgagaagcacaggatggttgcgccggtgatcatcggcaccacgtgcgcgccttcggaccagaacggacgggtgctggtcagcgtacctgcgccttcaccgtgcgccacgccatagacgatcaggccaatgatagccgccacaatccccatctgcaggatcacgatcagggtgttgaagttcgccactgatttgatgctgcgcagattggagatagtcataaaggctaccagcgcgactacgaatatccaggatggcacgctcggcaccagcgcttcgaaatagattttcgccagcaggatgttgatcatcggcatgaacaggtagtccagcagcgatgaccagcccaccataaagccaacagccgggctgatggatttctgggcgtaagtataggcggagcccgcagacgggaaacggcgaaccagtttaccgtagctgagcgcagtgaacaggatcgccaccagcgcaaaggcgtaagccgtcgcgacgtgaccatcagtcaatccagagacaatgccgaacgtatcgaacagcgtcatcggctgcatataggcaagacccatcataacaaccggaatcagcgtaagggttttacgcaattccacgcgagaggtttttggagtaacgttatgcgacatggtgaacccccattacggcagatgccatcgcaaatgcaaaaaattgccccatctgttttctttcctcagcgacaacgactgtcgttttttaaatgtgtatctatccggtacgaagcccggcctctttgattaaatgacgtttttattgcaaaaaaaataaccgacgcgtttaacgtcggttaatctcattttttgcaggcggcgtattttgccccaaatccgggcgcgatgacaagactgtgaaaggcctgtcatgcgaatatttttacgattgcccgccgtgacgggcatcagcaaaattgtaaacgccggtaatagcactatttgccactatttccctgcaccaccacgcgctggcgaggcctgcggtttgctcattccagcccagccagacgggttccccagacacctcgtcagtgacgcgtttttcaatcagcgcgccgctgtcgagaaagcgctgcgccagatagcgcggtacccagccaaagccgaggccgccccgtagcaactcaagtttagtcttaaaatcgaaaaccgcgatcgcttcatgatcgtccggcatggcctgcttaccgctggtcaccacaatggcgcgatggcgtttgatgtcatgacggggtatgggctctgctgctttcgccagcggatgatgcggggcaacggcgaaaacctgttcaaggctgcccagtcgggtaaagccaaagccgctgagatgaggaggttcatgcagcgcgccgacgatgatatcggcctcgccgttaatgagcgcctgccaggagcctgacagcacgccattgataaacttcagacgggtgacactatgatcccgataaaaggcgtcaataagcggtaacaacaaggaaaacgggaaggtgtcgtcaacgcctatcaccagctggctttcccagccctgatgaagcttcaccgcctgcttttccagttcccggacggcgtgtagtacgtcgcgccctttctccagcagcatctgtccggtgcgggtgaatttcgcccggtgcccgctgcggtcgagcaactgaatattcagatcgctctccagcttatgcacggtgtaactcagcgcagagggcgttttatagagctttgcggaggctgctgcaaagctgccctctttttccagcgcatccaggatcaccagcacatccagcaatggtttcatgctcgccccctcagggtgtgcgaccagtcaatccctgccagtcgccgtgtccatcggcatgagcagcggatcggggtattgatagtcaaatcccagctctttggtgatgcggctgccgtcaacgattttgcctttgtcagcagtcggcgcatcatgaaactgcggcaccggcagatccagctgccgtgccatggcgggataaaatgtcgatcgcgccgggtgggcaggcgcacagatattatagatgtgcccgccttttggagcctgcaacaaaagggtgattgcggcgacgacatcatccagatggacgagattgacgccatgctgaccgttgggcgcggttttaccggcaaagaagcggcccggatgacgccccggccccaccagccccgccagacgaaggatgtccaccgaggtgcccggcagattatgcagccagtcttccagatctttgagaacgcgcccgctggcggtcaccggctggcgaggactgtcctcttttaccgtaccggcaacgtcgccgtagaccgaggtggagctggtaaagataatacgcgggatgcggtgcgccagcgcgctgtcgacaatttcctgcatcgcctgcatatagaattcgtcccctggcccgctgcggcgggcaggtagtgtaataaccagcgcgtcgacgttcatcagggcgtcgagatcgtcggtgtcgcacatcagctccggggtgagttgcagcagatagctgtcaatgccgcacatgcgcgcggcctcaacgccgtcctgagttgttttactgccggttacctgccagccccgcgccgacagcgctaatgccagcggcatccccagccagcccagtccgacaattgccaccttcttcatgcctttctcctgacgttcacgcatctgcagtaaggctacgccagggtgagagaactgacaattcatagaatcaatatgaaatgatttaatgatggaaaaaagcccttgccttacagggctaaactggtttaggttaatcgcaagcagttgaatattcattcatcgagaaaatttatgacacgcgttcaatttaaccaccaccatcaccatcatcctgactagtctttcaggcgatgtgtgctggaagacattcagatcttccagtggtgcatgaacgtatgaaaaagcccccggaagatcatcttccgggggcttttttttgaaccaaattcaggcaggaacagaggataatccgaatgttagacaatacccgtttacgcatagctattcagaagtccgggcgcttaagtgatgattcacgcgaactgctcgcccgctgcggcattaaaattaacctgcacacgcagcgtctgatcgcgctggcagaaaacatgccgatcgatattctgcgtgtgcgtgacgacgacattccgggcctggtaatggacggcgtggtcgatctgggcattatcggcgagaacgtgctggaagaagagctgctgacccgccgcgcccagggcgaagatccgcgttacttcaccctgcgtcgtctggatttcggcggctgtcgtctgtcgctggcgaccgcggtggatgaggtctgggacggcccggcggcgctcaacggtaaacgcatcgccacctcttatccgcacctgctgaagcgctatctggatcagaaaggcgtttcctttaaatcctgtctgctcaatggttctgttgaagtggcgccccgcgccggtctggccgatgcgatttgtgacctggtctccaccggcgccaccctggaagctaacggcctgcgcgaagtggaagtgatttaccgctccaaagcctgtctcatccagcgtgatggtgagatggacgatgccaaacagcagttgatcgacaaactgctgacccgtattcagggcgtgatccaggcccgtgaatccaagtacatcatgatgcacgcgccaaccgagcgtcttgatgaagtgatcgccctgctgccaggtgcggaacgtccgaccattttaccgctggcaggcgatcagcagcgcgtggcgatgcacatggtgagcagcgagacgctgttttgggaaaccatggaaaaactgaaagcgctgggcgccagttcgatcctggtactaccgattgagaagatgatggagtgacggcgatgagcttcaatactgtaatcgactggaacagctgtagcccggagcagcaacgtgaactgttgcagcgcccggcgatctccgcctcggaaagcatcagccgcacggtcgctgagatcctggataacgtgaaagcccggggtgacgatgcgctgcgtgagtacagcgcgaagtttgataaaaccgaggttggcgcgctgaaagtcaccgcgcaggaaattgacgacgccagcgcccgactgggagagacgctgaagcaggcgatggccgtggcggtcaaaaatatcgacaccttccacatggcgcagcagctgcaaaccgtggatgtcgaaaccctgccgggcgtgcgctgccagcaggtgacccgtccgatcgattcggtcggcctgtatattcccggcggctccgctccgctgttctcgacagtattgatgctggcgacaccggcgcgcatcgccggttgccggaaagtggtgctctgctcaccgccgccgattgccgatgaaattctttatgccgcgaagctgtgcggtgtgcaggacgtctataaagtgggcggcgcgcaggcgattgcggccatggctttcggcaccgattccatcccgcacgtggataaaattttcggccccggcaacgcgtatgtgaccgaagccaagcgtcaggtcagccagcgtcttgatggcgcggccattgatatgcctgccgggccttctgaagtgctggtgatcgccgacagcggcgcgacgccggatttcgtggcctccgatctgctttcccaggccgaacacggcccggactcgcaggttattctgctgacgccggacaacgccatggcagaagcggtggcgcaggccgttgagcgtcagctggcggatttaccccgtgctgataccgcccgccaggcgctggcggccagccgtctgattgtggcgcgggacctggcgcagtgcgtggccatctccaatgcctacggtccggagcacctgatcatccagacccgcgaagcgcgtgcgctggttgacgacatcaccagcgccggttcggtatttctgggtgactggtcaccggaatcggcgggggattacgcctccggcaccaatcacgtgctgccgacctacggttataccgccacctgctccagcctcgggctggcggatttccagaaacgcatgaccgtgcaggagttgtcccgcgacgggttcgccgccctcgcctccaccattgaaaccctcgccgccgccgaacgcctgcacgcgcacaaaaatgccgtgacgctgcgcgttaacgcccttaaggagcaagcatgagcatcaccgaactcgcacgcgaaaatgtgcgcaacctgacgccttatcagtctgcgcgccgtctgggcggtaagggcgatgtctggctgaatgccaatgaattcccgacgccggtagcgtttcaatttacacagcagacgctgaaccgttacccggagtgtcagccgaaagcggtgattgacggctatgccacttacgccgggttgaaaccggagcaggtgctggtgagtcggggcgctgatgaaggtatcgaactgttgatccgcgccttttgcgagccgggcaaggatgcggtgctgttctgccccccaacctacggcatgtacagcgtcagcgccgaaacctttggggtggaaacgcgtaccgtgcaggcgctggacgactggcagcttaacgtgcccgccattgctgaaaagctcgacggcgttaagctggtatacgtgtgcagcccgaacaacccgaccgggcagatcgtcaacccggcggatctgcgggcgctgctggagatgacccgcggtaaagcgctggttgtcgccgatgaagcctatattgagttttgcccgcaggcgacgctcaccggctggctggcggagtatccgcatctggtagtgctgcgtaccctgtcgaaagccttcgcgctggcgggtctgcgctgtggctttacgctcgccaatgaagaagtcatcagcctgctgatgaaggtgatcgccccctacccgctttccacgccggtggcggacatcgccgcgcaggcgctgaccccgcagggtattgccgcaatgcgcgagcgcgtggcgcagatcctggcggaacgtcagtatctggtggcgaatctgcgcgatattccctgcgtcgagcaggtttttgattcggaaaccaactatattctggtgcgcctcaccgcctccagcgcggtatttaaatcgctctgggatcagggcattatcttacgcgatcaaaataaacaacccactttaagcggctgcctgcgcatcactatcggcacccgggaagaaagccagcgcgtcattgacgccttacgtgcggagcaagtatgagccagaagtacctctttattgaccgtgatggcacgctgattagcgagccgccgagcgactttcaggtcgatcgttttgacaagctggccttcgagccggatgccattccggttttgctagccttacaaaaagccggtttcaaattggtgatgatcaccaatcaggacggactgggcacgtcaagcttcccgcaggctgatttcgacggcccgcacaatctgatgatgcagatttttacctctcagggcgtggtctttgacgaggtgctgatttgcccgcacctgccggcggacgagtgcgactgccgcaaaccgaaaacccgccttgtggagcactatctggcggaacaggcgctggataaagccaacagctatgtcattggcgatcgcgagacagatattcagcttgccgacaatatgggcatcaccggcctgcgctataaccgcgagacgctgaactggacgatgatcggcgagcagctgacccgccgcgatcgctacgcgcacattgaacgcaataccaaagagacgcagatcgacgttaaggtgtggctggatcgcgaaggcagcagcaagattaatactggcgtcggcttcttcgaccacatgctggatcagatcgccacccatggcggcttccgcatggaaatagccgtgaaaggcgatctctatattgacgatcaccacacggtggaagataccggcctcgcgctgggcgaagcgctgaagctggcgctgggggacaagcgcggcatcaaccgtttcggctttgtgctgccgatggacgaatgcctggcgcgctgcgcgctggatatttccggccgcccgcacctcgaataccgcgcggactttacctatcagcgcgtgggcgatctgagcactgagatggtcgagcacttcttccgctccctctcctataccatggcggtgacgctgcacctgaaaaccaaaggcaagaacgatcaccaccgcgtggagagcctgttcaaagcctttggccgcacgctgcgccaggcgatccgtgtggaaggcgatacccttccctcctctaaaggggtgctgtgatgaacgtggtgatccttgataccggctgcgccaacctgaattcggtgaaatccgcagtgatgcgccacggttatacgccgctggtgagccgcgatccggatgtggttctgcgcgccgacaaactgtttctgccaggcgtgggcaccgcccaggcagcgatggatcagatccacgaacgcgagctgagcgatttgatcaaagcctgtacccagccggtgctggggatctgtctgggcatgcagctgcttggcagccgcagcgaggagaataacggcgtcgatctgctgggcatcattgagcaggacgtgccgaaaatgaaagatgtcgggctgccgctgccgcatatgggctggaaccgcatttatccaaaagcgggcaatcgcctgttccagggcattgaagacggatcttatttctacttcgtgcacagctatgccatgccggtgaatacctggactattgcccagtgccattatggcgaggcctttaccgccgcggtgcagaaagataacttttatggcgtgcagttccacccggaacgctccggtgccgcaggcgcgcagctgctgaaaaacttcctggagatgtaatgattattccggcattagatttgatcgacggcacggtagtgcgtctgcatcagggtgattacggccagcagcgcgactacggtaacgatccgctgcctcgtttgcaggagtatgccgcgcagggggcagaggtgctgcatctggtggatttaaccggcgcaaaagatccgcaaaaaagacagatcccgctgattaaatcgctggtggcgggcgtgaacgtccctgtgcaggtgggcggcggcgtgcgaagcgaagatgacgtggcggcgctgctggaggccggcgtggcgcgggtggtggttggctccacggcggtaaaatccccgcagctggttaaacagtggttcagccgttttggcgctgatgcgctggtgctggcgctggatgtgcgcattgacgaggcgggcaacaaacaggtggcggtcagcggctggcaggaagactccggcgtgtcgctggaagcgctggtggagaagtatctgccgtcaggccttaagcatgtgctgtgcaccgatatttcccgtgacggtacgctggcaggctcgaacgtctctttatataaagaagtctgcgcccgttatccgcaggtggcgttccagtcatccggcggcattggcgatctggaagatattgccgccctgcgcggcacgggcgtgcgcggcgtgattgtcgggcgtgcgctgctggaaggtaaatttaacgtaacggaggccatccaatgctggcaaaacggataataccctgcctggacgtacgtgacggccaggtggtgaagggcgtgcagttccgtaatcatgagattatcggcgacatcgtcccgctggcaaaacgctatgccgaggaaggcgcggatgagctggtgttctacgatattaccgcctccagcgatggccgcgtggtggataaaagctgggtgacgcgcgtggcggaagtgatcgacatccccttctgcgtggcgggcgggattaaatccgcagaagatgcggcgcgcattctcaccttcggcgcggataagatttccattaactccccggcgctggcggatccggagctgatcacccgtctggcggatcgctttggcgtgcagtgtattgtggtgggtattgatacctggtttgatgacgccagcggcaaatatcacgttaatcagtataccggcgatgaaagccgcacgcgcgtgacacagtgggaaaccctcgactgggtgcaggaagtgcagaagcgcggcgcgggggaaatcgtccttaatatgatgaaccaggacggcgtgcgtaacggctacgatcttgcgcagctgaaaaaagtccgcgaggtctgccacgtaccgctcattgcctcgggcggcgcgggcaccatggaacatttcctcgaagccttccgcgacgccgatgtggatggcgcgctggcagcctcggtgttccacaaacagattattaatattggtgaattaaaagcgtacctggcagcccagggcgtggagatcagggtatgttaacagagcaacaactggcccgactggactgggaaaaaaccgacggactgctgcccgccgtggtgcagcatgcggtatccggcgaagtgctgatgctgggctatatggataaagcggcgctggcgaaaacgcaggagagcagcaaagtgacgttttattcacgcactaagcagcgcttatggaccaaaggcgagacctccggacatttcctgaacgtagtcagcattacccctgactgtgataacgataccctgctggtgctggccaatcccatcggccctacctgtcataagggcacctcaagctgcttcggcgaagcgagccatcagtggctatttctgtaccagctggaacaattgctggcggagcgtaagacagcggatcctgaaagttcatataccgcgaagctgtacgccagcggcaccaagcgcatcgcgcaaaaagtcggtgaagaaggcgtggagacggcccttgccgccacggttaacgatcgtgaggaattaaccaatgaagcgtccgatctgatgtatcacctgatggtactgttgcaggatcaggaactggatatgacgacagtgattgagaacctgcgtaagcggcatcaataagacgaaaaaaaaccgggctgctaagtgcccggtttttttgtgcctgaattttagtatttaggctggtagttacggatggcgttgcgggccaggacggcgccagcgccaaccatggcacccaacaatgccgcgatcaataccgtcagagagcgtttcgggctgtcgcggaacaggggttccgttggtttcatgacataacgataggcatgcatatttgccggatcgggtttgatacgctgaatatctaacagattttgtcgtgtacgataataatccccggagaacaccagcggtcgtgaggcttcattcttaatcatggactccagcgcatcactacccagcaggaataaagtatcctgggtgacatcctgggtttgctgcacctggggttggttaacaccagcatctttagcaaaagtcagcgcctgcgtgatctgcttgatgcgcagatttttttgctcctgagccactttttcctgagtcgccagcgagtcctgcagctctgtaagacgtgatttgatgttgattgccagatcctgatccagctcatccgctatttgctcatcaacctgttgaatatatttcgccagttgctgctgcgcatgtttggctgaatcgccctgataggtgaccttaagcggtaagggctgaccttttaccgcagagtcaatggtcagggcctcaggcgccgactgatttttaagcgtttcagccagtgcagaaaacgccccgctaaaacgagtgatcactcgctgttgaatgtcaggattgtcgacttttccatcaccataaatcagcgccattgcattggtgtaacctgctatctgaccggcatctggcatggtgataacagccgttgaagtccatttctcttttacaaaggacacatagattccggcgaccacaactgcaatcataatgaaaatggcaataagccacttcccacgccacagctgcataaaaatatcaattagatcaatttgttcagaattattattacttctgacaaaattattatcgttgtgcgtcatagcaaccttaagaagaagattccagtctaagattaaaaattcagtgtagtgtacactttccataaaatcctggaatcagaatccgtttaattttgttactgtctgaaactacagataaaggtcacctgcaccggtagccttgctgatggcatcagcatacaatagcgggcatgttgcaccgcaggtgaaaaggacaagtatgaaatttttagtgactggcgctgccggttttattggttaccacgttagcgagcgcctgttgcaggcgggtcatcaggttgtcggtattgataatctcaatgattattacgatgtcagcctcaagcaggcacgtctggatcgactacaggtgccgggctttcagtttaaaaagctggatcttgccgatcgggaaggtatggcgcaactctttgccgacgagaaattcgatcgcgtgatccatctcggcgcccaggctggcgtacgttactcgctggataatcccctcgcctacgctgattctaatttgatcggtcatgtcaacgtgctggaaggctgtcgtcataacaaggtgaaacatttgttatatgcatcctcaagctcagtgtatggcctgaaccgcaagatgccattttcaacggacgattccgtggatcatccggtgtcgctctacgccgcgacgaaaaaagccaatgagctgatgtctcatacttattcacacctgtatggtttgccgactaccggcctgcgcttctttacggtatatggcccatggggtcgtccggatatggcgctgtttaaattcaccaaagcgatggtggaaggtaaaagcatcgacgtttataactacggcaagatgaagcgtgatttcacttatattgacgatatcgccgaagccatcatccgtttacaggacgtgatcccggaagctgataccagctggacagtggaatcaggttcaccggcgaccagttctgcgccgtatcgcgtttataatatcggcaacagctcacctgttgaactgatggattacatcactgctctggaagaggctcttggcatcgaagcgcaaaaaaatatgctgccgatccagccgggtgacgtgctggaaaccagcgcggataccaaagcgttatatgatgttatcggcttccgtccgcaaacctcggttaaacagggcgtgaagaactttgttgactggtataaagcattttataaagtgtaaaaaaaaggccctcatctgagggccttttttatcagtcgctgccgaacaggtcgcgggtatatactttatccgccacatccgccagttcttccgccatgcggtttgaaatgatgacatccgcttctttcttgaatgcatccagatcgcgcacaacgcgggaatggaagaattcatcttctttcatgaccggttcgtaaataataacctgcacgcctttcgctttaatacgcttcataatcccctgaatagaagaggcgcggaaattatctgagccgctcttcataatcagacgatagacaccgacgactttaggcttgcgggaaagaatggaatccgcgatgaaatctttacgcgtacggtttgcatcaacgatggctgagatcaggttgttgggaacggactgatagtttgccagcaattgtttggtatctttcggcaggcaataaccgccatagccaaatgacggattgttgtaatggctgccgatacgcggatcgaggcagacaccttcaatgatctgacgggaatccagaccaaggctttcggcatagctgtccagttcgttgaaataggccacgcgcattgccagataggtattagcgaaaagcttaatggcttcggcttcagtcgagtccgtaaacagcactttaatatcttttttgatggcgccttcctgcaacagggacgcaaaacgcttcgcgcgttctgaacgctcgccaatgacaatacgtgacgggtgcagattgtcgtaaagtgccttcccttcacggaggaactccggagagaaaataacgttatcaatacccagttcatcccggattgactgcgtaaagccaaccggcaccgtggatttaatgatcatcacggcctgcgggttgatttccagcacgtcgcggatcaccgcttctacgcttgaggtattaaagtaattcgttttcggatcatagtcagttggcgtggcaataatcacaaaatccgcatcgcgataggcatcctgcttgtcggtggttgcacgaaaattaagcggttttgtctgcagatattcctgaatctctttatcaacaatgggagagattttctggttaagcatatcgactttggcctggatgatatccagcgcgaccacttcgtgatgttgagcgatcaaaataccgtttgaaagaccaacgtaacctgtaccggagattgttattttcattcgctaagtaacttcttcaagtttaagtgtctggagatggcaataccaccaccactgaaatttgttaactgagggggttttacctcttacctttatcgcctgtcaagacgactactggaacctggttttgtccggaaaaaagcttttaggaaattactcaccccttcaaacgtgactacgcccgtaacaggtgcattccgcataaaaaaacgcccggtgttgcagaccgggcgtttagtagttttcaggttaaatcagattaatccagccattccgtatggaatacgccatctttatcggtgcgcttataggtatgtgcgccgaagtagtcacgctgtgcctggatcaggtttgcaggcagtacggcagcacggtagctgtcgtaataagccacagccgcgccgaaagtcggcaccggaatgccgttttgtacggcataagcaaccacatcacgcagtgcctgctgatagtcatcggcgatttgtttgaaatacggtgccagcagcaggtttgcgatggccggggtttccgcataagcatcggtaatcttctgcaggaactgtgcgcgaataatgcagcctgcacggaaaatcttggcgatttcaccgtagttcagatcccagttgtactcttcggaagccgcgcgcagctgtgagaatccctgagcataagagacgattttaccgagatacagtgcacgacgtactttctcaataaattctgctttatcgccagccggtttagcctgcgggccagacagcactttggaggctgcaacacgctgttctttcagagaggaaatgtaacgcgcgaacacggattcagtgatcagcgacagcggctcaccaagatccaacgagctctggctggtccatttcccggtacctttgttggctgcttcgtccaggatcacatcaaccaggtatttaccctcttcatcttttttcgtgaagatgtctttagtgatgtcgatcaggtagctactcagttcacctttgttccattcggtaaaggtctgcgccagctcttcgttggacagattcagaccgcctttcagcagcgagtaagcttcagcgataagctgcatgtcgccgtattcgatgccgttatgaaccatcttaacgtagtgacctgcgccatcggcaccgatgtaagtcacacaaggctcgccatcttcagcaacggcagcgattttagtcaggatcggcgcaaccagctcatacgcttctttttgaccaccaggcatgattgacgggcctttcagtgcgccctcttcaccgccagacacaccggtaccgatgaagttgaaaccttctgcagagagttcgcggttacgacgaatagtgtcgtggaagaaggtattaccgccatcaataatgatgtcgcctttgtccagatacggtttcagggagttgatagcagcatctgtacccgcgcctgcttgcaccattaacaggatacgacgaggcgtttcaagggattcaacaaactcctcaacgctgtaaaaaggaaccagatttttgcccggattttcagcaatgacttcctcagtcttttcgcgggagcggttgaaaacggaaacggtatagccacggctttcgatgttcagcgccaggttgcgccccatcacggccataccaacaacgccgatctgctgtttggacattacatactcctgtcaggtgtggtcaccgcgtcatgtgcgcggcttgaaaatgtgtcttagatgttaactcaaaaatattaaaaacaatagttcatgaattgtcaggtctttacacagcaaataagcattttttgataaaatctcataaacctgaaaatagtttctatttatgaaaaaataactactaacaaaagtatttttaacgactataacgtctattaaaagaaattaagggccagcgccatggctaagagcacccgatcccgggagcgtcttcttaacctgcaaacatggaacattaatttcaagttaccgacataacctgaatggatatttttgtgtaaaaatctgtcattacttaaagggaatagctcaattattttttcgatttcagcccgataccatttgtttttcaccaggctaagtcttttgaatattgagcgtaagctattgttagcgccaacctggttacttgcatgctgacgataaagcatcccagaattgttgtcgatgtaccatttgtaatttctggaacgagcgaaagcatatataaaccaatcatgcaaagcaatattacaaaccggcccctggttatcaattataaactttctaagttcaagataggccgctttttttataacataagtacatccagggccagcagcctcgaaataataatcgtaatcaacaaaaggctgtgatttgacaatttcacattgcatgccattttcccagaatgctgtcacattactggaataaaaatcattcttgtccaggttagcaatagcgcgacataacttgtcatttttccagatatcatcctgatctgacaacgcaatatactcgtcgtctttaatatcggcatccataatgagacgataaaagtttctggccgcgccaccaaacttcttacccattggtaaaaattcaacattggggtgtttagcggccatggactgaacaagttcttcagtaccatcggttgaaacgtcaacgctgataacaattcttacatcgacgttagactgttttaatattgactcaacctgctcttcaatccattgtttgccattgtaagcagctaacaagacgagaactttatctttcattacggtcaccattcttcatgcgtaacttgtatatttttgaaatgaataaacgcctaaagaactttaatagtgaaaaagctaccagaaagaaatactttggcattgttataagctttttatccattaattcagtatagttacttaattcgcctgattccattttccatagctttgagccaagtcctgcaccagaggcatatggatgtttatcatctgcataattgattacattatcacgtaatacagcgcttttaaattgatgtgttacgtaataaaaaaagagggcatcctcactgtaccttcgaccttcagaaaaaccatcaatgtggctgaatacttcttttcgcagaatcacagtcgaaggctggaagtactgtttcattaactgcatttgatacgtgacatgtatatgatcgtcacgaccatcagcactaataaatctattctgatacccgccaccaacaacaaaatagtcactgtttgccagaaaaatcatttgcttacgagttttatcactacgccactcgtcatcagcatccagaaaagcaatatattgcccgctactacgcctgatgccggcatttcttgccgacgctacccctgcattcgcttgcctgaccaggtcaatatcgatattctgttcatgagcaaatctcgaaactttatcggctgtgctatcagatgagccatcatcaatgacaattatttcaaaattgaatgcaccttcttgtcggataacggaaagcaaggctcgttcaatagtaccctccgcattataagccggaatgatgacgcttattttattcataatgatatattcttataataaccaggtcatgcataataaatacaattcaaattttatgagtgcatggagaatacttttttccaggaacttaccactgcatctggataatattttttactgctagcgacagcgttcttcgaaatagactcgcaaagctgctcatcatctaataacgccagacatttttcctgaagcgcctctagatttccattttcaatcaaaaatccattcacagcattctcaataagttcagcaggaccagtaggacagtcataactcactactacacacccggctgccatggcctctataataaccattgaaaaactttcacgctcagacgtcacaataagaaattttgacttttgaaaatccttgaaaatatcacttgatttaccgcacaatatctctgtggcagacggagaagatgataataaactctcatattcttcgccgtggccaaataattttgacgtaatgtttcggtgactcttgatataatcgtgcaacttcaaaaaatgggtaaatcttttgatttcgtgtagtctgccggctgcaacaaagtcaacaggacgggttgcaattggttcattaactgcgcccgttgcaaaattaacatctaaaatgttagggattgtatataccttagtaaaccattttctgtagtattcattatcttgttttgtcagacagactatggcgtcacatcctaaacggtaagagtatttacgtaacaatcttactcgtgatctatgggcataataatcagcgtgctgatgagcaattagcatgaatttctttttactgaatttccttagcagcgaaaggaaaaacgaaatgcgatcataagctgatataagtacggcatcagggggaagtgatttcaagaagttccataacttatgaatttcatttttacccgtcagtaatcgatactgctcatttgcatcaatatgaatttcagcattttcatgtaatgaaacaatttcagcatcatagccagaatgcttgagagtattcactaaggtaaaagaacttctttctattccacctaaatcacaagcattaagtaccagtacatatattttcatagatcgcagaatctctttgcatactaaattttaatgatcaacttttatgaccagcactaaagtatgttatggtagatataaccttccatggtcgtataaccattaatcttataagctgtcaccaggagtaacacattgaagaacgctattttctgtattaaatgtttgcagttataaaggattagcccataaataatcatatcatagactaaaaagtataaacttaaccgaacagcgatatccgggaaagagggataaagtgcaaggtagcaaaacatacctactaaataaagtttcaagaaaatgttatcgcgtacttgtcgtaatggaacaaccattagcaaaagtattactggcaataccctttttatacacccaagcagatagtccatagctgagtatgttgagttgtacgcactgtcagtataaagctcaacattacggaaatatcctaaaccactcagatactctgacaatgttaaaaatgagccagcaatgataaatgaacaaagagaagcaattaatatatttctgtatccaactttgaaatagttaactatatatgctaaagaaaatacaatcgcggttttatggaataagcaggcgatgaaaatagtaatggcaaagaaaaaaagttgttttcttacaacaaagaatattgaaatcagcgagattgataaagcaatactttgacgcatcccacttaaattcagataaaaaaacaaatccgaaaagaagactaataaggcgacattcttataatatgaaaacttatcaagaaagcatatcaataaagtaaaattaaggatattaattatcattaatacccaaggataacttaatccatccaatagtcgatagatactcgcaaatccaatctcaatattttgactaacaagttcatactggttgatatacatattttcataagcataccaatcaaggcctacattgctgcgtgttgccgcaaaaatcacaagcactactacaataaagaaggtcagaagatcttggtaggcttttcggtgataaaaagcatctgaaaaagctattatcgccagcaaaagatatagtaaaaaatacatttagcaccttaatcaggttattacgcaatataccaattgccgtagcacttgtgaaaactacttagtagtaaaatacttagagattatttttaaatatgaatcaccattcacattgcaaggctcaatataattaccttcagcccattcgttccatgattttaccatcaacatttttcttttcattctactaactatgttagcagtatttttaacatgttcttcaaataattcaggggagttatttttcagtatgaccccttttttaccatgcctgatactcgaatcccatcccggaaaaataacaggtatttgtaacgaattaggatcaatatccatgttcatttttcttgcacatcgttcgtatttgtagatgcgaggtataaaaatattataccgttgaagtttaacgatcagcaaatcgaaacatttccttataaaggttctatgtttcataaaatcacaactattcaaatactggtttaccaatttagtttctggatccccaggcaacatgttttcgccaataaagtagatgccatcaaaaccttctgcctgcgcccttgcagtaaaatactcgataagctctttgccatttaatgcatttttaagatcataaataaagaacactggcttgttatcgattttggtatatcgcttatctttaaaaaatggcagcaaataattaaaatatgactccaaagaaaaatcataatgttgttctttgaggagtttattttctgttttattccaccaggtgtggtttgcccacgcaaaacagaatttaacgtcaatatcactttttaacaataactctgctggtttctcaagcaacatatcatgatcgttaaaccagtaatgccaaaaacaaaaggacgtaatgccattttctttagcaattttatattgtttctcaatcaccgaaacgtcattcaaatcatagtaacccaaaggctctatgggttgagggattacgtggtccttataaattttcttagcacttttgagcttgacccattccgtaaaaccctttccccaccactgatcgttttcgggaatagcatggaactgtggtaaatagtaagtaaaaatctcttcaacttcagttttcataaaaatccaggaataaaatgaatgacttggaaacggccaaaattgtttttaatttttgaacacacgctgattaatggcggaaagcacttcttcgtccggacgtgtataaaataaactgacatcatcatcagcgatgttatttaaatcaagtttggaaaaatcaatttgtttagcatattcaatttcttgaggtgataatctcatactaattgtctttgccggatttccccctgcgaccgcataaggagctacatcttttgttaccacagaaccagcagcgatgaccgctccacggccaatctcgactcctgaaagaatggttacattgcaccctatccacacatcatcgttgatgattatgggtcccttggtaccagcatcaatatttttatttaaattcttttttgctgatacagggaatgaagtcattcctatagtcgaatggttaccacctaaaacaaaagtgacatttcctgcaattgaaacataatgaccaatttcaagccgttcaagcggattaccccattccagtacatatagggaaccataggtcattttaccgacctgaactttatcaaaatcaaaatcgtttataatggctgtatcattgtgtttatttctttttcgccatgcatgcttacgcattaataatttcagatttctttttacaaaagctactagcatttctttttcctgacggttgaaatcttttcatttatattatgctgaaggagattgattgcttaccagtgactcgatagctttaacctggcattgtgaagtacatcgctgtaaagccatttgacggctactttcttttagagcggctaaagaaggatcgtccaattttaaaaattccatgatggaattggctaaagcttgtgtagtaatactatccgccaggaaaccgctgattctgtcgacgatgagatcctctgcaactccgactttgaaagccatgactggaacacctgacatcagtgcttcgtttatcatcataggcccggcatcctctatcgaagggcaaataaaaccatctgccagattgtagagataaggatacttatctttgtcatgaataaaaccaatattcacaaaggaaatcccttcagggagagtagcctgggcttgatcaccgaccgttaaaatcgatacgcctgttagcagattgggaaagttctttctgataaacgccaaagcatcaagtacatactttacacctttcctcgggtcacttaaggattgcgcgcctaagaagataaccctattcccggcaggtatttgcacatcaataatatcgttggcgactacctttgtacggggtttgaaaatctgctcatcaataccgattatagctttcttgatgcccagtttcgctttaatcccacttgactcgcaacggtcatctaaccatttacttgccgaaagaaaaaaacaatccatttgcatgtaatacttcttacgcttatggaaaatatttttcggtagtttgatcaactcagggtatttcattgcagggcagttgtcacaatcaaccttataaccctcacaatgccatggataatgacaaccgccggtaaacatagctgcatccattaaatagaacgcaacaggacatccataatgcttttgtatttttaaaatatcatgatcagaaagataatcggcaacgaaataaactataatcagatcaggtttagttctgtattttttaaaaatttcgctgacactgaaagtagtattgtaaattaaataaattttatcttccgggccacctcgacgcacaaaaaatcgtcgcatcagtcttccaaaaatactaaatatctttcgcttattttgtgaaagctcaattacatctttatcgtgtgatgttttttccactacacacatgcttgattcgtgtccgtactttttaagattagtatgtgtacgatacgcaccaaagaaagcacccttactatcgccagtggacaaatgtaaaattttcatattttttctaccatttttttattttaaaattatggatagctgttaagaattgatttttgaacatatatataaaaccacaaataatcaccaggttaattattggcgggcacaaaatataaaggaatttattgcctgaaaataattcatagctttgcgtgattttgaaaaccacataagaaaccataaggatcagcatcgtcaataaggggatgatccggacatagcctgtcatctccttatgtacacagtaaccgccccataacaacataaacataagcgtctgaataaaatagaatatgcaggaccagtgtggcccaaaatacttggcaataagcactgttaagggaattgttaatgcggaatataatgcataggcgtaaaagtgaaacttcaactggccagtagaatataaaaggataaagacaaaattcatcatcccagcaaaaaaggcagcggaaaccagccatttagcatattcattaacagtgaaaccaagttctctgttttttagccacaatgaaattaaatcacctccgtataaatacatatacggaaccagaggcgcgagacatactatataacctattgaactaaggctaaatagttcaacaaatttggtatgatctttctctttaaccagcgcgctcattcttggcaaaagcaactgtgataaaggcgcagctaatgtaagcactaccgtactcagctgtgcaccaatctgatattgcgtatagcttgtgagatcggtataggttgagagagatatcttatctacctggctagctataacccatatcattgacaggccagataattgcagggaaaacttaattacgcttctgaaagaaataatctcatgaaccgcttgatcattattatcatgatattcattcaagctttttcgctgcatcatgatgacgtatgcgacacctcccgcagtggcaataatatcaacaattgctaaagccagaagagaagtaaagaaagcaatcaatgtattagaataataaactaatacgagatacgaaccgccataaaagaacgtagtatagaacatactccatatggctattaaatcctgacgctccatgccattaacaaaactctggaggtacgagcgtagatataataatgccagtattacaccagtaagtttaatacatattattgtttcatcgttcgacaggttggtcttcaaccagtcattagctatatagtctgcatagttgttaaagatgaaaacaagaataccggcgactacaacaaaaccacaaaaaaccttgagaaataaatttacaactcttgtgaaattaacaagctgatttttattggttgcaattaatttaatgaacgtaccgctaatgcctgcatctaacagacccattagcatgataagcatagtaaagaatgatactagtccataacgttccgttcccagcatgccaataattaacggtactaatagcagtggaaatgcggctctgtacaactgcgaggcatataatactattactttcttaaacataaccgctcacaataaaaaccagccaatcctgacattacatgtttttgaagaagtcagatattttggagcaaattgagtctacctgttccagactgagctcataatacataggtagtctgagtaaacaatctgtaaagcggtcactgtattcaagatctacaggctcatttttctcaaggaaaaaatcactcttattaagtgataaataatggaatacagagtggataccattttctttcagataagcaataagcgatgaacgggtttctatgtcgttacaaacaatataatacatatgagcattgtttgtagcataagacggaacatctggtaatttaataaggttttcagcctctaagctggcaagattcgcattataacgattccacagcgccttacgtttaccctgaatgtcatctaagctttcaagctgtgcatacaagtaagctgcaataatgtctgaaggtaagaaagaagaaccgatgtcaacccaaccgtatttatttacttcacctctaaagaatgaagcgcggttagtacccttttcacgaatgatctctgcgcgttgaatatattgctcatcatttatgacaagcattccgccttcaccagaaataatattttttgtttcatgaaatgaaaacgtgccaaaagtgccaatactacctaatggtttatctttgtagtatgagtcaattgcctgagcagcatcttctacaaccggtatattatactccctggatatagacataatctcatccatatcacaggcaatacccgcataatgcacaattacaatagctctggttttatctgtaatgctgttacggatagcaactggatcaatatttggattgtcgctgcaactatcgacaaatactaattttgcaccgcgtaatgaaaatgcattaacagtagaaacaaaagtataggatggagcaatcacctcatcccctggctggatatcaagtaaaatagcagccatttcgagagcatccgtgcacgacgtagtcagaaggacttttttgaaaccgtattttttctcaaaaaactcatggcactttttagtaaatgcaccgtcacctgaaattttaccgttactcactgcctggccaatataatttagctcatttccctgcatatacggcttattaaacggaatcattttgctgccttatttaagatcattaaaatagttagcatccgcatccttcgcggaaaggatcactttttctgccgatattggccaggtaatgttgagcgttggatcattccagacgatgctacgctccgctgaggggttatagtaatttgtcgttttgtataaaaactctgctgtttcgcttagcactacgaaaccgtgagcaaaaccctcggggatccataactgacgtttattttcggctgaaagcgtgacgcccacccatttaccaaaagtggcagagtcacgtcgtatatccaccgcaacatcaaatacttctcctactgcacagcgtactaacttaccttgcgcatagggttcggcctggtaatgtaatccacgcaatacgccttgcgtagattttgaatgattatcctgaacaaatgacagcgttgtaccaacatgctcctcaagtgctttctggttaaagctctcgaagaaaaaaccccgctcatcgctgaaaacttttggttcaataattaagacatcagggatttcagttttaattatattcattattaataacctttaatcattttcagcaaatattgcccataagcatttttcgagagcggcgcagccagttttttcacttgttctgcatcgataaaacctttgcggaaagcaatttcttcagggcaagatactttcagaccctgtcgttcttctattgtttcgataaaattactggcttcaataaggctctgatgcgttcctgtatccagccacgcgaacccacgtcccatcatggcgacagaaagtttgcctttttccagatagaggcggttaatatctgtaatctccagctcaccacgtgctgatggcttaagatttttagccatttctatgacatcgttgtcataaaaatataacccggtaaccgcataattactttttggttcagcaggtttttcttcaaggctaattgcggtgccttgtgaatcaaattctacaacgccgtaacgttcagggtcgttgacatgataagcgaagacagttgcaccgttttccctggaaactgcgccatcaagcagtttcggtaaatcgtgaccatagaaaatattatcgcccagaaccagcgcgcagttatcatcgccgatgaaatcttcaccaataatgaaagcctgcgctaatccatcagggcttggctgcactttatactgcaggtttaatccccactggctgccgtcgccgagtaactgctcgaagcgcggggtatcttgtggcgtgctgatgatcagaatatcgcggatacccgccagcattaacgttgacaatggataataaatcatcggcttgtcatagattggtaacagctgtttactcactaccatcgttacgggataaagacgtgtcccggaaccgccagctaaaataatgcctttccgtgttttcattttactatctcagacaatgagttaatgtgcagttgtggtaaacaactctgcgagcatacgcttaacgccctcttcccatttcggaagcaccagactaaaggtgtgctgaaatttttcggtatttagtcgcgaattcagaggacgctttgccggtgtggggaaactctcggtggataccgcagccagttcattaagagaaagctcgatgcccgctttacgcgcctcttcaaacaccagcgccgcatagtcatgccaggtcgtggtgcctgaagccaccagatgatacaagcccgcgacttccggcttttgcagcgcaacgcgaatggcatgtgccgtgcaatcggccagcaattcagcgccggtcggcgcaccaaactgatcgttaattaccgacagcgtctcacgctctttcgccagtcgcagcatggttttcgcgaagttgttgcctttgccggcatatacccagctggtgcggaagataagatgtttttcgcagttctctgcaacagccttctcccctgccagcttggtttcgccataaacattcagcggcgccgtttcgtcagtctctttccacggcgtctcgccggtgcccgggaagacataatcggtggaataatggactacccatgcgcccagtgcctgcgcttctttagcaatagcggctacgctggtcgcattcagtaattcggcgaaatcgcgttcggattccgctttatcgacggcagtatgcgccgccgcgttaacgatcacatccggacgcacacggcgcacggtttcagccacgccttcaggattactgaaatcgccgcaatactcctgcgaatgcacatcgactgccgtaagtttgcccagcggcgccagcgcgcgttgcagttcccagcccacctgacctgttttaccgaacagaagaatattcatgattaacggctctcgtagttctgttcaatccagctctgataagcgccgcttttgacgttcgccacccactgctggttatccagataccattgaacggttttacggatcccggatttaaaggtttcctgtggtttccagcccagctcgcggctgattttatccgcatcgatagcataacggcgatcgtgtcccggacggtcagccacgtaagtgatctgatcgcggtaagaggagtcttttggcacgatttcatctaacagatcgcagatggtgtgcaccacatcgaggttctgtttttcgttatgaccgccgatgttgtaggtttcgcccggctgaccttgtgttaccacggtgtagagcgcgcgagcatgatcttcaacatacagccagtcgcggatctgatcgcctttgccatagaccggtaagtttttaccttccagcgcattgaggatcaccaacgggatcagcttctcggggaagtgataaggaccgtagttgttggagcagttagtcaccagcgtcggcataccataggtacgacgccacgcacgcaccagatgatcgctggaggctttggacgcggagtacgggctgcttggcgcataggccgtttgctcggtaaagagcggcaatgcctcgccttgtggatgctcgtccggatgcggcaggtcgccatagacttcatcagttgaaatgtgatggaagcgaaacgcggattttgccgcgtccgaaagagctgaccagtacgcgcgggcagcttccagcagcacataggtgccaacaatgttggtttcgataaaagcggcagggccagtgattgaacgatccacgtggctttcggctgccaggtgcatgacggcatccggcttatgctgatcaaaaatacgcgccatcgctgcggcatcgcaaatatcagcatgttcaaaatgatagcgctcgctgtcagcgacatcactgagcgattcaagattaccggcgtacgttaatttatcaacattcacaactgaatcttgagtgtttttaataatatgtcggacaactgcagagccaataaagccagcgccaccggtaacaagaattttcacgctatccattccgtttagtaaattgagaggaagttcgacacgacagaattgtcgcggctttagcccgcaggcacgctaccgcccctggctcaacagctaccagtggactgagtaaggtcattttgtagggcaactgcgaaatgtagcgggcgtacgcccgttttcaaccgctaattgtcatccttatttcacattgaaacaaggaaaattcttatggatcaccggccttcgcatattttttaagccgttgatctacaagaacttgtagttgaaaataaaaaaagcagcagataatcatcagaggcaaatattcgcctctgagatcatctactgctctgtgttcacttactcgtaaaccgtccggaacatcagccaaccgttaacgtaatagtttagcaatgctttcgcggaatttttgaccttctttcagattacgcagaccatagctgacaaatgcctgcatatagcccatttttttgccgcaatcgaagctgtcgccggtcatcagcatcgcgtctaccgactgtttttctgccagtttagcaatggcatcggtcagctggatacgctcccaggcgcccggttcggttttttccagttccggccagatgtcggcagacagaacatagcgacccacggccatcagatcggtatccagcgtttgcggctgatccggtttttcgacgaagttaataatgcggctgactttaccttcgctgtccagcggctctttggtctggatcacaccgtattcagacagatcgcccttcatacgtttcgccagcacctggctgcggccggtttctttaaaacgtgccaccatagcggcgaggttataacgcagcggatcggcgctggcgttatcaagaataatatccggcagcacaaccacaaacggattatcgcccacgataggacgcgcgcagagaatggagtgacccagacccagcggctgcgcctgccggacgttcataatggttacgcccggcggacaaatagactgtacttccgccagcagctgacgcttaacacgctgttcaagcagcgcttccagttcgtacgaggtgtcgaaatggttctcaacggcgttttttgaagagtgggttaccagaacgatttctttgatccctgcagcaacaacctcgtcaacgatgtactgaatcattggcttgtcgacgatcggcagcatttcttttggaatggccttggtggcaggcaacatgtgcatcccaagtccggctaccggaataactgctttcaaattaatcattattaattccacctataaatggttgatgaattatagctatttagcctgctttatccagcaggttttcaccctctggttgaggcaaatcatgttacgccggttaatatccgtatgcagtagatgtaatccgaagctgcctcctggcgcaccaggaatgttcgcaaacttgtttttatgtgcgtttatcaggcagacggaagttcagtttatcggtattgaccacatgctgatccacccggtcgatgtccaccgagctttggcctttttcatttaccgcatgaatgttggccagggaaagcagcgtgtcctgcttcgccataaagcgaccgcgcacgtctttgcgcagatcaaactgcattttcagcgccggtccggtggcggcttcctgcatgatattaatgttacgcaagaacaggtgctgcggcttattgtgcagggcaagggtcgcgcgcttcatggtcagattggtgatcgccacaaaggatgtcgcgttgccggatgagatctgtataccacgcagtttcagttcactgttgctgttatcgagatgcacgtcgttgagcttgaaattttgcgggatagagaggtaattgcctttgattacgccataaccaatcagcataccggcgctgttggtcatgttgacgttatcaatcacgaaattatcgcagccgtaaatcgccacggtggcgttatcaatgccagctttcttactgtactccggcgtaatatcggtggctttgatattgcggatcacgaagtgcttgccgttctccacatgcaccagctggcggcagtggctgccggtaatgttcgccacgacaaagttttttaccgcctgatgttccgggtaatcattgtcataggtgctgcccgcgaggccaataccaatcccccagttgatcttgccgttggtgcagtcaatatggtcgatgacatgatcggaaataagaatattgctgtcgttgatcgccacgttccactcgatggcgtcgccctgcagatagctgaagcggctgttggtgatacgcgcgccgtcaatacgattatggaagccctggcgcaggatcgcgtagttggctctggtgaccgtgatgtcatcaatcagcaggttacgcattacacgtttatttttgccgccgatgtagatttgcgtcaccggcccgaagccgctcattgccagccccttgatcacacagtccgatccgcgcacgtcgagggtaatgttatacaggctaccgcccttctcacctatgaccttactgccatcctgtaacacaaagcgtccgcggccattccccttcagggcaccacgcaccagcagggttttcccttccgggatgaaaatgccggtattgatgttttcacaaacgagatcggcgggtacttccaccgtctcgccatcggcgaacgcctgtttaaacgcggcgatccagtcatttttctggtagtcgcgcacatcaacggtggatttactgccctgcgcgaaggcggcggcaggcagaagcggaagcgaggccagtacggaaccggccttaataaagtgtcgacgggaaaatgctgtcataaaacctcagttcagagcgtctggagcagcgtcgccagacgctgattgattttctgctgattaaagtccgtttcgactttttcacgggcgcgggtcaccaccggcaccagctgctggctctgcatgctgctgaaggcggccagtttgtcagccagcgcctggggatcgttctccggcaccagccagccggactggtcagcgtcgatcagctcaggaataccgctgtgtacggtagagacgaccggaatgcctaccgccatggcttccatcagcgccaccggaatgccctccatgtcgccgtcagcgccggtcacggacggcagcaggaagacgtcagcctcatcgagcattgcctttacttcatggctgggcttaaagcccggcatctcgatcacgtcctcaagctggaactgttcgatcagagtgcgcagacggcgctcccagggtccgatgccgagaatgcgatagtggaaattaacaccgcgcgccttcagcagacgacaggcttcgatggcgacatgcagcccttttttctcggtcaggcgcgccacggagattatctgcaagggttgtccgggcgctttcacctcgcgcagggtaaagcgcgacatatccacgcccatacgcgaaacggcgatcttctccggcgggcagcccatattttgcaggcgaccggcccacagatcgctgatgggcaacatcagatcgccgcggcggaacagctgctgatactccggcgtatagtgcgccagtacgtcccggtgcgagacgtcgataccgtggaagacggtggcgattttgccgcggatcacccccagttcacgcagttttgctgccgtcacgcctgccggaccaaagtgggcgataaacacatcggcgctgaaagtgcgtggtgccaggccacaaatggcggcgaggatcaggttacgggcttcatcgccgtagcggcgcatattcagcgccttccaggtggatgcgcgccccgcgccccgcaggatcgcctgcgcccggtagcgcagttttgcggctttgccctgcggctcatccagcagccagtgggtcttctccgccagcttgtattcggtataggccgcatgggtattgctgagatcgcccttatgcagggcgataatctccacgtcaaaccccatatcgataaacgccgtgatctggttcaacacgaaggtttcggacgacagcggaaacttcagcaggaaaaaactgaccttcattgcttaccccgcactctgtccatcaccgatttcaccatctgcaatccattattgcgttctgcggccaccgccgttgaaagttgctgattaatggcgggcagctggccgagggtatccgccaccatcgcggcgagcgagccgtcgagcaaatgacgaatatcaatggccatctccggcatgccaagctgctgcatgatgcctgcggatttgtgctcgtagttaatggcgatggccggtgtgccgaagttcatggagatgatcgccgaatgcagacgggtgccgacggtcagatcacaggcggcaaaaattttgcccatctccagatcgttaagctcatccatcaccacgtgatagcgggacggatcgctgacatgctgacgcagattgagcgccaccatgcggtcatctttgttatagctgtcgatgccggtgcaggtggagagcgccattacctgccagcccgcatccagaatacggctaaccacttcggcgaaggctttttcgtaggcctgctgcgtggtgccgaggcgtttatcgaagggcgccagttcgcgcaacgtaatggcgacggttttctgcgaggccgccacgtccagccagtgctgcaccgcatagctgggggtaaaatcgctatcgtgatgatccaccagccacgcggtgtcgacgccctgctccaccttatcagtgttgatctggctctttttcatcagatcaagacttacgcgctcacgcaggatcaaggcatcgcagtgcccgaacgcatagttcgccagctggttaaactgcgcgtcctggaatggcccgacgctgtggccgatcatgtacagcggttttttcgccataaaggtgcagagcgcatgctcaaactgcggcacgccgtaaagatcgacaaagaaagatccgcccacctggataatggcgtcatagcctgacagcaggcgaacgaaatcggtaaagccctgggcaatggcgatattgcgcagcttgccgctgtcggtcacgcgggataacagcacctgatgctgataacggcgacgcaggactttcttcacccgcccgaccagaccggcggcggtattgtgctgtttcatctggctgtacagcggatcgcccatcaccggacgatttaatagccaggaggagctcaccggatagcggctcatgacatccacttcagcgtcaggctcaagcaccgtaatggcatccagtaagccgcgtaaaatcgcgctgtccccacggtttccacaggtatggttacctaaaataagtagtttcattacagtttcacctgaattattgatgtcgtaaatttgtgaataaaatcaacctgcgcgcagcagcattcttaatttttcattgcggcaaaactgacgtttcagctccaccaccagcgcattacgcgacagcacaatcatcaccgcgaacgccagcccaccggccaggatctgcaccgccagcagcgtggcaagggacaaatgcccgtccagcgccagccccaggccgtagctcaccaccagcgtcggcagcgacaggtaaaacggcagccacaggctcagaatgtactggcgatagctggaaccgagcaccggcttaatcattacgaaatagctcagaatggtgttgatgatctgcaccagcaggaagcccagcgtcacgcccagcgcgccgcccatgtgcccgcctgcgataatcgccgggacgaacaggcaggttttaaagacgttaaatttgaagctgatatcgacacgggctttcgccatcagcagcgatccaatggggttccccaccgcgcgcagcaggccgacgatgcacagcaattgcagaatggggatgatgctgttccacttctcgccaaacaccagcggcaccacgttatcggacaccaccatcagaccgagcaggatcgggaagttgataatgcccaccaccgacagcagtttgtagaagttgagccgcagcttttgcgtgtcgtcctgaattttggcgaaggccgggaagagcactcgggtgataatggggttaagcttcatcggcggcaccaccgcgacgttgtacgccaggttatagccgcccgcgacgctggcgccgagaatacgcgccagcaccagcgtggagaggttagtgttgacgtagttgatcacgctatccgccgtcagccatgcgccaaagcgcaggttggagttgacggaagccagcgaaaagcgcagacccggacggtaaattttgcggccgaagaagccgaacagcagcgtacgcaccgcggtgttgaccagataaccaaggatcgcggtcatcgccagcggccagtaccaggcgctgatcaccgtaaaggtgaagcccgccatcaccgatacggtttcaatcatgccgatcttgctgaactccagctctttctgcatcagggcgcggaactgctgaccgtgggggatcagcacaaaagccaccgacagcgttttgatcagcggcgccagatccgggttattcagtaccccggcaatcacgtcgcttaacaaaaacatcgccgcgcagaccaccagccccagcccgacgttcagccagtagagggtggtcagttcgagatggccgatctctttgcgctgaataatggagttggcgatgccaaaatccgacagcgtatccgccagggcgatgatcaccagcgacacggtgagcaggccgaactggtgattatcgatgatgcgcgccagccaggtcatctgcaccagcccaaggccgatgatgatcagggtggccatggctgaccactttgcgccgctgatggttttctctctcaggctcatgatgtgctcgcttaatacgccgctttgttcacaaagcctttaaagatggtgagaaaaacaatcttgatatcgaaccagaggctccattcacggatgtactccagatcgaattcaatacgtttttccattttttccagcgtgtccgtctcgccgcgccagccgttgatttgcgcccagccggtgatgcccggtttcactttatgacgcagcatgtagccctggatcagggtgcgatactgttcattgtgcgccaccgcgtggggacgcgggccgacaatcgacatgccgccggtcagcacgttgataaactgcggcagttcgtcaagtgaggtacggcgcaggaagttgcccactttggtgacgcggggatcgttctgcgtcgcctgggtgaccacttcggcgttttccatcaccttcatggaacggaatttccacaccttgatcggcttaccgtccataccgtagcgggtttgacggaaaataatcgggccaggagaactgattttcaccgccgccgcgatgcacagcagcaccggggagataagcagcaggatcagtgaggagagcacaatgtcttccagacgcttcagcacgcggttcatgccggagagcggtgtgtcatacagcggcaccaccggcacgccgttcatctcttcgatgcgcgaatgcaggatattaaaggtaaacacatcagggatgaggatcaccgagcaggtggtgtccgccagctcacgcaccaggcgttttatgccggactcttcgctcatcggcatggcgatgtaaacgttatgaattttgcccgctttcgcgtcttccagcagttggtcgtaattgcccgcccagtcagcggtcacgccgcccggtctggcatcgtgatagacgcccaccacttcaaagcccagccagggctcatggcggaaactgtccagcagcacctggcctaccggcagatcgcccgccaccgccacacggcgggtgttatagccatgatgacgcagccagcccgcgaaaaagcggatcagcgtgcggcaggtcaccagccccacgctgcttaatacgtaccaggcaaagaaaacgctgaaggtattatcaaaatcggcgttgaaggccatcagtccggcgctgaaaatcaggctcagcgtccagttttgcagcagcagcgccagctcggtcgagatcttcacgccacgccaggaacggtagaaatcggtcataccaccgatcatctggaacaccaccagcgtgatcagggccatcagcagatgcaggtaaaaaaagggtaacgcgtgtagcttgcagacgatccatagcccaccgaacatgatggtgatgtctgaaaaacgctgcaccatagagattaacgatgcattcgttttagctcgctcgcgcttttttagatttatcatcgttgttcctgttcttaagtcccctcgccccttcccgcgggcgaggggaaaccaagctcgactactggttcaacagcgccaggatgtcctgtgttcgtgcctccatcagcgccacgtcaccccgcgattcgacgttcagacgcaccaccggctcggtattggacgagcgcaggttgaagcgccattccgggaacgccatgctgatgccgtcggtatggtcgacttccagcgcgctggcggcatagtgctgctccacgcgggcaatagcggtggccggatccgccagcttgctgttgatttcgccgctggccgggaacgccgtcatgcgatcgcgaaccagttccgacagagactgccctttcacacacagcagttccgccaccagcagccaggggatcatgccgctgtcgcagtaggcaaaatcgcggaaatagtgatgggcgctcatttcgccgccgtagatggcgtcttcttcgcgcatacgctctttgatgaacgcatgaccggttttcgacatcaccggcttaccgccagcagccgtcaccacatccacggtgttccaggacagacgcgggtcgtgaatgatcttcgcgccagggtgtttttcgaggaaggcttcggccagcaggccaacaatgtaataaccttcgataaactgaccgttgccgtcgaacaggaagcagcggtcaaagtcaccgtcgaaggcgatccccatgtcggctttatgctcgatcaccgcattgcgggtatcgtcgcggcactccggcagcagcgggttaggaataccgttcgggaagttgccgtccggggtgttgtgtaccttgataaaggttaccggcacgttcagcgccttaaagcgcgcttcgatagcgtccaccaccgggcctgccgcgccgttaccggagttaatcactaacttcagcggcgtgatgttggtggtgtcgatgtaaccgagcaggtggtcgatataagcatcgcgcagatcgatctgcttatagctgccgcgtttatccgggttcaccggcgggaaatcattggcttccgccagacgctgcacgtcgcgcaggccggtatcgccgctgatggggcgcgcgcccttgcgcaccagcttcataccgttatagtccatcgggttatggctggcggtcacttcgataccgccgtccacgccgagatggaaagtcgcaaaatagatctcttcggtgccggaaagaccgatgtccagcacgtcaacgccagcgtcctgtaaccctttcgccagcgcaagcttaagtgcttcgctggtcagacgcacatcaccgccgagcacaatggtctgcggcttcaggtattcgccgtaggcgcgaccaatgcgccaggcgatgtcttcgttcagctcttctccgagcttgccgcgaatatcgtaggctttgaaacaggttaatttttccatgattacctcgttttcaggcgacacacagcctggagcccgttggggcaaatttgttatttgttccagcccggtggcgttttgcttaccgggcccggtgatgcgaactttccttgcccggtggcgcttcgcttaccgggcctacaatcattcacctgtaggcccggcaagcctgcgccgccgggcaacgttcattcactacacccgaccgtaacgatcctcaaaccgcacgatgtcatcttcttcaagatacgaaccggagcggacttcaatcagatccagcgggatcttgcccgggttttccaggcagtgcgtggcaccgagtgggatatagatcgactcgttttcgcccagtaacttgatctcgtcgttaatggtcactttggcggtgcccgccaccacgatccagtgctcggcgcggtgatgatgcatctgcaaggacagcccttcccccggcttcacggtgatgcgtttcacctgatagcgttcgccggaatcaatggagtcatacttaccccacggacggtacacttcccggtgaatgtgatgctcgtgacgaccctcggctttaatttgctcgaccacttttttcacgtcctgcaccgcattacgatcggcgatcagcaccgcgtctttggtctgcaccaccaccagatccttcacccctacggtggtgacaagaccggattcggcatagacatagctgttttcggttttatggctgatcacatcgccgtgatgcacattgccctccggcgtatgggcgctgatttcccacagggacgaccaggagccgacatcgctccagcccgcgtccatcggcaccactaccgcatcggcggttttttccatcaccgcgtaatccaccgactcttccgggcaagcgagaaaggcttcttcatccacgcggataaaatcgagatccggatcgacggcgtccatggctttggtgcaggcctgcaaaatatccggacggaattttttcagctcttccaggtagcgaccggcgcggaacaggaacatgccgctgttccagtaatactcgccgctggcgacgtaagcctgagcggtatcgagatccggtttttcaacgaactgcgccacttcgaaagccactgcgtccacctgcccctggctgaccgcgccacgacggatatagccataaccggtttccggcagatccggcacgatgccgaaggtcaccagtttgccgctctcggcgtacggcatggctgcacgcaccgcctcgcggaaggcttcttcgttctggatcacatgatccgccgccagcaccagcatcagcggatcgctgtccgggctgttgcgctgcgccgcaagggcagccagggcgatggccggggcggtgttacgcccggcgggttcaagaatgatgttctccgtcagcttgttgagctggcgcagctgttcggccacgataaagcggtgctgctcgttacagatcactaccgggctttcgcactgcacgccgttcagacgacacaccgtcgtctgcaacatcgtcagttcgcccttcaggcacagaaactgttttggatagagtacgcgggacagcggccacaggcggctgccggagccaccggccattactaccggatagagcgttggttgactcattgtttaatcccgaatatctgcaataaattggcttaacacgttctctttttcgagcgtgcgttcggcatattcacgtgccaccgtgttgaatttgggcatcagcagggcctggccgatgccgtcgatcagcgcgtccaccgattccggctccacgcagaccgcgatccccggacaggtgtcgcacagttgtcccagttcggtgtggcgctcggctgtgatcaccgcattgccccccaccgcaagaatattggtcagcttcgacggcagtaccgcgtcagcagcgccgcgcttctggatcaccagatgacaatccgccagcttcagcagcgcgggcagcgcgtcataggactgcaacggatgaaaaatcacgttgctcaggccgcgctcgcgggccattttttccagtcgcgctttgccgccgccctggccgacaatcacgaacagccacggctggtcgcgcagacgatctgcggcttcaatcacgctctccagcccctgcttttcgccaatgttgccggagtaaagaatgatttttttatccgccggcagggcgagttgctggcgaagcgttgatgcatcggcatcggtaacgtcgcgaaaacgcgccacttccgaccagttggggaagaaaatcacccgctcagccggtacgcctttttcctgcgctttattcatcatcgagcgcgaaatcgtcgatacgttatcgacgttgtgcaggccgctgcgctcaaaggcgctggcaagccgggccactcgcccgcccttacctttgccggccatgccgaggccaagcatggcatcgacttcgtaatcctgaatgtgcagtacggtacgggcgccggacagttttgccagcaggcgcatgcccggcgtacaaaacagcgtcggcaccacgccgataatgcgatccggcttccagcggcgctgcgccatcagcgggaaaaagctgctcagcgcaaagctgccgagatggatcaggcgctttaaggtggtcggggttttgggcacatatagaggacagcgccagacggtcgccgccccctcttcccgacgccagcgccaggccgagtaaggctcgcccactttccactccggatagtacggcggcgcggtaatgacgcgaacgtcatggccctgacgggccatccattccaccatctcgccggtgtacttaccgatcccggtcagctccggcgagtagttaattccgtacaccagaattctcataagcccggcactccggacttatcagtacggaaataggcgcggctgttgtcgtgcacgttctcgctgttcacgatggcgtcaggcgtcatccagcgccacgccccgtgctgctcggcgggcagcgtcagggtgctttcatccacacggacacggaaacccagcacgatgtagtgcgtggaaaaatcgcgtccggagaagttgtcgtcatagaagtgctgccagacgccgtaaaactcgcctgccgacatcggcagacgggttcccagttccgccagggtcaggcgctcgaaggcgctggccagcggctcatccttttgtacgcgtccgccagggacaaaccagtatccctgtgccggacggttggtgcgttctcccagcagaaactcaccgcgcgaattttccacgatgagatcgatggagatcagcggcgttgagcgcactaccgtggcgaagtcttcttgactcaaaaacatgcttacccccggaaccggtgctggttttcaaggaaccactgataggtgcttgccagcccctgctccagtgacacctcgtgataccagccaagctgatgcagacgcgtcacatcaagcagcttgcgcggagtaccgtcgggtttgctggcgtcgaacaccacgcggcctttaaagccggtgacctgcgcgagggtttgcgccagttcgcgaatggtgcagtccacgccggtgccgacgttaatatgcgacagcatcggttcggtgttttcctgccacacttccggatccagctccatcacgtgaatgctggcagccgccatatcatccacatgcaggaattcgcgcatcggcgtaccgctgccccataccaccacatccgtggcgttttcctgggccgcttcatggaagcgacgcagcagcgccgggatcacatgggagttgctcgggtggaagttatcgttcgggccgtacagattggtcggcatcaccgaacgataatcacgtccgtactggcggttgtaagattcacacagcttgataccggcaatcttggcaatcgcgtaaggctcgttagtcgcttcaagcgtgccctgcaacagctcgctttccgccatcggctgcttcgccattttcgggtagatgcaggatgagccgaggaacagcagcttattcacgttgtgcgtatgcgccgcgtgaatgatgttgctctcgatcatcaggttctcgaaaatgaactccgccgggtaggtattgttcgccacaataccgcccactttcgccgccgccagatacacctgatcgatggattcggtggcgaagaaatcatttaccgcacgggcatccagcagattgagttcatcacgggtacgcaggacgagctcaacgtccccgcgttgctcaagctgtcgtacgatggccgaacccaccattccacgatggccggccacaaagatacgttgtttgctcatgcttacgactccagcgcgatggcgacctcgaagccatgagctttcagcagcgagtgtttcttagccgcttccagatctttggctaccatttcagagaccatctcctgcagggtggtttccggtttccagcccagtttttcgtgcgctttggtcgggtcgcccagcagggtttccacttccgccggacggaagtaacgcgggtcaacagaaacaatcacatcccctggcttcacgcccggtgcatcgtgaccggttacggacaccacaatgcctttctcgtcaacgccttcgccttcaaagcgcagtttgataccgagctgagccgctgccatttctacgaactgacgcacggagtactgcacgccggtggcgataacgaaatcttccgggtgatcctgttgcagcatcatccactgcattttcacgtagtctttcgcatggccccagtcacgcagggagtccatgttgccgaggtacaggcaggattccaggccctgagcgatgttggcgatagcacgggtaattttacgggtcacgaaggtttcgccgcgacgcggggattcgtggttgaacaggatgccgttacaggcatacatgccataggattcgcggtagttaacggtgatccagtaagcgtacagtttggcaacggcatacggagaacgcggatagaacggcgtggtctctttctgcgggatttcctgcaccagaccatagagttcagaggtggatgcctgatagaaacgggttttcttttccaggccgaggaagcggatcgcttccagcagacgcagggtacccatggcatcaacgtcggcggtgtattccggcgattcaaaagaaaccgcaacgtggctcatcgcgcccaggttgtacacttcatccggctgcacttcctgaagaatacgcgtcaggttggagctgtcggtcagatcgccatagtgcaggtggaatttcgggttgctggtatgcggatcctgatagatatggtccacacgctcggtgttaaaagaggaagcacgacgtttgatgccgtgaacttcataacccttctccagcagcagttccgccagataagaaccatcctgtccggttacgccggtgatgagagcgactttactcataatttattttcctcaaaaagtgccgtttcgacgcgtttgcgcgtcaccactgcgggattaccccggcaaatcacattcgccggaagcgtcttaaaaacactgctacgggcaccaacgacggtgccatcgccgatttttacgccgggggcgacgaaaacatccgttgccagccagcatttatcgccaattactatcggggcggcattaatatcgaaatgcgcgctctgataatcgtgactaccggtacataaataacacttttgtgacaccacagaattcgagccgatggtgatgtcgcccagcgtatataacaccgcgtcatcacccacccagctataatcaccgagcgttaatttccatgggtacgtaattttcaccgacgggcggatcaccacgcctttaccaatttttgcgccaaaaagacgcaataaaaatgcgcgccagcggtacataacctgtggggaccaggcaaataatgttgcctgtactgcccaccagagctgaactttgagcgcactggccccgcggaagccggcgggtaccgtgaatccgtttaattcctgcatcgtatttccttatattcaggctttgttatataaggcttttgttttaccggttgtgcgtttgcgcagcaggtaagaaagctctgcccagaatgccggcacgcgtaatattttgcgctgcacatttttagcatcctggcataattccagattattcgaggttgacacgccacccatcgaaaattcagaaaccagtcctttcaggcgcttaaaggcatagcctgctttaaacatgcgggcggcaagcgcgtaatcggaagagactttatattgtaaatcgtaggggtaggttttcagaccgcttaccgggaagaatatggcctgatggctggccggtaagctgtggtagatataccatccatgtttcgcactgcggcgaatttttttcccgtcaccaaaatcgagtaatgcatcgccaatatacatggcgctttccggggcgttctccagctggcgcacgacatccgcggcgtcagcatggaaaatatcgccagaattcaggaataatgcgaagcgcccttctgccatcgcaatgcctttattcatggcatcgtagatgcctttatctttttcgctgatataacgtaagttgtactgtccgttgaggttttccaggaattctgcggtgccgtcctgggagccgccgtccaccacgatccattcgaaggtgatgtcctgtgcctgtgccagatgcgccagggacgcataagttttcgccacgccgtcataattccgaaacgcgaccgtaatgacacttagaagcatgtgaaccacctcatcttgaatgcgtaatattcagcgctttgcgcaaaataaaagggcagacgattaaaaaagcatattcgggactaaaaatcgaaccggtaaaaaacaatgacaccggggtaaaaagaaagagttgaacgcgataattctgattattaccaaacgcgttgatcatcatttttaccactttcgacatgtaccatatcgtcagtaacactgcgaaccatgagaaataaatgattagcagatacaacccattgtctattgtttttccgacgtccgcaccgttaaagattccgaatgatgcaacatattcgtaaagtgaaccgaagcgcaccacgccgtcgatattggttaatgaataacccaccatcgccagcggcccgatgatacggtaataagaagacgatccttccgtacctaaatcacccaggcgttccgaaatataaggaaaagcgaataccacaccgacgagaaagactgcgagcgaaattatcgctaaaggcagctttttcttaatcgcctctttattcagatactggaatgcccattccagcaggtaaaaaaggataaatgtcattactccagagaaggaaccggagaggactatccctgccagaatcatagcatcggtcttgggcgttttgataccaaactgtttgatgctgagccaaattgagattaatgccagagcaaaaaatgcgggttcgaaatacatggcagtggttcgcttaccaccaaacttaatgaaattcagaacatagctgttactgtaaatcagatatttcgaaatattctccatcaggctactgccgccggtaagaataatctgcgccatttcggcggcggcgagtattaccacaaaacccaccaccagccagaagaaacgtaaaatcttgcgatagttgtgcggcgaaatggttttaaaacgaatactccataccatgccgatgatgatcaccaggtagacaaacagcagcgtcgaggtgacatactttccggcattcagcgactgaccgaagatgtagttaaagatcgtcaggcccgcgccgatgcccagcgctatcatcagctttttcacgctgatcttatcgacgtacagcagcagcagtaccggcaaaaaggtcactatggttatcgggaagctctcacctatctgggcgatcttcacgttcaccagcagatagatgagcggcagcagcagataactacagactctgatagaacgagacatactcctccagcatctgttcgccactgtaggcctggcggctgcgggcgcggaacgcgtccagcgtggtgccaaacaccgcccgggcaatctccgctttcggacgctgcaccagggaaaccacctccgattcggcaaaagttttgccgccggatttatgcagcacttcctgcgccgcgtcgctatgtgtcgcaattaccggtacgccgatagacaatgcttcgcagaggatcagcggatagttatccacccgcgaactgaacaccagcgcgtccatttgattcagctcgctcatcagctggcgcttatcggtcataaacccatggttcactacgttcgcgccctcaaaaggcgaaaacttgccgaaggtgtgcagctcgattttgtcgccgagcgccatcatatcgcgcaccagccgctgattggttttgccgtcgtagcgtaagtcgtgcgccacaatggcgattttcggtacgcctgcggtttcgctcaccggggtcagttccgcaaggatcgcttcggtcgccacatcaataccattgttgataatgcggcagcgcccttgtccataaatactgttaaaggcatcggcgacgtgctggcttggggagataaaggtacagcccagtgccagcatggctttaaacagctggcgtttgccttccaccagctgatgcgcgcggtcgattttcaccggcggatagttgctcagcgtcgggcatttctggcagttggttttccagccttcgcagccgtcggtaaaggcgcagcgaccggttacgctccagtgatcgtgcagcgtccagacaaaggtgacgtccggcttgtgggctttcactttctggcagaaggccaccagatcgttaagcttcagccagtagctgtgcatgacatgaaagtgcagcaccaccgggcccggcgtacgggtgacggtgcggtacaaattattcaggttgccaaaaacatcgcggttaaacagacgaaacagcgccagattggccatcgacgtcagacgcggcgtctgtttgatcacctgcggatagtggtcgtggctgacgctttttttgccgcccttgccatagccgtacacaaaacgggaaggcagtcctttttgcagcgcgcgctggtgtaaatccagcgccacgcccgctgcgccgccctcggcgagacgcacattaaattgcagaatgttcatttaattaccttcacgcgcgctttctcacccaccaccagcgcgttatccggcacgctgtccagcaccacgctgcccgcgccgatggtcacgttattgccgatagtaatatcgccgatcatcaccacgttggcgcccagttccacgccattgccaatcaccgggcaggccaggctgtccgcgccgcggttgccgatggtgacgccgtgacggatagtgaaatcatcacccgccacgacgtttttattgatcaccaccgcatagccatgatgaatagtgaaacgtcgcccgatggtggctgccgcctgaatttcgtaaccgaacaggcattcggtaataaagcggtacagcaccagcaccggggcggcccagatattgttaagcacatgttttttacgccacaccgagcaaaaatgcgcgatgcggtaggccattaccatgcagcacggacgcaggctccagtggttggcacgaaaatcttccagtcgcattatttcccccgcagcccgtcagcaaggcgtttgccgttacgcacggaaagcagcgttaacaacgtgcgccagttcatgcgcttgttgcggatctggtagagcgtgaacagctgatactttttgctggcccggtcaaacttgtctttgtgcttgcggtagaaatgaaaataccctgagaactttttcggcgatgcagtgatctgcatctcgccgtgattcacgtgcaggatctgcgtggcttcttccactttccacggctcgccatactccaccaccatgcgcaggaaaatgtcgtaatcctgagcggctttcagttcggtatcgaacaggcactctttgaaacgccaggcaaaggtaaacacctgattgccgatgatattgcgtttgtagaacagcgtgcgggagtacggggatttcgggtacagcggcaggctggcaggctgggcatagacttcgccttcgcagatataatcgttggcatataaaaatgcgtgcgtcaccagctgctgtttatgggccaggaagaccgacaggcggttcggcgtccattcgtcatcatcgtcaatgccggtaataaattcgccgctggcctgtaaaatggcctgattacgtaccgcgcaggcaccggtattgatctcgttgtgggtatagcgcacgcgcggatcgttaagtccctcgacaaactgctgcagctgctcataagacgaagagcagtcatccacaatgatcatctcccagttgctgtagtcctggcgcaggaccgacttaatcgcccggatcgccagctgttgcctgttccaggttggcatgtaaattgagatcagcggattatctgttgtcattcttatttccccggatagtaccgactcatttgccggatggcggtgcgggcaccttatccggcctacatggaagcaggtcggataagcgcagcgccatcaggcacctttcggtgatttattttgaatcagacttgtactcgtactcgtagtagccgtagtcctgatagcctgtcgcgcggcggaagatggagttgaggatcacccctttcacctcgataccgttctgttgcagacggttcaggctggtttccacctctttaagcgtgttcaccgcgtaacgcgccaccatcagcgtggtgcccgcatggcggcccacgatggcggcgtcggtgaccgcgaggattggcggcgtatcgatcagcaccaggtcatagttcttgctcgcccaggccagcagctgggtgaagcgttcgctcatcagtagttctgacgggttcggcggcacctgcccacgcggcaccaggtcaaagttcggcaccgaggtcggtttggcgcaggcggcaatgtcgccagtgctggagagcacattcgacagaccgttcacgttgtccgtgccgagcagttcgtgggcgtaacctttacgcatatcacagtcaatcagcagcacgcgcttgttggtctggctgaccaccgccgcaaggttggcgcagacaaaggttttaccgatggacggactgaccccggtcatcatcagcacattattgttggcctgcatcatggcgaagtgcagactggtacgcagactacgaatagcttcgatagcgagatcggtcgggttacccaccgccagcagctggctctgcttgtaacgcttagcccctttgacggttttgacgtggtcgcgggatttctgccattcggacagcggaatgctggcgtagacgttgatgccatgctcttccagcacctgcgggctttcgataccgcgattaaacagcgagcgcagcagcacgccgacaatcgacagcatcaggccgaggataatgctgcccagaatgatcagcgctttcttcggtttcagcacgccaggctgggtgatcgccgggtcaacgatacgcacatcgccgacggtactggcttcggtgatcttcagctcctgctgtttgttgagcagcgccatgtacacctgctggccggattccacatcgcgggtcagacgcacaatttcctgctgggttttcggcatcgcggtaacgcggccgttcagcttggctttttcatcttccagcgctttacgtttttccagcagcgtgcggtaggccgggtgcgctttggtataaagcttggaaatttccgcttctttaaaggtcagctcgttcagctgggcgtcgatattgaccatcgaatccagcaccgctttcgcttccagcggtaaatccacggagtctttatcctggcggaaggcgttcagtttgttttccgcttcatccagattacggcgcacttccggcagctgtttggcgaggaaggcgaggcttttggccgcttcttccgatttacgcgccacgttctgctcaagatagttgcgggtaatgctgttgaggatggcacggatctgctcgcgatcttcaccggtaaaggacaggctcagcacgccggtgtctttaccgttttcggtgacggtcaggttgttttgcagattgttgatcatgccgagggtggaaaacttagtaatggtgaactcgctgtcggtagaggagtggatctcgctcacctcaagcgtgacgccatctttttccagcagcttacccacttcacctctggcgctgaaacccgcgtcgctggtcaactggtactgcgtcgggctgagcacgcgcagcgtgaaaacctgctcccctgcccctttcggaatagtaaaggtcgtcaccttcaccgtttcgttctggcgacccatcagccgttcccagccagccccgatgatcggcatggtgtttttggtgacggcaatatctaaatcgagatcgtcaacggtttttcccagcaccagacgggatttgatcagctgaatttccgcgtcagacgcagggggcttgttcgacagcgcgctgttaatgttctgtaccagcgagttgccggtatcctgctcgatctggaccagcgcatcggcgctgtagatcggcgtggcgaacagggtatagatcaccgccgccaccgcaaaggctgcggtaaccccgagcacccaccagcgggcttcaatcaccgtcccaataaggcggccgatgtcgatttcatcgctgcctgtctgggaggcggcagaatgctgtagtttttctgtcattgttatccctgctgaacgttcaatgcctgcgcccactggcgggcagacctttcgagtaaggtgtaaacggcctcaaaagcttcacggcttttacggtatggatcgggaatttcccgctcattatcccagtgaccaaacagcatcactttgccgcgcatttccggtgcgatttcacacagcgaggcaatgtgacgcttttccatcaccaggatcagatcgtattcgcggcacatgcgcgcggtgatctggcgggcgctgtggcccgcaagcgagatgtcatgctgttccgccacgctggttgccgtggcgtcagcccctttccccaccagcgcgcccaatcctgccgattcaacggtcagggcgggattaaacgctttcagcaaccgttccgccgtcggggagcggcagatattgcctacgcaaaccacgagaattttattaaacatcgcttattcccagttccgtaagtcgctggccgtgtcggtcatgtagcgaacgccactgatggtcggcaacagctggttgatcagacggttccagcgggcaaccggtgcggttgtaacgtagaccacgtcgtacggctggaggcggaattccgtcgccattaccagagaggtggcgtcagacatatcaagctggtaaatgttggcgatcttgccgccgcgtccaccctcgcctttcagcggacggatcacgaagataccgctggcgttggaggtgttcagatccagaccttctgcctgaccaagcgcttcggtcagcgtcatgccgctgaagtccattttgagcgtgctctgttttttcacttcgcccatcacgaacactttcagatcgtcattgcgcggcacaaagagaatgtcgcccggataaagcaggcggttctggctcaaatcgccgttttgcatcagcgcctgcaaagagatgcgttgttcgcggccttcgtgggtcaacacgacgttgcgccagtcggcgttatcggtcagcccgccggcggcgttaatggcgtccagcaccgtcagcggcacgttagtgatcgcctgctgaccggatttattcacctgcccggagatataggctttttgcgagcggaagccagcgatattaacgtccacctgcgggtcagcaatgtactgcgctaaacggctggtaatatcactacggatttctgccagggttttgcccaccacgtggactttaccgatatagggatagaacatggtgccgtccggctgtacccagttaccggcttcgctggaactacgatactggcctgctggcgtcgtcagttccgggtgatcccagacggtcacgttcaggacatcgccaggaccgacacggtactgataactggcgatttcctgatccagcgacatattgggttgggcgacatttggacggggacgtaactgctcgaccagtcggggggtcaaaggataaacattcaccatgcggtcaagatcgaagtcagcatcttgctgcttaatgacatcctttcccatggttgacatattgctgccgggaaaaaccgtgcaaccactcatcaaggtcacagacaccaataatggcatcaatttcattttggatttcatcattgattatttatcactttggcagagtaattatcctgtgcggtataaataagcgcgtagcctgttcacattcagcatgcagttaattgccgctaaatataactggcatcagtcctaaaaatcgcttattcaaacgcggtttgttgacagaataatcggagctgattcacacgcttccgggcacgctaccgcccctggcttccagttaccaattcactgataaaacagtaagttattgattacagcctgactctttacattatttacaggaaataatgtaaacctcggcagtggctgtcagaaaaagaagaacataacccatcatgacgttagaaatatgacatacaaaagaacgccatgatgcgctggaggaattgttgcagctaacggaataccaggcaaggtaacttgtccggggtaaggtctttttaagattaatattaacctcaaaaatatcggcttttaggagtttcttcatattgacaaaatttatatatagatttacgcgtacgataattcctaatttacagtataaaaaagcccataatatataagcgcattacagtcatgaggagcgcgaaatatcacttaaacctatggtgcgattattcggataaatcgcagaggaatattgcattttgggcgcaatgtacccatgatcaaaacgtgacaatcgtcatattacacaaggtacgacatttactatggaatggattgccgatccctctatctgggcgggactgtttaccctgatcgttatcgagctggtgctcggcattgataacctggtctttattgccatactcgcggaaaaacttccgcctgcgcagcgcgaccgcgcgcgcgtcacgggcctcatcctggcgatgctgatgcgtctggttctgctggcctcaatttcctggctggtgaccctcaccaccccgctgttcagcgtgcgcagcctgagcttcagcgcccgcgatctgatcatgctgtttggcggtttcttcctgctgtttaaagccacggtggaactgaacgagcggctggaggggaaagacagcgataacccgacgcagcggcgcggggcaaaattctgggcggtggtgacgcaaatcgttattcttgacgccgtcttctcgctggattccgtgatcaccgccgtcggtatggtggagcatctggcggtaatgatggcggcggtgatcatcgccatttccctgatgctgctggcgagcaaagccctgacccgctttgtgaataatcacccgactatcgtcatcctctgcctcagcttcctgctgatgataggctttagcctcatcgccgaaggctttggctaccacatcccgaaagggtatctgtatgccgccatcggcttctcggtgatgatcgaagcgcttaatcagctggcgattttcaaccgccgccgcttcctgttcgctgacaataccctgcgtcagcgcaccaccgaggcggtgatgcgcctgctcagcggccgcaaagaagatgccgagctggatgttgaaaccgcctccatgctggccgaccatgataatgcgcagatctttaaaccgcaggagcggctgatgatcgagcgtgtgctcaacctgaaccagcgcaccgtcagcagtatcatgacctcccgccatgacatcgaacatatcgatctcaccgcgccggaagaggtgatccgcgagctgctggacaagaaccagcatacccgcgtggtggtcaccggcggcgatgcgcaggaagatctgctgggcgtggtgcatatacttgatctgctgcaacaggcgctgcgcggtgagccgctgaacctgaacgtgctggtgcgtcagccgctggtgttcccggaagggttgccgctgttacaggcgctggagcagttccgcaacgcccgcacgcactttgcctttgtggtggatgaatttggttccgtggaaggggcggtcacgctcagcgacgtgatggaaaccatcgccggtaatctgccgaacgaagtggaagagatcgacgcccgccacgatattcagaaaaacgccgacggcagctggacggcgaacggccatatgccgctggaagatctggtgcagtttgtgccgctgccgctggacgagaagcgcgaatatcacactatcgccgggctgctgatggagtatctgcaacgtattccgcaggtcggggaggaagttgaggtgggcgattatcgggtgatcactttgcaggtggaaagccatcgcgtacagaaagtgcagatcgtgccgttacgcacaaaaagcgagctggattacgaagtctgatcccgtttctgccctctccctgccggagagggctaatcactgggccgttacatcttttccagcagcttcttcacatcttcgctgtatttactgtccttattgcgatccgcccacttgttaaggcggcgcttcgcctcgccctgtaaatggtcgcgcagcacctgatcgactttcaggctgtattgcagcgcatcccatttgccgtatacccgcagcgggatcggcgtctcgcgcaggaaggcgatcagctcgctgttgccaccgttccagccggagagtacgcgcacgttaaactgggtgtcgctctcttctttgatcagatccagggttcccttgccgtccagcgccagcagcggcgactgcccctgcatatcgctcagcgttacgctgccgtgatccagttccagatcggtgctcagcgcatccagacgggtgctgttgtcataatcctgctccaccttcacatcgctgctgcgcgccacggcctgctggatcagctgctggaagttaagcccttccatgcgtacattcgccatttccagatgcgcgttgccctgccagtcgcggcggaacgcctccgcatccaccagaccaccggaaaaatcaccgctcatggagagcgcgccggtcagggcaataggataattaaaggctttcaggatggtgccgatctccacgttctcaagctttggctggaacaggcttttcggcgttctgccccgcacgtcgagacggccgggcagcgaaagcgtaccgttgcccattttgccctctaaggtggtgagggttaacagtcccgcctggttggtcatttggcttttgacgtcggtgaaatccatcccgcgccagcggatctgcccggcgctgagcgcaacctgagcgctgaacccgcgcagactgttgtactccggctcgctgctgtcgcgggcgatcaccggacgcggcaacagcttaggctgcgcctgggctttctgcgccgtatcgctgctggcggcggccatagtcgcgccgctgaataagttttccagattaagcttgtcaaaatgcaaatcgagcgcccagtccggggcgtcgttaagcaccacgctgccctgcccgctcatggcgctgtcgttggcagtgacattaaggttgctgaaagacaggcgtttttgcgcctcctgccactgggcgtttagcgtcgccgtaccgctgatcccctgcggggacacatcaccgcccttcagctgccagtcgaactgctcaatggcggcggtcaggctgtgcgggtaatccgcggcgtcaatttttgctttcatcgccagcgtcagatcgcgctgatcgcggttgatacgcccggaaaaatcgagcgtggcgtggtaagacgcatcctgatccatcttcagacggatatcgcgcaccgttacctgctcttcgtcttcatgctggaacaccagcacgctgtcggcgacctcaaggcgggaaatggcgtaggaccagcctttatcggcttctgcctgcggcattggattatcatccggcgcaacaggctcgtctggtttgcgcgcggctttggtttgcggcgttaactggatcaccgcccctttcagcatcacctgtttaacgtgcagctgatgcgaaagcagcggccagagttccacgtcaaggcgcatattcgccgccgacaccagcggcgtggtggcccccggcgcggtcaacgacatgcgcccggagagaatgctgagctgcggccagacatgccagcgcagcggctcgtccagctccagctgatagccgcttcgcgcctccacctgttgcaccatataggcacggaaatcgttggggttgaccagcagtaccaacgcagagatgccggcaacaagcacgacaagcagaatcatcagcgtggttaacactcttctcatggcatcctcagcgagcggttaatactcaatctttatcaatacggctggcgaccgcgccctgctggtcacgatatttcgcgtcctggcgacggttgtaaggacgggctgccgggccggagagcggttcaaagctcagcgcgccgataagcatccccggacgcagcgccagcggcagtttgccagaattatagaactccagcacgatacagcctgaccagccgggatcgatacggtgcgcggtaacgtgcaccatcaggcccagacgcgccagcgatgagcgaccgtccagccagcccaccagatcggcaggcagggtcacggattcataggtgaccgccagcgccagttcgcccggatgcaggaaaaaggcatcgccgtccggcagaacgatttcatcgctcatcacgcgctcaagagaggcggcgacttcatccttcggaccgctgagatcgataaaggccgcagtatgaccgcggaaggtgcggaatttattccccagacggacatcgacggtggcaccattgatgcgttcaacgggtggacgcggggtaatagacagacggccttcatccagccaggcttcaatatctcggtcacacaaacgcatgcgttttctccttagatacagcatcccccggcaagtgttctcgccggaggttaagcatactactttgaacggtacacaattcgcgcagattattcaaaagcagactattcaaagaactggctgattttggctttcagaatgtcgatcgcaattcggtttttgccgccgcgcggcacaatgatatcggcgtactgtttggacggctcgataaactgcaggaacatcgggcgcaccgttttctggtactgcgccatcacggaatccatagagcggccgcgctcgttcacgtcacgcttaatacggcgcatcaggcagatgtccagcggggtatcaacgaaaatagagaaattcagcgcgtcgcgcagacgggcgtcggtcagcaacaggatgccttcaaggataatgactttcttcggctgaatatgaatggtttcctgcgtgcgggtatgttctacataactgtagaccggcaattcaatggggctgccgttttttaaggtttgcaggtgctcgaacagcaagctgtgatccatcgcgctcggatggtcataattggtctttacccgttcttccatggacagatgactttgatctttgtaatagctgtcttccgggatgacgccaatatgctcatcaccaacctgttcgcgcagctcgcgatagagggtgctggcgatgagacttttacctgaagcggatgcaccggcaatgccgataatgacgcactgatgagacttatcagtcataaatttttgcgacctggttaacctggatgttaaggaaggacgacgccgaaacgccaaacgcggcaattatagggatttcgccgccgtgataccagttgaataggtcatcgcgcaaatccggcggtcataaagaggaatatcgcctttacgcaaattaaaatgctcacttttgcggcgatgatcggggatttagcatcaggtaagtaattaataacactgtgatgtcaaattatgagcgcccacgataggaattgtaaattgtttgtactagcataatccaaatttcaaatttaactcgccccgtgaatgtatcgggcggctcagggtctgcggataaagcggtaatgaataaacaataccagcgcgttttggtggctaccccgaatcctttactgcgattaatcagtttaggactggtcacctttatctttaccctgttctcccttgagttagcccgcttcggcaacattcttgctccgctgtggttctccacgtccattatgatggtggcgttttatcgtcatgcaggccgcctgtggccggcgattgcgctggcctgttcgctgggcagcattggcgcgtcactggtgttattcccgcccgaggccatcaatctctggtaccccggtattaacgttattgaagcgctgatcggggccatactgctgcgtaaaatgctgccctggtacaacccgctgcaaaacttaaacgactggatccgtctgactatcggcagcgccgtgataccgccggtgattggcggcctgctggtgtctctgctggtcgggaacgacaacccgctgcgcgcctttacgctctggacgctctcggaatccattggcgcgatggcgctgatcccgctgggtctgctgttcaaaatgcattatctgctgcgccaccgtaagccgcagttgctgctggaaacgctgctgacgctggcggttacgctgatgctgagttggctgtcgataaaatatctgccgtggccctttaccgcggtgatcgtgctgctgatgtggagcgcggtacgcctgccgcggcttgaagcctttctgatatttctctccaccgtgatgatggtgtcgctgatgatggcagcggatccctttgcactgacgccgcacaatacgcccgtcatgctcaacgcgccctggctgccctttatgatgatgctgctgccggccaacgtcatgaccatggtgatgtatgcttttcgcacagaacgcaaacacatcaccgagagtgaagcgcgctttcgtaacgccatggaatattccgccatcggcatggcgctggtgggcaccgaaggcgaatggcttcaagctaacaaagcgctgtgtaaattccttggctatacccaggaagagctgcgcgccctcacttttcaacagctgacctggccggaagatctcaacagcgatcttgaacagctggagatgctggtgcgcggcgagatcaacagctattccatggaaaagcgttactacacgcgcaatggcgacgttgtctgggcgctgctggcggtatcgctggtgcggcacggtgacggcaccccgctctatttcatctcgcaaatcgaagacatcaacgatctcaaacagacggaatgggttaacaaacgcctgatggagcgtattaccctcgccaacgaagcggggggcatcggcatctgggagtgggaactggcgacggacatcatcagctgggacaaacggatgtttgagctgtatgagatcccgccgcacgttaaaccgacctggcagctgtggtatgactgcgtgataccggaagaccgcgcgatgaccgagcaggtggtgcgcgattcgctggtgtcgcgcctgccgtttaagctggaattccgcgtgcacgtgaaagagggcgtgcgtcatatccgaaccctcgccaaccgggtgctgaacaaaaatggcgaagtggaacgcctgctcggcatcaatatggacatgaccgaggtgaagcagcttaacgaggcgctgttccaggagaaagagcgtctgcatattacgctggactccatcggcgaagcggtgctctgtaccgatgtgaatatgaacatcacctttatgaacccggtggcggaaaaaatgagcggctggccgcaggagcaggcgatgggccaggcgctgctcaatgtcctgcacattaccttcggcgataacggcccgctgatggaaaacattcacagcggcgatatgtcccgctccgccattgaacaggatgtcgtgctgcactgtcgcaacggcggcagctacgatattcactacagcgtgacgccgctcagcaccctggacgggcaaaacatcggctttgtgctggttattcaggacgtgaccgaatcgcgcaaaatgttgcgccagctcagctacagcgcctcccacgacgccctcacccatctggccaaccgcgtcagctttgaaaatcatcttaaacgcctgttgcagggcgtgcaggaaacccaacagcggcatgcgctggtgtatatcgatctcgatcgctttaaagcggtgaacgactccgccgggcatgcggcgggggatgcgctgctgcgggaaatttcatcgctgatgctcagcatgctgcgcaccaccgatattctggcgcggctgggcggcgatgagtttggcctgctgctgccggactgcaatatcgaaagcgcccgctatatttcggggcggttgattgccgcgatcaacgattaccagtttatgtgggaaggccgtctgcaccgcatcggggccagcgcgggcattacgcttattgacgaaaccaactatctggcgtcagaagtgatgtcgcaggcggatatcgcctgttatgcctcgaaaaacggcggacgcggcatggtcaccgtctatgagccggagcaggacgacatgcatgaaattcgtctgcagatgtccgcggaagagcagtcgcggatgatcaatgacaatccgctgctgctgattgcccgcggcgtggcctcgcctcgtgtaccggaaacctgcaatttctggctgctgtcgctgcgcctgtggaccagcaacggcgacatcatggaagagcacgcttttcgcgcctccctgagcgatcgcaaacttattcgcgcccttgaccgccgcgtgttccaggaatttttccgcaacagcgccgcagccgtcacccgtaaaggcttaggggttgccctgccgctctccaccaccggtcttgccagcaaaaccctggtcagcgaactgctggacagcctggcgcagagccagatgcctgcccgcctgctgcatctggtgatccatgcggatgcgctgatgcgcgacgacgccagcatcaacgacgggttgcacaaactgcgcgaagcgggctgccaggtgatcttaagccacgtgggccgtgacctggagctgttcagccatctcaccccgtacgttgcggattacattctgctcgaccaggaattgatcggtaacgtacacggcaacctgatggatgaaatgatggtcactattgtgcagggccacgcccagcgtctgggcatgaaaagcatcgccgggccaacgcaccagccgatggtgatggacaccctctccggcatcggcatcgattacatctacggcgataccatctctccgccgcagccgctggatttgatgctaaacaccagctatttcgccatcaactgacggctgccagccgtcggtataccagatatgcagcagcgcgtaagagcgccacggctgccagcgggcggcgtagtgacggatttgcgcgggcgtcatgccgctaaaacgctgcttgatcagataatcgtccgccagaaagacatcttttgcctgccagccgcgcagggccagataattggccgtccagcgcccgatgcccggaaaggtctgtaaatgcttcaccccctgttccacatccgccggggcgatgaggggaaagcgcccgtcaagggttgcccgggcaaaatgcacaatggcctccccgcgttttaacggcatgcccagcgtttttaactctgccggatcggcattcaccagcacttccgggcgcggaaaacagacaaaacctggttcgccgttcagcggctcgccgtaacggtttgcgacatagccggtgagctttgccgccatcgccacgctcaccagctggcctaaaatcgcgcggatcccctgctcgaaggcatccatcgatcccggcagccgcagccccggacgcgccgcgcccaaatcgcccagcgcgccattaatcatctgcggatcgcaggccagatcgaacagccgcccgacgcgcgccagacattcatccgccaccggcagcaggccatcgctgagcgtcacccgcagggtatgttcctgctcatccggttcggcggtgataagtccatggtgcccgccgagcgccaggctacgcacatagcgcccctcgctgacgacttccaccccgcttacggcacgggcgcgaagaaagcccagcatccacgcccagtcataaggcggttgccagtgaagtgtgtacatagcctctcctgctgtaattaactttcttataacagactaaccgcccccggcactttttgctttgctttcaaatcccattccgctaaagtcgccccccttctgcaccggcccggggaattcaacatgtttattggttttgactatggcaccgccaactgctctgtggcagtaatgcgtgacggctcgccgcagctgttaaaaatggaaaacaatagctcgctgctgccctccatgctgtgcgccccgacgcgcgaagcggtcagcgaatggctgcaccgtcatcatgccgttccggcgacagagggagaaacccaggcgttgctgcgccgggcgatgaattacaaccgcgacgaagatatcgaggtgctgccgggcagcgtgcagttcggcctcagttccctgcatcagtatgtgcaggatccggaggaggtctattttgttaaatcgcccaaatccttcctcggcgccagcggcctgaagccgcagcagatcgcgctgtttgaagatctggtgtgcgccatgatgctgcacatccgtctccaggcgcagacgcagctgccggagccgattgaccaggcggtgattggccgtccgatcaacttccagggtctcggcggggatgaggctaacgcccaggcgcaggggatacttgcgcgcgcggcaaaacgcgccggattccgcgatgtggtgttccagtatgagccggtagcagcgggtctggactttgaagcgacgctcagcggcgaaaaacgcgtgctggtggtggatattggcggcggtaccaccgactgctcgctgctgctgatggggccgcagtggcatcaccgcagcgaccgcgactccagtctcctcgggcacagcggctgccgcgtcggcggtaacgatctggacatcgcgctggcgtttaaaaacctgatgccgctgctcggcatgggcggccagaccgaaaaaggcattgcgctgccgatcctgccgtggtggaacgctgtggcaattaacgatgttccggcacaaagcgatttctacagcaccgccaatggtcgcctgttaaacgatctggtgcgcgatgcccgcgatggcgataaagtggcgctgctgaccaaagtctggcgtcagcgcctgagctaccggctggtacgcagtgccgaagagagcaaaatcgcgctttcggagacagatgaggtcacggcgcgtctgccgtttatcagcgacgatctggcgaccgccattacccgcgacggcctggaagcggcactcagccagccgctggcgcgtattctggaacaggtgcagctggcgctggacagcagcaatgaaacgccggatgtaatttacctcaccggcggcagcgcccgttcgccgctcatcaaacgcgcgctggcggaaaaactgccgggcattccgattgccggcggcgatgatttcggctcggttaccgccggactggcgcgctgggcgcaggtacagtttggatcaacaaggaaataacgctatgccacggtttcatctgatcgtcatgccattaattattgcgctgggcctgtgcggttttgcccgcgccgacacgctttctgccgtcaaacaggcggaaaccacgctcgcggcgcgtgtgggctatgcggagctggatctggcttccggtaaggtgctgaacagctatcgtcaggatgagcgttttccgatgatgagcacctttaaggtgctgctgtgcggcgcggtgctggcgcgcgttgacgccgggcaggagcagcttaatcgccgcctgacctggcagaaagcggatctcatcacttactcgccggtaacggaaaagcacctggcggacggcatgacggtggcggagctgtgcgatgccgccatcaccctgagcgataacacggcggccaatctgctgctctccacgctgggcggcccgcaaaagctgacagatttcatccgcaaaaccggcgatgggacgacgcgtcttgatcgcgtggagccggaactgaacgaagccctgccgggggacgtgcgtgataccaccaccccgacggcgatggcgaaaaccctgcgtcagctgttaacgggcgataccctgacggcggcttcacggcagcagttagcgcgctggatggaagaggataaggtcgccgggccgctgctgcgctcggtcctgcctgcgggctggtatatcgccgataaaaccggggccggtgagcggggatcgcgtggcattgttgcagccctggggccggacggcacgccgtcgcgcattgtggtgatttatgtgacgggcagcaaggccaccatggatgaacgtaataaagccatcgcggcgattggcgaggcggtgattaagcagtggtgatatgcccattgcccggcggcgctacgcttgccgggcctggaacggcaaattacccaggccgggtaagcgacagcgccacccggcacaaacccactcaggatccaatcactccgccgtccgctttggtgatcaccaccgttgacgagcgcgggcgcccatccggccggttatccggccagttcgacaccgcgcgcggattcgccggatcggtaacatcatctccgccttctcccggatgctgaatattaataaacagcgtgcggttgtccggcgtaaaagcgatgccggtgatctcacagccgcgcggcccggtcaggaaacggcgataatcattggtgccgggaatggtcgccagcatctggttattgcccatcccctcgtaagctttctggttgatggtgctggaggagacgtccgtctggatccacagcacgccctgatggtcgaatgacaggccgtccgggctgccgaaggccgcgccctgcatattgcctttcgcgtccggcttatcgccatcgttacgcccggcgagcaccagaatatcccatttaaagcgcgccgctgccggatcggcgttatcttcgctccagtgcataatatgtccatacacgttattggcgcgcgggttcgccgcatccaccggcgctttgccctctttgccgcgatcgctgttattggtgagcgtgcaataaacgctgccggcagcgtgaggatcgacggcgatccactccgggcgatccattttcgtcgcgcccaccgcgtccgccgccagacgggttttgatcagcacatcgccctggctttcaaagcccttgctttgatccagcccgttctgtccgaagaccagcggcagccagtcgccggtgccatcttcattaaagcgcgcgacatagagcgtgcctgactccagcaattgcatgctggcgtcacggttgcccgcatcatattttttatccgagacaaatttatagatgtactcgaacttctgatcgtcgcccatatagaccacgacgcgtttgtccgccgccagcgtcaccgctgcgccttcgtgcttgaagcgccccagcgcggtgtgtttgcgcggcgtggaggtcggattgtacgggtcgatttcaaccacccagccaaagcggttcggttcgtttggggttttatcgacgttaaagcgttcgtccacttcgctccagcggtaggactcgtcgctgtcggcgatgccataacgtttttccagcgcgttgcggtcggcttgtttaacaaaaatatctgaccagttttcttcacaggtgagataggtgccccagggcgtatggccgttggcgcagttctgcatggtgccgagcacgcgctcgccctgcggatcggcggcggttttcatcagcatgtgatgacgcgccgggccggacagctccatcggcgtattaacggtgatacggcgggcatagtttgacgggcgcaccacctgccagtcgctgccgctctttttcacctcgatcaccgacacgcccatggcgttctgccctttacggactttatcggcgttccagtctgcggtgccgtctttaaacagcatgccgttatcgatgtattcgtggttcatcgccagcaggccgtgggcggcattatcttcaccgcgcggcaggctgaaccaggccatgccgtcatggtgcatacccgcctgcgccgcctgttcttcagtggtgttgctggcgtcgaatttgaattccggcatcatgcctttgatgccggtggcgtcgccccagcgatagaatggacgtgcgatgtagccttccggcaccgttacggtgtccgcagtggaaacaggaatgctggtaaagcccagcgacaccgctttcgccagcgccgtcggctgcgtcatggccgcaaaagcgctttccgcgcgcatcagcgccgggaaagacaccgccgcgcccgcgaccgcccccatctgcaaaaagcgacggcgtgacagaaagacgtccttgacgtccgaaaataccgggttggcgctggtgttgctgatctcttcactgtgttcttgtttgaagacggattttaatggcctgctcataatgacttcctgttaccagaggacgggaaaataacaatgctgagcagtctataaactatttattacatttttataacagtcgcaggcagagcgtccgccccttgtcattcggacaaatccacacagtgtttcatatttcctccatttttctgcggcctggcattactaaactagtatcattctgcttaatgtttcaggaagagatacgaataacgatgaaaggccgtaataatacccgctggatgcttctcgcaggactggtcatcgccgcccttgccgctgcctggtactggcacgctcattctgccgcccccgccggacagcagcgccaggccggagccggacgtcacggcgcgggcatgcgcggcccttcacttgcgccggtacaggcggccaccgccacccgcgaggccgtgccccgttatctgagcggtcttggcaccattacggccgcgaataccgttaccgtgcgcagccgtgtcgacggtcaattgctggcagtgcatttccaggaaggccagcaggtgaaaaaaggcgatctgctcgccgaaatcgatcccagccagtttaaggtcgcccttgcccaggcccaggggcaactggcccgcgataaagcgacgctggcaaacgcccgccgcgatctggcccgctatcagcagctggtgaaaactaatctggtgtcccgtcaggagctggatgcccagcaggcgctggtcagcgaaagcgaaggcaccatcaaggccgatgaagccgccgtcgccagcgcgcagttacagctggactggagccgcatcaccgcgccgatagacggtcgcgttggcttaaaacaggtggatgtcggcaaccagatttccagcggtgataccaccggtattgtggtgatcacccagacgcaccccatcgatctgatcttcaccctgccggaaaacgacatcgccactattgtgaaagcgcgcaacgccgggcagacgctgagcgtcgaagcctgggaccgcaccaacaagcagaagctgagcaccggcaccctgttgagtctggataaccagatcgacgccaccaccggcaccatcaaacttaaagcccgctttgagaatcaggacgacgccctgttccccaaccagttcgtcaatgcgcgcatgctggtggataccgaacaggacgcggtggtgatcccggctgccgccctgcaaatgggtaacgagggcaatttcgtctgggtgctgaacgatcagaacaccgtcagcaaacacaccgtcacgccgggcattcaggacagccagaaagtggtgatcgccgccgggctttccgccggggatcgcgtggtcaccgacggtatcgaccgtctgaccgaaggggcgaaagtggaagtggtggacgcgcacgacgccagcgccgcaccggcaaaaagcaccgctaaaggagcgaaatcctgatgcaggtgttaccgcccagccgcaccggcggcccgtcccgtctgtttattttacgtccggtcgccaccacgctgttgatggtggcgattttactcgccgggatcatcggctatcggtttcttcccgtttccgccctgccggaggtggattacccgaccattcaggtcgtcaccctctaccccggcgccagtccggatgtgatgacctctgcggtgaccgcgccccttgagcgccagttcgggcagatgtccggcttaaaacagatgtcgtcgcaaagctccggcggcgcgtcggtggtgacgttacagttccagctttcgctgccgctggacgtcgccgagcaggaggtgcaggccgcgatcaacgccgccactaacctgctgccgtcggacctgccgaacccgccggtctataacaaagtgaaccctgcggatccgccgatcatgacgctggccgtaacctccagcgccatgccgatgacgcaggtggaagacatggtggaaacccgtgtcgcgcagaaaatttcccaggtggcaggcgtcggtctggtgaccttatccggcgggcagcgtcctgcggtgcgggtaaaacttaacgcccaggccattgcttccctcggcctgaccagcgaaaccattcgcaccgccatcaccagcgctaacgttaactccgccaaaggcagcctcgacggcccgacgcgggcagtgacgctgtcagccaacgaccagatgcagtccgccgaagagtaccgtaagctgattgtcgcgtaccagaacggtgcgccgatccgcctgggtgacgtcgccaccatcgaacagggagcggaaaaccgctggctgggcgcatgggccaacaaagagcaggcgattgtcatgaacgtgcaacgccagccgggggccaatattcttgataccgccgacagcatccgtgccatgctgccgcagttaaccgccagcctgccgaaatccgttgaggtaaaagtcctttccgatcgcaccaccaatattcgcgcctcggtgtctgacacccagtttgagctgatgctggccatcgcgctggtggtgatgatcatctatctgtttttgcgtaacgtcccggcgaccattattcccggcgtcgcggtgccgctgtcattaatcggcacttttgcggtaatggtgttcctcgatttttccatcaataacctgacgctgatggcgctgaccatcgccaccggctttgtggtggatgacgccattgtggtgatcgaaaacatctcccgctatatcgaaaaaggcgaaaagccgctggcggcggcgctgaaaggcgcgggggagatcggctttaccatcatctccttaaccctgtcgctgattgcggtgctgatcccgctgctgtttatgggggacatcgtcgggcggctgttccgcgagtttgccgtcaccctggcggtggcgattctgatttccgccgtggtgtcgctgacgctgacgccgatgatgtgcgcgcgcatgttgagcgccgaatcgctgcgcaagcagaaccgcttctcccgcgcatcggagcgcttttttgaacgggtgatcgccgcttacgggcgcgggctggcgaaagtgctcaaccatccgtggctgacgctgggcgtgaccttcgccaccctgctgctgtcggtgttgctgtgggtgatgatcccgaaaggcttcttcccggtgcaggataatggcattattcagggcaccttacaggcgccgcagtcggcgtcctttgccagcatggccgaacgccagcgccaggtgagcgatattgtgttgaaggatccggcggtggaaagcctgacggcctttgtcggcgttgacggcactaacccgtcgctgaacagttcacgcctgcaaatcaaccttaaaccgctggacgatcgcgacgaccgcgtgccggaggtgatcgagcggctgcaaaacgcggtggcaaaagtgcccggcgtggcgctctacctgcaaccgacccaggatctgactatcgacaccaccgtcagccgcacgcagtatcagtttacgttgcaggcaacgtcgctggaggcgctcagcacctgggtgccgcagctgatgagcaagctgcaaacgcagccgcagctggcggatgtgagcagcgactggcaggacaaaggccttgcggcttatatcaacgtcgatcgcgacagcgccagccgcctgggcatcagcatggcggatgtggataacgccctgtataacgccttcgggcagcggctgatctccaccatctacacccaggcgaatcagtaccgcgtggtgctggagcacgacaccacccaaacgccagggctggcggcgctggacacggtacggctgacggggagcgacggcggcgtggtgccgctcagcgccattgcgaaagtggaacagcgctttaccccgctgtcgatcaaccatctcgaccagttcccgtccaccaccatctcctttaacgtgcaggacggctattcgctgggcgaagcggtgcagtcgattctggacacggaaaaaaccattagcttcccgacggatatcaccacccagttccagggcagtacgctggccttccaggatgccctcggcagtacggtgtggctgatcgtcgcagcggtggtggcgatgtacatcgtgctcggcgtgctgtacgaaagctttatccatccgatcactattctctccacgctgcccacggcaggcgttggtgcgctgatggcgctgatgctggcaggggcggaactggatgtgatcgccattatcggcatcattttgctgatcggtatcgtcaagaaaaacgccatcatgatgatcgactttgcgctggccgccgagcgcgaacagggcatgaccccacgggaggcgatctatcaggcctgcctgctgcgtttccggccgatcctgatgaccaccctcgccgccctgctcggcgcgctgccgctgatgctcagtactggcgtcggcgcggagctgcgtcgtccgctcggtatcggtatggtgggcggtctgctggtgagccaggtgctgacgctctttaccacaccggtgatttacctgctgttcgaccggctggcgctgtcgctgcgccgccgtttcccggcgcgtaatgaggaggcgtaagtgaagtttttcgccctcttcatttatcgtccggtggccaccattctgatttcgctggccatcaccctgtgcggcattctcggtttccgtatgctgccggtcgcgccgctgccgcaggtggattatccggtgatcatggtcagcgcctcgctgccgggcgcgtcgccggaaaccatggcgtcgtcggtggcgacgccgctggagcgggcgctgggccgcattgccggggtcaacgagatgacctcctccagttcgctgggcagcacgcgcatcattctggaattcaaatttgaccgcgacatcaacggcgcggcgcgggatgtgcaggcggcgatcaacgccgcgcagagtctgctgccgagcggaatgccaagccgtcccacctaccgcaaagccaacccgtccgacgcgcctatcatgatcctgacgctgacctcggacacctggtcgcaggggcagctttacgatttcgcctccacccagctggcgcagaatattgcgcagatcgaaggcgtgggggatgtcgacgtcggcggcagctcgctgcccgcggtgcgcgtcggcctcaatccgcaggcgctgtttaatcagggcgtatcgctggatgatgtgcgcagcgccatcagcgatgccaacgtacgccgtccgcagggggcagtggaagacggcacccaccgctggcagttgcagaccaacgatgagctgaaaacggcggcggaataccagccgctgatcgtccattacaacaatggcgcggcggtacggctcggcgatgtcgccagcgtcaccgactcggtggagaacgtgcgcaacgccgggatgaccaacgccaaaccggcgattttgctgatgatccgcaagctgccggaagccaatattatccagaccgtcgacagcatccgcgcgcagctgccggagatgcagaaaagcattcccgccgccattgatttacagatcgcccaggatcgctcgccgaccattcgcgcctcgctggaggaagtggaacagacgctgattatctccgtggcgctggtgatcctcgtggtgttcctgttcctgcgatccggtcgcgcaacgctgatcccggcggtggcggtgccggtatcgctgatcggtaccttcgccgccatgtatctgtgcggattcagccttaacaacctgtcgctgatggcgctgaccatcgccaccggttttgtggtggatgacgccattgtggtgctggaaaatatctcccgccatctggaagcgggcatgaagccgttgcaggcagcgcttcagggcacgcgggaagtgggctttaccgtgctctcgatgagcctgtcgctggtggcggtgttcctgccgctgctgctgatggacgggctgccgggccgtctgctgcgcgagttcgccgtgacgctgtcggtggcgatcgggatttcgctggcggtatcgctgaccctgacgccgatgatgtgcggctggttgctgaaaagcgcgaaaccgcgcagccgcccgcgcgagcggggttttggtcgcctgctggtagccatgcagcagggttatggccgttcgctgaaatgggtgctcaggcacacccggctggtgggcgcggtgctgctcggcactatcgtgctcaacgtctggctctatatctcgatcccgaaaaccttcttcccggagcaggataccggcgtgctgatgggcggcattcaggcggaccagagcatttccttccaggcaatgcgcggcaagctggaggatttcatgaagatcatccgtgacgatccggcggtggataacgtcaccggctttaccggcggttcgcgggtgaacagcggcatgatgtttatcaccctcaaatcccgcgatgagcgccatgaaagcgcccagcagatcatcgaccgtttgcgcgtgaagctggcgaaagagccgggagcgaatctgtttttgatggcggtgcaggatattcgcgtcggcggacgccagtccaacgccagctatcagtacgccctgctgtcggatgatttaagcgccctgcgcgagtgggagccgaagatccgtaaagcgctggcggcgctgccgcagctggcggacgtgaattcggatcagcaggacaacggcgcggaaatgaatctgatctacgatcgcgaaaccatgtcacgcctcggcatcagcgtgcaggccgccaacagcctgctgaataacgccttcggccagcggcaggtctccaccatttatcagccgctgaaccagtataaagtggtgatggaagtcgatccccgctacacccaggacatcagcgcgctggataaaatgtttgtgattaacaacgacggcaaagccattccgctgtcctattttgcgaaatggcagcccgccaatgcgccgctgtcggtgaaccatcagggactgtcggcggcgtcaaccatcgcctttaacctgcccaccggcgtgtcgctgtcggaagcgagcgacgccattaatcgcgccatgacgcagctcggcgtgccctcctcggtgcgcggcagttttgcgggaacggcgcaggtgttccaggacaccatgagctcgcaggtgatcctgatccttgcggccattgccaccgtgtatatcgtgctgggggtgctgtatgagagctatattcatccgctgacgattttgtcgacgctgccgtccgctggcgtcggggcgctgctggcgctggagctgttcggcgcgcccttcagcctgatcgcgctgattggcattatgctgctgattggtatcgtgaagaaaaacgccatcatgatggtggatttcgcccttgaggcgcaacgtaatggcaatatgacgccggacgaagccattttccaggcctgtctgctgcgttttcggccgatcatgatgaccaccctggcggcgctgtttggcgcgctgccgctggtgatctccgccggggatggttcggaactgcgccagccgctgggcatcaccatcgtcggcgggctggtgatgagccagctgctgacgctgtacaccacaccggtggtgtatctgttctttgatcgtctgcggctgcgctttacgcgtaaaaaccaacagctgataagtgagtaaatgaccgacctgtccaggaacgtacgctggcaattgtggatcgtcgccgtgggctttttcatgcaggcgctggataccaccattgtgaataccgccctcccctcgatggcgcaaagcctcggggagagtccgctgcatatgcatatggtgatcgtcgcctatgtgctgacggtggcggtgatgctacccgccagcggctggctggcggataaagttggcgtgcgtaatgtttttttcagcgccatcgtgctgttcacgcttggctcactgttctgcgcccgcgccgccaccctggatgagctggtaatggcccgcgtattacagggcgtcggcggggcgatgatggtgccggtcggacggctgacggtgatgaaaatcgtgccccgcgcgcagtatatggcggcgatgaccttcgtcaccctgcccggccaggtggggccgctgttaggcccggcgctcggcggcgtgctggtggagtatgcctcctggcactggatctttttgattaatctgccggtgggcattctcggcgccatcgccacgctgtggctgatgccgaactacaccctgcaaacccgccgtttcgatatgtgggggtttgtgctgctggcgctgggcatggcggcgctgacgctggcgctggacggacaaaaagcagacggacagtctccgctgttgccgatcctgctggtggcggcaggcgtggtggcgctgctgctctatctgcgtcacgccagaaacaatgagcgcgcgctgttccggttaacgctgtttcgcacccgcagtttttccctcggcctgctcggcagcttcgccggacgcatcggcagcggcatgttgccctttatgacgccggtgtttttgcagattggcctcggtttttcgccgtttcacgccgggctgatgatgatcccgatggtgctcggcagcatgggcatgaagcggattgtggtgcaggtggtcaaccgtttcggttatcgccgggtgctggtgggcagcacgctcgggctggcgctggtcagcctgctgtttatgaccaccgcgctgctcggctggtattatctgctgccggtggtgctgtttatgcagggcatgatcaactcgatgcgcttctcgtcgatgaataccctgacgctgaaagatctgcccgacgagctggcgagcagcggcaacagcctgctgtcgatggtgatgcagctgtcgatgagcatcggggtttccgtggccgggctgctgctcggcctgttcggtcagcaccatctgacggcggacagcggcgtggcgcatcacgtctttatctatacctggctgtgcatggcggcgatcatcgccctgcccgcgctggtgtttgcccgcgtacccaacgacgccagtaaaaatgtactgattgcccggcgcaaaaggagataacaatgaaactgtggcggccgggtattaccggcaaactgttcctcgcgattttcgccacctgtattgtgctgctgatcagcatgcactgggcagtgcgcgtcagctttgagcgcggctttatcgactacatcaagaacggcaatgaacagcggctacagatgctgagcgatgcgctgggggagcagtatcagctgcacggcgactggcgttttttacgaaataatgaccgttttgtgttccagatcctgcgctcgttcgagcacgatgacgacgatgaccggcctgggccgggaatgccgccccacggctggcgcacccagttctgggttgtcgatcaggacagacatgtgctggtcggcccgcgctcgccggtgccgcgggaaggcacgcgccgggcgattgtggtgaacggcgcgaacgtcggctgggtggtggcctcgccggttgaacgcctgacgcgcaataccgacattaactttgatcgccagcagcggcgcaccagctggctgatcgtcggcctggccaccctgctggcggcgctggcgacctttttactggcgcgcggcctgctggcgccggtcaaacgccttgtggaaggtacacataaactcgccgccggggatttctccacccgcgtcacccccaccagccctgatgagctgggcaaactggcgaacgactttaaccagctcgccagcacgctggagaaaaaccagcagatgcggcgggattttatggcggatatttcccatgaactgcgcacgccgctggcggtgctgcgtggcgaactggaggcgatccaggacggcgtgcgccagttcacgccggagtcggtggcctctttgcaggcggaagtgggcaccctgaccaaactggtgaacgatctgcaccagctgtcgatgtccgacgaaggcgcgctggcctatcagaaagcgccggtggacgtcatcaccctgctggagatggccgcgggtgtgttccgtgaacgcttcgccagccgtcagttatccctcaacgcctcgttaaccgaatccgccaccgtgtttggtgaccgcgaccggctgatgcagctgtttaataatctgctggaaaacagcctgcgttataccgacgcgggcgggcagctgctgatcagcgcccgcaccaggggcaacgcggtgctgctgacctttgccgacagcgggccgggcgtcaccgacgaacagctcgcccgactgtttgaacgtttttaccgtaccgaaggctcccgcaaccgcaccagcggcggctcgggactggggctggcgatctgcgtgaacatcgtcgaagcccacggcggcgcccttcatgctgcccattcgccttttggtggggtaagcattacagttgaactaccgctggaacgcgacaaaacgagagatgtatgactgagttaccgatagacgaaaacaccccacgcattctgattgtcgaagacgagccgaagctcggccagttgctgattgattaccttaaagctgcgggctacgcgccgacactgatcggccacggcgaccaggtgctgccttacgtgcgccagtcgccgccggatctgatgctgctggatctaatgctgcccggcaccgacggcctcaccttgtgccgcgagatccgccgcttttccgatctgcccattgtgatggtcaccgcccgcatcgaagagatcgaccgtctgctggggctggaaatcggcgcggatgactatatctgcaaaccctacagcccgcgggaagtggtggcgcgggtaaaaaccattctgcgccgctgcaaaccgcagcgtgaattacagacgctggatgcgcaaagcccgctggtcatcgacgaaggccgttttcaggcgagctggcacggcaaaatgctggatctcaccccggcagaattccgcctgctgaaaaccctctccggcgagccgggaaaagtcttctcccgcgagcagctgctgaaccacctgtatgacgactaccgcgtggtgacagatcgcactatcgacagccatattaaaaatctgcgccgcaagctggaggcgctggacgaagcgcagtcgtttatccgcgcggtgtacggcgtcggctatcgctgggaagcggatatgtgccgcgtggcctgagccttcacggggcggggaaacacaccggtttactcccccgccccacagcgctacaattcccgccctaaaattaagggatctccccgaccgtctcaccccgtgagcggatctgacctgtcatcagaacgagaaaatcatgtttaaaccggaactcctctccccggcgggaacgctgaagaatatgcgttacgcctttgcctatggtgccgatgcggtatacgcgggccagccgcgctactccctgcgcgtgcgtaataacgaattcaaccacgagaatttacagctgggcatcaatgaagcccatgcccttggtaaaaaattctacgtggtggtgaatattgcgccgcacaacgcgaagctgaaaacctttattcgcgatctgacgccggtggtggaaatggggccggacgcgctgattatgtccgatccggggttaatcatgctggtgcgcgagcacttcccgcagatggatattcacctgtcggtgcaggcgaacgccgtcaactgggcgacggtgaagttctggaaaagcatgggcctgacgcgggtgattttatcccgtgagctgtcgctggatgaaatcgccgagatccgcgcccaggtgccggatatggaaatcgaaatctttgtccacggcgcgctgtgcatggcctactccgggcgttgcctgctgtcgggctatatcaacaaacgcgatccgaatcagggcacctgcaccaacgcctgccgctgggaatataacgtccaggaaggcaaagaggacgacgtgggtaatatcgtgcatgtgcatgagccgatcccggtgaaaaacgtcgagccgacgctgggcatcggcgcgccgaccgacagcgtatttatgatcgaggaagccaaacgtccgggggaatacatgaccgccttcgaagacgagcacggcacctacatcatgaactcgaaagatctgcgggcgatcgctcacgtaccgcgcctgacggaaatgggcgtacactcgctgaaaatcgaaggccgcaccaaatcctattactactgcgcgcgcaccgcgcaggtataccgtaaagccattgatgacgccgccgccgggctgccgttcgatgagagcctgatggacacgctggaaggcctggcgcaccgcggctataccgagggtttcctgcgtcgtcatacccatgatgattaccagaattacgaatacggtttttccgtttccgagcgccagcagtttgtcggggaatttaccggcgagcgcaacggccatcttgccgccgtacaggtgaaaaacaaattcagcgtcggcgacagcctggaattgatgacgccgaaagggaacgtcaatttcacgctggagcatatggaaaacagcaaaggcgaagccatgccggtggcgccaggcgacggctataccgtctggctgccggtgccggaagatatggcgctggagtatgcgctcctgatgcgtaatttcaacggcgaaaacacccgcgcgccgcacggtaattagttcagcggggttattttttcgggagattagaatcggatcacataccgcttcgttctttatgggtaatatcgcgcctgctgaaaaacataatccataaatgctagctgtaccaggaaccacctccttagcctgcgtaatctcccttacgcaggcttattttttccccgcctttcagtttcttcttacgcgctctgcttccgcctgagatacactcttctcattggttcttttcgaggtagcaggatgagcacctatacatccagtttgatgattttgaatggcaaaaacgccggtgacgagacgctgcgcgaagccatcaccttactgcgcgatgaaggcatcgatattcaggtcagagtgacctgggaaaaaggcgatgcggagcgctatgtgcgggaggcggtgcagcttggcgtggcgacggtgatcgccggcggcggcgatggcaccatcaacgaagtggcgacggcgctgtataaaaacggcggcgaaaacgccccggcgctgggtattctgccgctgggcacagcaaacgatttcgccaccagcaccgcgatccccgagtcgctggacaaagcgttgcagctggcgattatcggcaaggcggtagcggtggatctggcgcaggtcaatgatgacacctgttttatcaatatggcgaccggcggcttcggtacgcggatcaccaccgaaacgccggaaaaactgaaggccgccctcggcggcgtctcttatctgatccacggtctgatgcgcatggatacgctgaagccggaccgctgcgagatcaaaggcgataactttcagtggcagggcgatgcgctggtgatcggcatcggcaatggccgtcaggcgggcggcgggcaacagctctgcccggacgcgctgattaacgatggcctgctgcatctgcgcatttttaccggcgaggaactgctgccggcgctcttcaccaccctcacccagccggaagacagtccgaatattatcgacggtaaatcggcgtggtttgaagtgaccgccccgcacgatattacctttaacctcgacggcgagccgctcagcgggcagcgtttccgcattgaagtattgcccggcgcactgaagtgccgtttgccgccggattgcccgttattacgttaatggcgttgataatgccgggtggcggctgcgccttacccggcctacagcgcgaatagcgagtaggcccggcaagcgtagcgccgccgggcaaggagcaatgagcaaaccattaatacgccgccacctcccgtgccatctcccggctgtactgctggctggcgctgaccagcatctgcgtgtagtcggttttcgccccgccgctcaccagctcgtccaccgtcagggtttcgaggatcttaccgtactgcatcaccgccaccttctggcacagatgggcgatcacccccagatcgtgcgtcaccatcagataggtcagcttcgactcctgatgcagctccgccagcagattgagaatttccgcctgcactgacacatccagcgccgaggtgggttcatccagcaacagcacctgcggttcaaggatcagcgctctggcaatggccacgcgctggcgctggccgccggacagctgatgcggatagcggtcgcgaaacgcgcggttcagcccgaccttatccagcagcgaattaatacgccggtcgcggtcaggaatgccgtggatttgcagcggctcttccagaatatcgccgatggtgtgacgcggatgcagcgaaccgtagggatcctgaaacaccatctgcaccagccgacagcgctgctgattgatgcggtgatcgagcttctggccgttaatcgccagctctccctgccagtgggtaaacaggcccgccaggcatttcagtaccgtggtttttccggatcccgactcccccaccagaccgtaaatctcccccggctgcacgctgaaattaacgtcaaacagcacctgattgcgcttgtcgccctcgccgaactccagacttaagtttctgacatcgatcataatctgccccttattcgtgaagccagctggcctggcgctgcaaaaccggcagcaccgggcggcgatggtgaatttccggcagcgcgttgattaacccctgcgtgtaggggtgctgcgcgttatcaagatctttcgcggcgatggattccaccacccgtccggcgtacatcaccagcacgcgatcgcaaaagctgcgcaccagattgatgtcgtggctgataaaaatcagccccagcccgcgggaggccaccagatcgtccagcagcccgagcacctgcaaacgcaccgacacgtccagcgcggaggtgggttcgtcggcgatcaccagttccggatcggtgatcagcatcatggcgatcatgatgcgctgcccctgaccgccggagatttcgtggggataaaggctgtaaacccgctccggctggcgaatacgtaccacatccagcatctccatcactttcactttcgcctcggctttgcgccccggatggtgcgtcagccaggcttcggcgatctgatccccgacgcacaccaccgggttgagggagtatttcggatcctgcatgatcatcgaaatacgtttgccgcgcacggtgcgcatctgcgcttcgctgacgttgcgcagatcgatatcgccaaaatgcatacgttcggcggtaatgcgtgctttagccggatgcagacgcatcagcgcgcgcccgacggtggatttaccggagccggactcgccgacaatcgccagcttttcccggcccagctggaaggagacgccgcgtaccgcgttggtcaccgtacgcccgttgacaaaatcgacgtgcagatcgcgcacgtcaagcaggggcgaattattcgctgcgaggatcgaggatgtcacgtaggccatctcctaagaagttgaacgccaggctgttgatcaaaatcgccagccccggaatagtcaccacccaccagcactccatcatgtaggtacgaccgctggagatcatcgcgccccactccggctccggcggctgtgcgcccaggccgaggaatcccagaccggcggcggtcagaatgatgcccgccatgttcatggtgatacggatgatcaccgacggcagacacaggggcaccacgtgacgccacagtacgcgcaccggcgaggcgccctgcaaacgcaccgccgagataaaatccgcctgtcgcagcgacagggtttcggcgcgggccagacgggcaatcggcggccaggcggtgagcgtaatggcgatcaccacatgctccagccccggcccgagggcggcgacaaaggccagcgccagcaccaggctcgggaaggagatgaaaatatcggtaacgcgcatcaggaccatatccaccttgccgccgaaataaccggcgcagacgccgagcagcagacccagcgggccaacggtgacggataccagcaacacgatgtacagcgtgatgcgcgagccatagaccaggcggctgaaaatatcgcggccaaactcgtcggtgccgaaccagtgctgcgcccccggcggttgcagggcgttgttcagatcctgcaccagcggatgataaggggcgatccagggcgcgaacgtcgccaccaccagcagcaggaagataatgccgccgccaatggcggtgagcggattacgcgccattttgccaataaagcctccggtgcggctgaacagacgtttcacgcgcgcaccctgctcgctggctttgccaccaacaggcggatccagataaaccgtcatgatttcgtcctcggatcaaagagttgatacagcatgtcggagagcaggttgagcatcacgaagatcacgcccaccactaacacgcagcccatcaccgcattcatgtcacccagcaacaggctgctggtgagataggagccgaagcccggccaggagaagacggtttcgatcagcaccgccccttccagcagcgagccgtaggccagcgccaccaccgtcagcaactgcacgaggatattgcgaaacgcgtggttccagatcacctgccgctcggttaagcctttcacccgcgcagtgatgatgaactcctgggagagctgcgccagcataaagctgcgggtcatacggctgatgtaggccagcgagtgaaagccgagcagcgaggcgggcagcaccagatgattaagcgcattccagaacacctgcatgttgcctgccagcagcgcgtctatggtcatcagcccggtacggcgcggcactatgccgtccagccccaggtcaatgcgaccggcgccgcccacccagccaagccaggcgtagaacagcagcagccccatcatgccgacccagaaaatcggcgtcgaataacccgccaggctgataatacgcaccacataatcggaaatgctgttacgccgcgccgccgccagcacgcccagcggaatgccaagacccgcgccgacgataatcgccatggtcgccagttcaagcgtggccgggaagacgcggataatgtcatccagcaccggtttaccggtcagcagcgcattgcccagatcgccatgcagcagattgctgaagtagatgccaaactgcgacagcagcgatttatcaaagcccagctgctgatagacctggttataggtgctctggtcggcatccgggccgacaatcgccagcactggatcgatgggcatcacgcggccaataaaaaaggtcagcagcagcaggccgaacagcgtgatcagcacctgggtcaggcgttttgagaagcgccgggcgcgggagccgggcgctaaaattgccgtactcatcctttatctccttcgcttttcaacggggctttccagacttcccgcaggtgcgtggtggcggagggatgcgactggaagtttttaacttcattacgcaccaccaccgaatccaccatctgggaaatcggcatcagggcgggaataagctggtcgtaacgggtctggatcgcctgatactccgccttttgtttttccggatcgcgctccagcagggcgctgtcgatcatctcgttcagcgctttgtcataaaagccggtgcgccagccctggaaattggtcagccgcgcttcgtcgctgttgtccgggttatagaccagcgcgcgcaggctggagtgcgggtgcggctcgacgccgctgccgccgcgcccgaccagcagatcaaatttacgctcgcgcatggcgccgtagatctggttgccggtgccggtgatgattttggcgttaatgcccgcctgcatcagggtggactgcacggcgatggcgatattgaggaacggctggtcggccagcacgcgcagggtggtgtcaaagccgtccgggtagcccgcttccgccagcagctttttcgcccgcgccacgtcaagcttatagcccggatccggcagcgtggacggcattcccgctttaatggggcgctggtgcagcacgccgtagcccggcatcagcgctttgttaatgccctggtaatccaccagatagcgcaccgcttcccgcactttcgggttggcgaagtgcggctctttcatgctcatcgctacgtaatagaccgtgcccttctgtaccgcttcaacggtgagatcggggtcgctacgcagcgcgttgatgtccgataccgccatattattcgcaatatccagatcgcctttggcgatcatcaggcgcagggtttgcgactcctggaaatggcgcagcaccacgcggttcattttcgccgcctcgcgccagtagtccgggttgcgcttcatgcgcagtacgtctttggcctgccaggtttccagggaaaacggcccggaacccgcttcattggtggtcagccagcggttgccccagtcgttattcacttcgtggctttgcacggttttgcgatccagcacgccgagattgccaagcgcgcccagggagtagatgaccagctgcggatcgttggctttcggcagacgaatttgcacggtgtggtcatccggtgcgctcacctgttcatcaatatttttcttgctgaagccgtaggatttccacaccgacgcctgcgcaagattgaggtgcagcaggcggcgcatcgaccacaccacgtcgtcggcggtcagcgggttgccggagtgaaatttgacgtttttgcgcagatggaaggtgagcgttttaccgtcggggctgatgtcccaggactccgccagcgccggtttaacgttggtcagctgattgggatccagttcgaccagcgaatcataaagattcaccacgatgcccaccacctcgttgccggtcatcgccgccggatcgaggctcagcaggttattcatattcatgccgatgatgagctgatcggggggcgttttggctgtcgccgccccgctccccatcagcagcgaaagcgccagcagacacgctcccgccagtgaggtttttttcatgtatatatcgcctgtagggtaagaagtttttataggtcagtcatggctgacggtattggcttcgatatatgcaaaattaatgtcttcacccagccccgggccttgtggcaaatgaacaaatccctcttcatccatcggatcgacaatgctgtgcagataggccgccgggacgtcgtaatcgaggaacgggtgcagcaggccgcgttcataccagcgacagtttttgatcgcccccaccaccgccaggctggccgcgccgttgccgtgcacttcgcaatccatgccgaaagattccgccaggctcgccactttcatggtcggccagatgccgccgacgccattggaaccggcgcgcagaatgtcgcaggcccccgctttcacccagtcggcgcggctgtgatgtttaccgccaaggctttccggcccgacaacgggaatggagaggttttctgccagccaggcgtaagaggccatgctctcttcttccatcggctcttcaaaccaggcgaagttgagtttttccagttccttaccgatgtacagcgcttcgctgcggctgtaccagtggtagccgtcgatcatcagatcgatgtccgggccgaccgcttcgcgcaccgcggcgcaggctttgacatccattttcgggttcggcgcaaaggacaccggcggcatccaggtgtgcagtttgatggccttatagccgcgcgccaccagcttttccgcaaaatcggcgtactcctgtggggtggaaagaccgccttccagatcgtcgccgcacatggtgctgccgtaggcgggcactttgtcacgaaaaccgccgagcagcttgtagaccggcatgttgagtttgcggcccatcagatcccacagcgcctgctccacaaaagagagcgcgcgttcggtcagctggtgcgcgctgccgcgctgccagtgcgccagatcctgccagatacgctcccggttaaaggcgtcctgaccaatcatcaccttacggaaaaaggtgttcaccacaaagggacgcaccacttccggcggcgcgaatgagtaccctttggtgccatcgtctgcggtgatggtcagcatcgccattttcgcgaggttctccgggccggggtgcgaatgcccggcggtatcggatacccgccgcgtgggatactgaaagacggtgacgtttacggattcaattttcatgacaagtccttgaggcagaggtgaagtaagcttttgaaaagctgtttcagtaatcaatgtatgcagaaaaaacagccagtgcctcggacaaattacgttaagcagaggttaaatgttgtgcatgtgcacgaagggatgtgaggttttccacaaaagaatggtgaaatgtgaagtggatctcccctcaccctaaccctctccccagggagagggaacggtccgcgttcgccctccagcaccgggagagggatggtccgcattctccctctcccgccgggagagggccggggtgaggggccgttatcaggcgatcgtcactttgctgtcgagatagacatcctgcacggcgttaatcagcttcacgccgtccgtcatggatttcttaaaggctttgcggcccaggatcagccccataccgcccgcgcgtttgttgatcaccgctgtgcgtaccgcatcgctcaggtcggtgtcgccccctgacgcgccgccggagttaatcagcccggcgcggcccatatagcagttcgccagctggtagcgcaccagatcgatagggttatcgctggtcagtttgctgtagacgcgttcgtcggtataaccgtatttcaccgcgttataaccgccattattttccgccattttctgcttcacaatatccgcgccaatggtggccgccagatggttggcctggccggttaaatcggcggaggcgtgataatcgacgccgtctttcttaaagccgctgttgcgcagatatgcccagagcaccgtcaccatgcccagttcgtgcgcccgctcaaaggcggcggagatctcctcgatctggcgacgggactccggcgacccaaaatagatggtcgcgcccacggccaccgccccaaggttaaacgcctgctctacgctggcatacagcgtctggtcataggtgttggggtagctcagggtttcgttatggttaatttttaccaggaacggaatacggtgcgcgtagcggcgggatacggaggccagcacgccataggtggaggccacacagttacagcccgcctcgatagccagctcaacaatatttttgggatcgaaatagagcggattcgccgcaaaggatgcgccagcggagtgctccacgccctgatcgacgggcaggatagataaatagccggtgcccgccaggcggccggtgttgtaaagcgtctgcatgttgcgcagtaccgcaggcggacggttgttatccatcatcacgcggtcaacgaaatcatgtccaggaagataaagctgatcggccggaatggtcatacaacgatgttgcagcaggctgtcggcgtcgttgcccagcaattgcgtaatatcagtcatagcgatgctcccgtaagttgataagcagagtaagcctggtaccgacctttgcggaacgccaccctggaaaatttattcagcacaatctgatggcacgatccataactcaaaaaaatgttattctgatcaaagatccagcacaaaggtatctaaaaggtattattaactggtatggtcataccgtaccctttgcttgtcatgaaggaagaccgatgaaaacaactgctaagctgtcgttcatgatgtttgtggaatggtttatctggggagcgtggtttgtcccgctgtggctgtggttaagcaaaagtggctttaccgccggggagattggctggtcctacgcctgtaccgccatcgccgcgatcctctcgcctattcttgtgggttcgctgactgaccgcttcttcgcggcgcagaaagtgctggcggtgctgatgtttgccggcgccgttctgatttacttcgccgcccaacaaacggagtttgcttacttcttcccactgctgctggcctactccctgacctatatgccaaccattgcgctgaccaatagtattgctttcgcgcatgtgaaggatgtcgaggctgacttcccgcgcatccgcgtgatgggcaccattggctggatcgcctcagggctggtgtgcggcttcctgccgcaaatgctcggctatgcggatatttccccgaccaatattccgctgctgatcaccgccggcagctctgtggtgctgggtgtcttcgcgctgatgctgccgcatacgccgccgaaaagcaccggcaagctggacgtcaaagttatgctcgggctggacgcgctggtgctgctgcgcgaccgtaatttcctcgtctttttcttctgctccttcctgttcgccatgccgctggcgttctattacatcttcgccaacggttatctgaccgaagtcggcatgaaaaacgccaccggctggatgacgctggggcagttctctgaaattttctttatgctggcgctgccgttctttaccaagcgctttggtattaaaaaggttctgctgctgggcttactgaccgctgctatccgctatgctttcttcgtctatggcggggcggatcactactttacttatgccctactgttcctcggcattctgctgcacggcgttagctacgacttctactacgtcaccgcctatatctacgtcgacaaaaaagcgccggtgcatatgcgtactgccgcgcagggtttgatcaccctttgctgccagggcttcggcagtttgctgggctatcgtcttggcggcgtgatgatggaaaaaatgtatgcctacaaagagccggttaacggcctgacctttaactgggcaggtatgtgggcgtttggcggcatcatgatcgccgtcatcgcggtgctgtttatgctgttcttccgtgaatcggatagagaaattaccgcgattgtggtggacaacgataagagccccactcgcggagaggtcccacaaggagaggtaaaatgaaatcagaacgtattctcggtgcgttatacggccagacattaggcgatgcgatggggatgccgtcagagctgtggccccggtcacgggtgaaggcgcatttcggctggatcgaccgtttcctgccaggtccggcggaaaacaacgccgcctgttattttgatcgcgcccagttcaccgatgatacgtcgatggccctttgccttgccgatgccattttcgaatgcaacggcaggattgacgccgaggttatcgcccggcatatcctgcactgggccgaagattttgatgcctttaataaaaacgtgcttggccccacctcaaaaatcgccctgcgggcgatccgcgaggggcgcccggtgagcgagctggagaacaatggcgtgaccaacggggcggcgatgcgcgcctccccgctgggctgcctgttgccgacgcactccctcgatcagtttatcgatcaggtggcgctggcctccagcccgacccacaagtccgatctggcgattgccggggcggtggtgattgcctgggcgatttcccgcgcaattgacggcgatcgatggcaggatattgccgatgctctgcccgccgtggcccgccatgcgcaggaaaaacgcgtcaccacctttagcgcatcgctggcggcacgcctcgaactggcgttaaatgtggtgcgcaatgcgtccggcgtggagtctgccagcgagcagatttatcagctggtcggcaccggcaccagcactattgaatcggtgcctgccgccattgcgatggtggagctggcgcaaactgacccgaaccgctgtgcgatcctgtgcgcgaatctggggggcgatacggataccatcggtgccatggctaccgccatctgcggcgcgctgcacggagtttccgccatcaatgccgcctttaagcagcaactggatgacgtcaatcagctcgatttttcgcattacagtgaaaagctcctggcttatcgtcaggagcgggaggaagcatgaaaccaggctatctcgtcagccttctgcaccggcttgaaacccggcgtccggtgacggtgttagggggcgcggtgatcgacgttatcgccagcgcctatgcgctgccatttcgcggctgcgacattgaactgaaacagcaaagcgtcaatatcggcggctgcgcgctgaatattgctgtcgccctgcatcgtctgggcatgcgcgcgcaaaacgtgctgccggtaggacacggcatctgggcagacatggtcagcaacgcgctcaattcccacggcattgaaagcgtgctgaacgtggatgaaggggataacggctggtgtctggcgctggtggagccggacggcgagcgcacctttatgaccttttccggcgtcgaaacccgctgggcgaaggcatggctggatccgcttaccgtgccgccgggcagcctgatttcactgtcgggttatcagctctccgccgcctgcggcgaagtgctggtcaactggctggaaacgctgcacgacgtgacgccctatatcgatttcggtccgcgtattgaagacattgatccggcgttgctggcgcgtatcctggcgctgaaaccgatcgtcaccttaaaccgccgcgaatcagagatcgccgcgcagctgctggacgtggagccggaacttttaggcccggcgtggcagaaagcgtacggcgcgccgctgattattcgtcacgatcgcgacggggcctggtactatgatggcgatgagcagggcttcgtaccgcccttcccggccaccatggttgacaccataggcgcaggggacagccatgcgggcggcgtgctggcggggttatcctccggcctgtcgctggcggattcagtctgccttggcaacgccattgcggcgatagtggtcagcaagcgcggcggcgactgtgcgccgacgcgcgaggaattactcctcgcatacaaagacgtataaatcgctgcgacaggtactgatgctgtactcaatgggccggttttgttgatcaagcgccacctggcttatcaccagaaccggcaccatgttttccagctgaatatgcgtctgaaattcagcgtccggcatccgggcgctgacccgcgattttgtgcgctggggatagagacgctggctgcggaaatagtcatacagcgaaacgccaatggcatccacatccttgatgagcggcgcgggcacccaggattcctcaatggacacggcgtcctcatccacatagcgaatgcgcttaagcagaaacacgtcggaatcggtgtcgatggcgagtttttccgccacctccgccgggcagggaacaatgcgtttgttcacccacagggtatccggcttcttaccgcgcagcaccacctgctgggaaaatccccgcgcctctttcagtgaatattcgaagatgttgttgatttgcgtgccgtagccacgtgaacgcgtgaccacgccttcatcctccagcatctgcatcgccttgcgcacggtaatgcgcgaaatccccgttaacccgctgaaatcacgctcgcccggcagaatattgccgtgggccagcagcccgctccgcacggcgtctttcaccgtcccggcaaacttcagatacagcggcatgttgtccgcggcggcaatccgctctttcagctgttcgattaactggatatgcgcttgttccatttcgggtatcctggcaaaaaagtccggtggttatactaccaccactcatggaaatgatgcaccggcccgatcccctcccccacttccagcgtgtcggcctgcgccagcgcggcgctgagccagcctttggcatgctccaccgtggtcgcccagtctgtacagcgcgggcgcagcgccgccagcgccgccgacagggtacagccggtgccatgagtatttttagtgtgaatacgcggtgcggtaaaacgcgtcgccccgtcgcgggtaaacagccagtccgggctttcggcatcctccagatgaccgcctttcatcagcaccgcttcacagccgagcgccagcaacgcgcggccctgctcgtgcatctcctgctcgttgcgggcgtgaggcgcggccagcagcgcggcggcttccggcaggttgggcgtgatcagcgagacctgcggcaacagatgccgacgcagggcgtcaacggcaccgggggagagcagcgcatcgccgcttttggcgagcatcaccgtatccagcaccacattctgcacctgataacgccgcagccgctccgccacggcttccacaatgtcggtttcggcgagcatgccgattttggtggtgtcgatacgcacatcgctgaacaccgagtccagctgtgctgcgacaaactccggttcgatgcggtacaccgactgcacgccgcgggtattctgcgccaccagcgcggtaatgactgaacagccataggcgcccagcgccgagaaggttttcagatctgcctggatacccgcgccgccactgggatcggtacctgcaatggtcagcgcattaatacgtttcatgccagcgcctccccgtccagacgatacagcgcatcgagaaacgccgggataaacgaacccggcccctgactggcagcgacggcacggctgcccgcctgcgccataatgccgcaggccgccgccacgttagtcaggcgatcccccggcagcgcacagctggcggccaccaccgccgagagcgcgcaaccggtgccgaccacccgcgtcatcaagggatcgccccccggcaccgcgagcacacgctcgccgtcggtgatgtgatccacctccccgctcaccgccaccaccgccccgctctgccgcgccagcgccacggcggcaggcaacgccgcacggatggtatctgtggtgtcaacgccgcgaccgcccgcctgcatgcccgccagcgcgaggatctccgaggcgttgccgcgaatagccgccgggcgcaggttcagcagttcccggcaaaaatcggtgcggaacgtcaggccgccaaccgccacgggatcgagcgtccagggttttcccgcctcgcgggcgctgttaatggcgacacgcatggcttcggcgcgatccgccgtcagggtgccgacgttaaccagcagcgcatcggcgatagcgctgaactgcacggcctcttccggctcgattaccatcgccggggacgcgccgagcgccagcaaaacgttagcggtaaagctctgcaccacgtcgttagtcatacagtgaacaaggggggaatggcggcggaagtgttgtaacagagtggcgatatccgccggatttagcaggtcaggttgcattttttgctcctgccagactgcgaagaagggacgccggcagaggcatctgacttccctacgctggcattatccagatcaggtggtacgggtatttctcagccttcacgcagaagggcaccccgagtcatttgaatcaaaatcaattatttacagttaacactgcaacagaatttagtgtagccgcgggctgttatcgggcacaaggaatttcataaagtttctgccgcccggcttttaacctcttttaggtattcgtgcttagtgtgatctggatcaacatttacaaatcttgacaggaggatagtaacggcgctgaactaatgcgtctcttttatagacacaaaatttactattcacgaagtcaatcaatatgaaaatctctactctcgccgcggtcgtcttagcggctactgcctttaatacagcggcaaatgaaagcgtttccattatgaacgatcgcctttccagcgccatgcaggatcaagccaataaccataatgatgcgacagcgagccgtgtacatgatgcgtacaacgccgttaagcaagctgaaaatggttcaatggataactcgcacatggggagcacgacgcaagccacaccaaccgcagccagctatggttttaacgcgtactccggatactcaacccgccccggcaccttcgcgccaacggcagacgatcgcaataatcatattccggacgccataccctctgtgaaaacagatggcgttccgcaggcaacgccgcagcgcgtgcccggtttgcagctgactccgaaagcggttgaacaacgtacgcctgtgctgaatcttacgcctgcagccattgcgcagaaaacaccgcaacttaccaacgctgtgcccacacagctcacgccacagcgcgtgcctggcgctattccggcacagcgttatcaaaaagtgcctgttgccaatttacaggcgccgggcacgctaacgcctgtagccacctattctgtacccaagcaggcaatcagctatagcggtgcttctcgccgaccgggcacttatcaaccttctgtgaccgctcccgccatggtgaaaggtattatgcagtctcctgcagtcgccacacctgagcaggttgacagcattaatgtcagcgttaacagcctgaaaccagatacacaggttaacgtcactgtcgaaggcaaaaccttcaccacaacggcgggcgctattgctaaggtcgatcctcaggcgcaaattagcgtgccacatatgccggtactggttcgcacccaatataacggggctaatcacggtaacaatggcgcacggaaaggcgagtctaatggtcgcggtgcagataatgcccattcccatgcctttggcggacatggctatggtcatgataatagccgatcagaaggcttcggcggccattcgcattttcattaataaccttagtctgtatttgataagaatacagcaaattaccgggttgattcataataatcagcctgctcaatataaaaaatgctcaaatacattttatgtagcgccctgctctatctgtcctgttttgtcattggtttcacaggcggcatggagtatataaaaatatttaccgactcatgtgatatttataaaataagcgacagcaataatgaaaaagttaatgatgatagcaatcataactggattagtcacttctaatgcctttgccataaatgccagctttcgtaagcaacttgaaaaatcaggctgcacacaagttactgaagctaatggtacatgtgacataaataaaacaaaggcacaaaacaagaaaagtaaaagcgaggaaactaagaatatccggaataaataattaacgtcactgccgtccattctgcacaacgggcggcagtgacagcttgccgcaaaagttttacttatcctcgcgccccgccgattaaacttacttaatccgaagtgaaaatttctcactttgtcaccctctcttacacgccagcatgattaatgtagaggtttatcaaacacttaaattcaatatttacttacctgactaagcgttccgcatccggttagctcattttttaatcaaatcctgaaatctcatacaagagatattctgcctgccatgcaaaatgaagttcgactacagacgcattaacttttgggcaggagagaaccgtgagtatcgaagaaaaaattgaaaatcatatacgtcagtttccggtatcgctggtgaattaccttaaaagcgattaccaggaagatctgatggtggtgatagatgatttgctgccgcatgacgttcgtgaagggatggaaacggaagcgcgccgcctgttgagcgaagaagcattacggcgtgaagtgataattgcccagagcggtaatacgccgcgtgcttacgacagtgttggacggaatgtcatccgcgaacagggggaatatattcccgcgttttttgacagcccaagcattctcaattttttcagccgcattaccggcgaaacgctttatcgggtgccttacgccccggaagaattcattattaattcacaaaacaaaaccggcgatacccacggctggcactgggatgactactcctacgcgctggtgtgggtgatcgacgagccggacgttttcgccggtgcgcgcgtggagtttattccccgtgtcccctggaaaaaaaccgccacccgggaatggattaaagatgtgctgacggaaaacaccatccgtagccgccatgtctcccagggacaatgttatctgctgcgcgccagagatgcgttacaccgtatctccccgttaaccagcgcgtcccgcagaaccgtaatcgtcttcacttatgccaacgatttagatcttaacgatcctgaactcacccatgactccatggaaactatttatccgcaggacacccaggcgcagctgtaaataataacgaagaaggaagacatcatgagtattaatgaatgtgcgggcgggatgaatgaccagggcggattcccggtattttttactgaaatctctgacgatctgggtcgctatgatgaatataccgacgccgcccgggcaatttcccaggcttttcctccggcttcttatcccgccgcgctcgatatttgctgcggcattggcaagatgagtaaagcgctccatgagtgtggctatcgcgtcacgggactggatttatccgccgcgcagctggagattgcccgtcagatttcccctggcccgcactatatccgcgccgacatggcaacgctgcctgccggagagtttgatttattactgaacgtttataccagctttggttattaccagagcgaagaagaagatctcagcgtgctgcccgcctggttcgccgcgctgaagcccggcggcgtgctgatcatggaactcgccgacatggatcgggcgcgtaaccgcatagatacctcaggtctgctggtacgtcatcataacggcgtacaggagacattaaccatggactgggaaaaacgaattcttaccgttgcctatgaaaaaaatagcagtcagtggacctgcttaacgcgcctgtatgaaaaagagtatttgcgggaggcgttactggccgccgggtttattgatgtcgggatcttcggcagcttcgatcttaaatcgaaagaagttgacgacaaccttgttcttattgccaccaaaggtaaataacatgtctaaaacaatctgcatcgttgatggttattccacgggcgcggaactggcgccgctgttcagaaaagaaggctggcgctgcgttcatattcaaagcaatccggttattccgggggattatcttttatcctttcgcccggaaacctttgataagcatttaatcttaaaagatcattcgcctgctgcgatgcgggaactggcggtcagcctcgccttttatggcccgacggttattattcccggcacggaaacgggcgtcgaacttgccgattttctcgcaaccgagctgggcaccgcgggcaatgactatgccaccagcgcattacgccgtaataaattcaaaatgcaggaagcgctgcgccagggcggtttacgcgccatcccgcagatggtgacggattcgctggcagatgcctggatttgggtgaaaacctccgcctgctggccggtggtggtgaaaccggtcgacagcgcaggggccgatggcgtgcgcttttgtcataattttgaagagctgaacgaggccttcaacgatattcacggcaaaaccaaccgtctgggtttacataacagcgaagtgctgttgcaggagagattaattggccgccagtttatcgtgaatgccgtcagtattgacggcgagcatttgatcagtgaaatctggtctgacgataaaaagcaggtcagaaacgcttcactcatttgtgagaaagaggtgctgctgccctatcagggtaaagagcaagaagcgttaattgcctatgtgcaaaaagccctgacgctgttaggcattaaaaacggcccgtcgcacagtgaattaatgatgaccgccaaaggcccggtattaatcgaaacggcagcccgtatgcagggcactattatgcacaacgcggtagtggcagccctgggttacagccatgtgaccttaaccgctgagcgttatcttaacccgcaacgcttcgccgcccggctacagcagcattatcagctcatgaaaacgctctattgcgtcacgctggcgtcggatgtggatggcgtggttagacaaaaccgttgtcaggaattgctcgcgcaactgccctctttttatggcgttatgcatacgccggatgcgggtgaaaaaatctaccgcaccaccgatctgtttaccaaccctggcattatttatctgtgtcatgaaagccagcagcagatcgaagcggactatgcgcagatcagagagtttgaaaaaaatggcgtcttatttgaattagcctgagataactatgaataattatagtggtgcagtgttcggttttattatggttttcatttacaactttctggacgccggaaaagaggtctattcgggattcctggtacagtctgcgcatccgatgatggtcacctgtattgtcttctcaaccgtgctggtattttttcagatcttctgcctgctccgcttgcgaaaggaatacctgcgtccttacagaacctggaagcctctggttgcgcttaatatgacaacagcgggatcgtggatcacttttttctactgtttaaaatatttagagcctgccagcgcgtcggcgattatcaccggcgttgcaccacttttaatggttatgattgtgcctttctttatcagaaccgaaaaacgggaataccgctggttgttactgacaggcattgcctgtagctcattatggctgggtgttatcagtctgcaggaggggcgtaatacctataatttatccgtacaggaagtgatcatcggtattgccctttccgtcggctgcgccctgttcagtattttctccaatatcctcagtaagaaactcagtgaggatgaatgtcgtccggaatccattatggcgcaccgcttttacctgacggtgctggtgacgctgctgttcagttttcagctacaggatatgcaaagcgatatgcaaaacctgtttcccggcgtgctgctgctggcagtcctggggttgattattccgttatggtgcttgcaatatggcataaaatccttagcgccttcgcgggtgatggtattaatttctgtcagcccggtctttacctttggctttcagatttttgacccccgactgtcgccgacagcgtcctcctttgttgccattctgttaatatgcttcttttctctggctgcggaagtgtggcgtattcagcatacaggacgggtgaacgatggctatcacagggtatcggaagacaggaacggttgagatcacgctttctgacagcaccaaccatgtttttccccggcactcccacgatgaattttatctgggcgcaaacctggccggcagggagaaaatctggcttgacggtaaacgttctgaagccagtattgcggatattaccgtttataatcccggccaggtacaggccgccacgcccaccccctataactgggtttattacagcttttacattccgcctcaggtgctggccgaacttaccggcctgcctgaggatgatgaattcagaaagagcgtattcaccgcgcccgatattgccgacgacattattaaaaccggggcgtattgcctggattacgcgcattccgatgatgaagtgctggaacgcctggcggtattattaaaaaaggtgctgcaacgcaccggttgccgcaccaaacttattctgttcgatcaggacgcggtgctggccgcgaggatcgccgcccagctgaaagatgaactgctcgaaccgccgtccctcaacgatctttccgcgcagtacggactcagcgccgtgcagctggtgcgtattttttctgcctcttatggcctgccgcccttcgcctggctgaaagtggaaaagttaaaaatagcgaaaaatttattattacgcggcctgagcttatcggatattgccgccggtcttaattttgccgatcaatcccatttcacccacagctttaaggaaatgtttaatatcacgccagggcgaatgtcgcgtttatataaaggggcgtgattttcactcccggaggataagtcctgcattttgcgccgggtgtttcccgcgccggtgggcggctatgctgaatacattcgctcaacgctatggagtagttatgaaagcaatcgccattaccgccgccgcgcagaacggcagcaacatcgatttcctgcatgatattgatattgaaaagcctgtcgcccgcggtcacgatctgctggtacaggttcatgccatttccgttaatccggtggataccaaagtgcgtgcgggctttaacgctgatgcgccgcgcattctgggctgggatgccgtgggcgtcgtcagtgacgtgggcgagtccgtgaccctgtttaagccaggcgataccgtctggtacgccggggcgctgacccgtccgggcagcaacgccgaatatcagctggtagacgagcgcatcgtggcgcataaaccggcctcgctggataacgcctctgcggcggccctgccgctcaccgccattaccgcctgggagatgctgtttgatcgccttggcgtcgcggaaaacggcaacgagggcgatgtgcttttgatcgtcggcgcggcgggcggcgtgggctcgatcatgacccagctggcgcgtaagctgacgaaaatgacggtgatcggcaccgcctcacgcccgcagagccagcaatgggtacgcgatcgcggggcgcatcatgtcattgaccacagcaaaccgctcagcgaagaactggcgcgtatcggcatcaaacaggtgacgcatgtcgccagcctgaccaataccagcgatcactatcagcagttgattgacgcgctgatcccgcagggtaagctggcgctgattgacgatcccgagacgctggatgcccggccgctgaaagcgaaaagtatctccctgcactgggaatttatgttcacccgctccatgtttgaaaccccggacatgatcgagcagcaccacctgctgacccgcgtggcctcccttatcgacagcggcgtgattgaaaccacgctgggtgagcatggcggcactattaatgcggaaaatctgcgtaaggcgcataagctgatcgagacacaacgggcggtgggcaagattgtccttgaaggtttctgagccaggaatcatcccaaaagcctttccccgatgaaagcggagcgcggttaacgcgcttcgctgcttctgctttgccccgcctttgcttacactttttcgcaaagcgctgttgctttcagtcataaatcgcagcaatgttagcgcgcatgatttaccagagggcggtagaaaaataaaacgcctgtcaaaaacggagagattatgggtaagacgaagatgttacttctgggcgcgctgttgatgacctcaggcgcggtactggctgcgccgcagggaaccggtattcagaagtatgaaattcaggaatttattgccgacttcaccaaatttaaaccaggcgatacggtgccagaaatgtaccgcaccgaagaatacaatattaaacagtggcaggcgcgtaacctgccggcgccggatgccggaagccactggacctatatgggcggcaactacgtgctgatcaccgatgccgacgggaaaatccttaaagcctacgacggtgagattttctaccaccgctgatcgacaggccgggataagagatgcgcatacgcaactggacagagagcgatcgcccttttttacgcacgctttatttgcaggcacgtcgtcacagctggacatggcttgagggcgaggagtggcaactggaagatttcgacgccgccaccctgggcgaacagatttgggttgcggaagaagacgggcaccggctgggctttgcctcggtttcggtgagcaataactttctgcacaatctgtttgtggatccccatgcgcagggaaaaggcgtcggcagcgcgctgctgaaaaaggtgcagtcggaatttaccagcaccggggcgctgaaatgtctggcgcaaaacaaggctgcgctggcattttatcagcgtcatggctggcatgtggaagcgaaaggcgagtcgccggaaggggaatatgtgctgctgcactaccggctaagctgatgaacgaaaaagaacccctcaccggacggcgaggggttttgttttacagcgcgcggaatgcgatttccgccgggatcacatcgccctgccagtacagctgcgcggcgacacgccccgccagcttacggtacattgccgtaaactcgctgtccggacggctgaccacggtcggcgtgccgttatccagatcttcacgcaggctgatgtgcagcggcatctggcccagaagctgggtgtgatactgctccgccagcttctctgcgccgccggtgccaaaaatcggttcgtggtggccacagttgctgcaaatatgcacgctcatgttttccacgatgcccagcaccggcacttccactttctcgaacatcacgatgccttttttcgcatcgatcagcgcaatatcctgtggcgtggtgacgaccactgcgccggtcaccggcacgttctgcgccagcgtcagctgaatgtcaccggtgcccggcggcatatccagcaccagataatccagatccggccacagagattcctgcaacagttgcagcagcgctttgctggccattggcccgcgccacaccatcgcgttctcgtcggtaaccagatagccaatggagttggtggcaaggccgtgggccatgattggcgccatgtgcgtaccgtccggcgatgtcggacgttcaccttcggcacccagcatggtggggatcgacgggccataaatatcggcatcgagaatgccaactttcgccccttccgccgccagcgccagcgccaggttgaccgcagttgaggatttccctaccccgcccttaccggaactgaccgcgatgatatttttcacgccgttgatgcccggctgatttttcacgcgctttaaggtggcgaccgtgtgcgacagcttccagtcgatggctttcgcgccggtaaggcgcagcagctcggcgctgcactcctctttcagctcttcaaaagcgctgcgccacgggaacggcatcagcagttcgatgtgcagcgtgtcatccatccaggcgacatgatggacggctttcagggccgtaagattatgggtcagcgtggggtgctggaaatttgccagggttccgacaactattgcgcgcaaggcttccggggatttggcctgggattgcgagttcatcccgactcctttgtatttgtatgattagctcgtcatgcaagtttacctgaaagaggcgggtttgtgcttacttaataattgctgttttggtaatatcaaaaccccttttttcacagaagaagtaatgttcactatgactcaagtcgcgaagaaaattctggtaacgtgcgcgctgccgtacgccaacggctccatccacctcggccatatgctggagcacatccaggctgatgtctgggtccgttaccagcgaatgcgcggccacgaggtaaacttcatctgcgccgacgatgctcacggcacgccaatcatgctgaaagctcagcagttggggattaccccggagcagatgattaccgaaatgagtcaggaacatcagactgattttgccggcttcaacatcagctacgacaactatcactccacgcacagcgacgaaaaccgcgagctggccagtgtgatttacggtcgcctgaaagagaacgggtttattaagaaccgcaccatctctcagctttacgatccggaaaaaggcatgttcctgccggatcgttttgtgaaaggcacctgcccgaaatgtaaatccccggatcagtacggtgataactgcgaagtgtgcggcgcgacctatagcccgaccgaacttatcgagccgaaatccgtggtgtccggcgcgacgccggaaatgcgtgattctgagcacttcttcttcgatctgccgtccttcagcgaaatgttgcaggcgtggacccgcagcggcgcgttgcaggagcaggtggcgaacaaaatgcaggagtggtttgaatccggtctgcaacagtgggacatctcccgcgatgccccttacttcggcttcgaaattccggacgcgccaggtaaatatttctacgtctggctggatgcgcctatcggttacatgggttccttcaagaatctgtgcgacaagcgcggcgatagcgaaagcttcgacgcttactggaaaaaagacagcgatgccgagctgtatcacttcatcggtaaagacattgtctatttccacagcctgttctggccggcaatgctggaaggcagcggcttccgcaagccgaccaacctgttcgtccacggctatgtgacggtgaacggcgcgaagatgtctaagtcccgcggcacctttatcaaagccagcacctggctgaaccattttgacgctgacagcctgcgctattactacaccgccaagctctcctcgcgtatcgacgacatcgacctgaacctggaagatttcgtccagcgcgtgaacgccgacatcgttaacaaagtggtcaacctggcatcccgtaacgcaggctttatcgccaaacgctttgacggcgtgctggcgtctgaactggcggatccggcactctataaaaccttcaccgatgccgcacagagcattggcgaagcctgggagagccgcgaatttggcaaagcggtgcgtgaaatcatggcgctggctgacgtggcgaaccgctacgttgacgagcaggcaccgtgggtggtggcgaaacaggaaggccgcgacgccgatctgcaggccatctgcaccatgggtctgaacctgttccgcgtgctgatgacctggctgaagccggtgctgccggagctgagcgcccgcgccgaagctttcctcaacacgaccttcgaatgggatgccattaaccagccgctgctggcgcacaaggtcaacacctttaaggcgctctacaaccgtatcgaaatgaaacaggttgaagcgctggtggaagcctcgaaggaagaagtgaaggcggcaagcgcaccggtttccggcccgctggcagacgatccgattcaggacaccattacctttgatgatttcgcgaaaatcgatctgcgcgtggcgctgattgaaaacgccgaatttgtggaaggttcagataagctgctgcgcctgacgctggatctgggcggcgagaaacgtaacgtcttctccggtattcgctctgcatatccggatccgcagccgctgattggccgcctgacggtcatggtcgccaaccttgcgccacgtaaaatgcgctttggtatttctgaaggcatggtgatggccgcaggtcctggcggcagcgacattttcctgttaagcccggatgatggcgcaaaacccggccagcaggtgaaataatcccaaatacgcttaactgggcgctgtttatacagcgccctttttttattgcactatgattgcagggatggtgattttttctcatattaaggagcagtatgaacattttaaaaaaattaggcgcactcgtcttcacggcgttcgtggttgtcgcgctgagcggctgtggcgataaagaagaaagcaaaacctttacctggtcagacggtaaaaccgatttatccctgacctattactacaaaaatgacgtagtactgcgtcagacagcgaaaaataccctgcactatgcaggtctgggcgtggcgaataaagaagaagcgatgcaacgtctggggccaatcagcgaaaaatataaagagattaagggcgtggaagagagcctggaatatggcgatacctctgcaaccgaaaccctgaccgtggattacagcaaagttgaccgtgacgcgctgcaaaaaattcagggcgcggagtttaccggtgatgtgaaagaaggcgtcagcatgtccaagtctgaagccctgctgaaatctcgtggttttaaagaagttaaagaataagtttgatattgcccggcggcgcaagcttgccgggcctacacaaacctcatcgccctccaggccggtgtaagcgaagcgccacccggcaaatcccacgccagttcaccctacctgtaggccggcgtaagcgcagcgccacccggcacaaaacccttatttcgcggcgtgcacccgggtcgccagaccacgcaggaaataacgcaggaactgatccccacattcacggaaatttttatgatccgccgcgcgcatcatggcggtgatctccggcatcgacacacggaactgctgcgcggttaaaatcgccagaatatcgtcggttttcaggttataggcgatacgcagttttttcagcacgatattgttattcacgcgacgctctaccgccagcgcaggcgccgattcatcccggccacgcttttcataaatcagaccattcaggaagcaggcgagcagaatatccgggcagcgcacaaagccctcttcatcttccttgcgcagccatggcaccagctgttctgcggtgacatccgcttcacccagcgcgaaaatacgcagcagatcttgattgttgaatttagagatatagcggacgcttcgtaaaatatcgttactgatcatagtgccttcggtggagaaaaatacaaaaacgcagtttaccacgatccccgcgttttacagacccagcgcttcttttagatttttcagataacgacggctgacgggcaccgtatgcccttcacgcagcagtaattcagcctgaccattatcctcaaagcggatctcttttaagtgcgccatattgaccagatattgccggtgacagcgcatcagcggcgtacggctctccagagtgcgcagggtcagctccgtaaagccctctttgccttcgtgactggtcacatacaccccgctgaggcggctgctgacgtacgccacatcgtccatctgcaacagataaatgcggctgtgcccggtgcagggaataaacttcagcggcgcctgattttccggcagcaccgagacgtcctgtactccgcgctcctggcgcaaacgcgtcagggtttttgccagtcgcggcgatgcaatgggtttgagcagataatcaaaagcatgctcttcgaaagccttcaccgcatattcatcaaaggcggtgagaaagaccacgtaaggccggtgctcaggatcgagcatgcccaccatttccagcccgctgatgcgcggcatctgaatatccagaaacagcacgtcggggcgcagtttatgcaccgcgcctatggcttccacggcgttggcgcactcgccgacgatctcaatatcgctttcatcttccagcagaatacgcagattttcccgcgctaagggttcgtcatcgacgatcagcacttttaacatgcgctttcctccacaggtaaacgtagggtaattcgggtaaatcgatccggctcgcaggccacggcgataccgcaatcatcgccaaaacgcgcccgcaggcgcttatccaccaggctcatgcccagcccgctggcattggccttcggctggtacagacccgcgttatcttcaatatccagcaccatatactgcccgtcgagactcgcccggatagtgatttcccccacgcccagcagctgtgaagtaccgtgcttaatggcattttcaacgatgggttgcagcgtaaaggcgggcagtttgtgccaggacagcgcctccggcacaaacagctgcacctgcaaacgcgactggaaacgcgcctgctcgatttgcagataggcgttcacatgctccacttcatccgccagcgtcaccacttccgacgggcgttttaagtttttgcggaaaaaggtcgacaggtactgcaccagttgcccggcctgctcgctgtcgcggcggatcaccgccttcagcgtgttaagcgcattaaacagaaaatgcgggttcacctgcgcatgcagcagtttgatctccgactgggtgagcagcgctttttgccgctcgtactgcccggcaaggatctgcgccgacagcagctgcgcgatcccctcccccagcgtgcggttaatggaactgaacaggcggtttttcacttcatagagtttgatggtgcccatcacccgctgattctcgccgcgcaacgggatcaccagcgtcgagcccagcttgcactggggatgcagtgaacagcggtacggcacttcattgccatccgcatagaccacttccccggtttccagcgctttttgcgtccagcgtgaggaaataggccgccccgacaaatggtgatcgtcgccgatgcctttaaaggccagcagcttttcgcgatcggtgatcgccaccgcgccaatgtccagctcctgatacagcacctgcgccactttcatgctgttctcttcgttaaatccctggcgcaaaatgccttcggtggaggccgccaccttcagggcagtggcggaaaaggcggaggtatacttctcaaacatcgcccgtttatccagcaggatgcgcataaagagcgccgcgccgacggtattggtcaccatcatgggcgcggcgatgctgctcaccagatgcagcgcgtcttcaaacgggcgggcgatcagcaggatgatcagcatctgtaccagttccgccaccagcgtaatggccccggcggtcagcggactgaatactttatcggtgcggccgcgtttgatgaggaaactgtgcaccaggccgcccagcagcccttcgacgatggtggacaccatgcagctgagcgccgtcatgccgcccatggagtaacggtgtaatccaccggtcagccccaccagcccgccgaccaccggcccgccgagcagaccgcccatcaccgcgccaatggcgcgcgtgttggcgatggagtcttcaatgtgcaggccgagataggtgcccagaatgcagaaaatggagaaagtgacatagcacagcagtttatgcggcagccggacggtgacctgcatcagcggaataaacaggcgcgttttgctcatcagccaggcgatgaccagaaacacgcacatctgctgcagcagcagtaacaccagattaaactcgtacatacccaaacaccgaaaccgcataaagcgcgtaacatacagggcgccggggatcctttctgtgaaaccgccggaaaaaatcaaaaaaacgtgcccgccatcacaataacgccgcctgttgtcaccctttcgtatgcctggcgaataaaaaacaagcaaatgagagccgttcgcataacagcgtctacagttagaccaggacccgtgcaaaggtgaaactatggcgctatacaccatcggtgaagtggctcagctgtgcgacgttaatcctgttaccctgcgggcctggcaacgccgttacgatttgctgacgccacagcgcactgatggcgggcaccggttatttaatgatgcggacatagaccgcatccgcgaaatcaaacgctggatcgacagcggcgtgcaggtcggcaaagtcaaaaccctgctgtggaatggcgcgacggacagcgaatataactggcgggagcaacaggagcgtctgctcggttacctgcaatgcggtaatcttccccgtctgcagctgtggatcaaagaacaggggcgcgcgttcccggcccatactatcatcacgcaattactcattcctttgcgtctgcgcctgcgctgccaggatccgacgctgctcgccatgctgagtctgctggacggcgtgctgatcaaccatatttcgctgtgtcttacctcgtcgcggaagaaaagcagcaatgatgcgctggtggtcggctggaatattcacgataccacgcggctgtggctggaagcctggatcgcaagcgagcagggctggcgcaccggcgtgctggcacattccctgacgcagttgcgcccggaacagtttaccgggcataccttaatggtgtggtgcggcgatgcgccgacgatttcacagatgcagcagatggccagctggcgtgatgccgggcatgcgatccagatgctcggcatttaatggttcgttaacacttgcgcttcacgttatactccctgcgttaatcatcaggagtaaaacatgaaggcgtccaaaatccttgtcaccaccctctttctacttatggctatcggcggcacgggcggcgtgatgctggcgggttacttctttattctgcgtgcttagtcattgcccgcgccaggcgctcgaatccgcgatcgacaataatcgcggccagcgccaccagtagcgcgccctgaatgacataggcagtattaaagccggaaagtccgatgataattggcgtgccgagggtattcgcccccacggtcgaggcgatcgccgccgtgccaatgttgatgatcaccgaggtgcgcacgccggctaaaatcaccggcgccgccagcggtaattccactttcatcagccgctgccaggcgctcatccccataccttccgccacgcttatcacccccgccggtacggcgctaagccctgccagcgtgccctgcaaaatcggcaatacgccgtagaggatcagcgcgattatcgccggatccctgccaaaacccatcaccggcacggcaatcgccagcactgccaccggcggaaaggtttgcccgaccgcggcgatggtttccaccagcgagcgaaattccagccctgccggacgcgtcaccgcgatccccgccccgacgccgatgatcaccgctatcacgctggaaatccccaccagccagaaatgcgccagagttaaggtaagaaaggattcctgctgataaaccgggcgcggcagctgcggaaaccaggcgctgaacagcgtggcgctgtgcggcagcgccagcagcaacgcgataaagagggcgataagccacagcagcggatcacggatgaccttcacggttggcctccatgctgagcagatcgcgaaaatgcagactgccgcaggcaataccttgcgcatccaccaccggcaacacgtcgcgctgctgcgccacgaaggccgacagggcgtcgcgcaatgtcaggttttcactgagcggctcgcctgctgccgcatccccggcgcgctgataatcgccgacccggcgcagggagagcaggcgcacgcccagctcgctgcgaccgaagaattcgcgcacgaatggcgtggccggacgggtgagcatctccagcggcgtgccctgttgtaccactttgccgttatccatcagcaccagatgatccgcaagctgtaaggcttcgtcgatgtcgtgcgttaccagcacgatggtgcgcccgagcagctgatgaatgcggcgcatctcctgttgcagcgccccgcgcgtcaccggatcgagcgcgccgaacggctcgtccatcagcagcacttccggatccgccgccagcgcccgcgccacgccgacacgctgttgctgaccgccggacagttcatggggatagcgcgagcgcaggccgggatccagcccgagcagcgccatcagctcatccacccttgctgcgatacgcgcccgcgaccatttctgcaactgcggcacggtggcgatgttttccgccaccgtccagtggggaaacagaccgatggactgaatggcgtagcccatgcgcctgcgcagcgtcagcatcggaaaggagcggatctcctcaccggcaaacaaaatggtgccggtatcgtgctccaccagccggttgatcatcttcagcgtggtggatttaccggagccggaggtgccgatcagcaccgtgaacgccccggttttgaaatgcagattcagatcgctgaccgcgtcctgaccattaaatgctttgctgacctgtcgaaattcaatcatgcctgttttaccttcagcagcgcgagccacaatccgaataatgcgtccaccaccactgccagcgcgatcaccgggatcacgccgagcagcaccagatccagcgcgctactcagcaatccctggaacaccagcgccccaaacccgcccgcgccaatcagtgccgcaatgaccgccatgccgatggtctgcaccgtcaccacccgcagactgcgcagcaataaaggcaacgccagcggcaggcgcacctgcaaaaagcgctgccgggcgctcatgcccatgccggcggcgctttccagcacctcgcgcggtacctggtttaaaccggccaccacgccgcgcaccagcggcagcagcgcataaagaatgagcgcgatcagcgcgggcgtcaggccggtaccggcaatgccaagctgtcccagcaccggaaagcgttgcaccagaccggcaaggggcgcgatcagcagaccaaacagcgccaccgagggcactgtctgaatgacgttaagcaccgcgaacaccggcccctgacgcgacggatggcggtaacaccacaaccccagcagcccgcccaccagcagcgcaggcagcagcgtgccgaccagcaacagcaaatggcgggtcaacgcatcgtcaaacacgtcctgacggttggcgtactctttcagcagggagagatcgttaagatagccatagtgcagcagaaacagcggcaggatccagatttgcgcatgtaacagccagcgccagacggggcctgccgtcaggcgacgaatggtatcgctggcggcaagcagcgccagcgccagccacagccacagaccgctgcccatggacgtacgggcaagcgtactgccctgctgcgccagatccgtcgccgcccggcctgccgcccataccagcacaataaacagcccttccgcgaggataagcgtggcggcctgaggccagcgacggggcagaaaacagagcgccatcagcagcaacggcgctgccagccacagccatgacgaggccggccagacctgccataacaggcggctttcgccggacaccagccggttaggcgcataattaacaaagggcagcagcgaggctgccagcgcgatcagcgccagcagcaacaccacgcgattatgacaacggatcaataccatcccatcctgtgattacttcaccagtcctttttgcttcaggtagtcagcggcgactttcttcgcgtccagcccttccacggcgatgctggcattcagctgttgcagcgttttttcatcgaggctggcgaagaccggcttcagccattcgtccagctgcggatacgcttttagcaccgcctcgcgcaccaccggcgttggggcgtaaatcggctgtacgcctttcggatcggtcagggtttgcagacccagcgccgctaccgggccgtcggtgccgtaggccatggcggcattcacgccggaggtttgctgcgccgcagctttgatggtcacagcggtatcgccgcccgccagcgacagcagctgatcctgattcaggttaaagccataggccttttcaaaggcgggcagcgcatcggcgcgttcgataaattccgcggacgccgccagtttgaaggtgccgccctctttcaggtaacggctcagatcgtcaagggaggtcagcttgcccttctccgccacgtctttacgcacggcgatagtccaggtgttgttggcgggcgcaggcgtcagccataccagcttgttctgttcggcatccagttttttgactttttcatagccctgctgcgcgtttttccacgccgcgtcgttttcatctttaaagaagaacgcgccattgccggtgtattccggataaatatccagctcgccggaggtgatcgccccgcgcaccaccggcgtggtaccgagttgcactttattaacggtcttcacgccgtggctttccagcacctgcaaaataatattgcccagcagcgcgccttcggtatcaatttttgaaccgaccttaattggctccgccgccagcgccggcaggctcaccgccgcgatcaacgccagtgagccaagcatcccctttttgattgtcatcgtgctttcctcgttttttgccgtctgctatcagcagcttgtgtaaaaagcgtagacgatatatcgctagtctgcggggttctctggcagctttaacggtacggtcataatactggccgaaaaatagagcagcgcaatgacccacagcgtgccttccacgcccagcggacccacgcacaacgtgacgataacaggcccggcaaaattgctcagccccgagccaagattaagacaggagatggcggtgcctttattttccggcagcagcgaggggaccagcgcgctcagcggcccaaaggcgccgaggccgatggcatagagcgcaagcgccatgaacagcgcggcattgctgtgaccaaagatcaccggcgcataacagaccgccagcgatgccagcccgcaaagggtgccggaaaaccacatcaccgtattgcgccagccgatggtgtcccccagccagccgaacagatagctggcgaaaatgttcaccacattgaccagtccccagatggtcagccattcggcgatgctgaagccgaagcgcggcagatacatcggcatgaggatcaccagcgaaaatttgccgatgtcattgatggttttgaccatcaccgcgagccgcattttcggctggcgcaccagcaccataagtccctcgcccatcgcctgacggatgctctggctgcgggtgaaacggggtctgtcgctattgaggatcagcgcgcatacggctcccagcgcaacaaaaataaaaccgctggccagggtggcggtttccccgatggcgggcagcatcagtcctgaataccagggtccgacaatggtcatgccgacgccaaaggcgatccagaaccacgacaccgcgcggcctaatatccgcgcttcgcagcgctggttgatccacaccagaaaggagtaggcaaacagcggataggccacgccgcgcagggcatagctgacgatcatcatcggatagtggttatccggcagagcgacaaaaataaagggcaccgatccggcgaaatagcacaccgtcgccgcccacatcagccgccgcacgcccagtacgccagcgccgatgccggaaaaccacgacaccgccgccacgcacaggccgaaaattgaggacagcaggctgatatcggtggccgcgaagccgcgcgtttgcagcatcgatgccagccagctctgttcgatggtcgcgccggtgataaagagaaagacgccgataaatccccagcaaagctcgcggggcaagccgaggcgcgcccagacgccccgctggataaaaagactttgatccatgatgttatccttaacaagattttcgtccctgaaggtgaaggccgcattatgcggattaccgcccgccatttttgtgacgcgctttctgagtctggtgaaaacgtactacagtgtgccgataaatcttttacaggacaggttaagcgagtatcagatgtcacaatactggtggaaggatttactcgaccgcaatggccactggcaggggctggaactgcaggtgcaggaaagcgactctcccgtgcaggccatggaaatgttaagcggccatcatggccgtatggcgctacagctccagggagaaacactgttctgggccacgatgcttgcggatcactcaggcgtctggctggtgtttaatgccgatcatccgggccagcaatccttgttgccgccggtgacttccgcagacgtggaatgggtccaaaagcaggccgtacacgatccgctaagcgaatggtgtcgctattttgcccgacagttaatgacggcccccacgccgttgttgtccgcgcgtcggtggttgttaagacccatgatgccagtaagcgcagctccgcgccccctggcgcagcgacagcccgttgccgactggcgttttgagtcgccgacaagcgccggaaatatcggctgcgactgggtgctctatggcgaagatttcccggatgtagcagacccgcaaaaagtcatgctggtggactggtggtggggaggcaatttactgcggggccgctatccgatcgaccgcgatgcgggacgcctgaaatggtggcggaaaaaaagccgtgaagggacattgccgccggtactggtctggtacattgccgggctggcctcctttgtgatcctcgacggacattatcgcctgcaggcagcaatcgatgagggcattgcccctgaatttgtggtgctcagtgaactgaatgagcggacgtttacgccggatccgggccagcaggcgcgggtcgttaaggcattagagatgcagcagcagcgtaatccggggtttaacgttgaggggatcaatcagaccttgattaacctttatgatacccgctatctgtacgcgtccacccacagtcgggcgatcctcggcgagggcacgggctgggcgcgggatttaaggaattatttgcaaaagcatcagttgagtgaatatctgggacgcatcatggcacgggtgagtgaataataaattttgtatccattgtgacgcgcaggaaggctttggcatgttacacatgagcaatgcgttgcccggcggcgcaagcttgccgggcctacaaattagtccgcagaccggataagcccgtaggccgggtaaaacggtaggccgggtaagacgccgtcgccacccggcgaaacagaaaagcaaaaaaaacgccaccggacggtggcgttggggattacggaaaaaggatcacagcagttcgaactcgccctgcttcacgcgggcggaatcggtgccgataaagacgttaaatttgcccggctccgcatcgtatttcatctgctggttccagaacttcagcgcctcaatatcgatcgggaagctgacggtctgggtctcacccggtttcagggtgattttttcaaagcccttcagctgtttcaccggacggctcatcgaggcggtcacgtcctgcagatacatttgcagtaccgttgcgccttcgcgtttgccggtattagtcacctcaacgcttgccgtcaccgtgccgtcacgcttcatggttggcgcagacagtttcacatcagacacgctgaacgtggtgtagctcaggccatagccaaacggatacagcgggccgttcgcttcgtcgaagtagcgcgaggtgtacttgttcggcttatcagcgttatacggacgaccggtgttcaggtggctgtagtagaccgggatctgcccgacagagcgcgggaaggacatcggcagcttgccggacgggttgtaatcgccaaacagcacatcggcgatagcgtttccgccttcggtgcccgcaaaccaggtttcgaggatcgcatccgcctgctgatcttctttcaccagcgccagcggacgaccattcatcagcaccagcaccagcggtttaccggtggcttttagcgccgcgatcagattgcgctggctttgcggcagggtgagatcggtacggctggaggcttcatgggccataccctgggcttcgccgaccacggccaccaccacgtcagactgattcgccacttttaccgcttcgtcgatcatcgcctgcggcgtgcgttcatccacctgcaccgccggttcgtactggtttaagaaggtgacaatgtctttgtcatcggtgatattcgcgcctttcgcgactatcactttgccctggtcgccgatggcgtttttaatgccggtcagcacggtcacggactgatccgccacccctgccgccgaccagctacccatcacgtcgcgcttgctgtcagccagcgggcccaccaccgcgatggtggcattctttttcagcggcagcgtatcaagacggtttttcagcagcaccaggctttcgcgcgccacttcacgggcttctttacgatgcagacggctttcggcgttggtgtcctgcggatcggtctctttcgcgcccaggtggctgtacggatcgttaaacaaccccatatcatatttcacgttcagcacgtgacgggtggcgtcatccagttcagccatggtcactttgccgtttttgatcagatccggcaggtatttgctgtaatactcatcggccatgctcatatcgacgccggatttcagcgccacgcgcacggcgtctgccggatcggcggcggtaccgtgtttaatcagctctttgatcgcgccgtggtcagaaatggtgatgcctttaaagccccactccttgcgcagcagatcttttaacagccagggatcggaggccgcaggggtgccgttaagggagttcagggcgatcatcaccccgccgctgcccgcgtccagcgccgctttgtacggcggcatgtagtcgttgaacagacgctgcgagctcatgtcgacgctgttgtactctttaccgccttccaccgcgccgtaagcggcgaagtgtttcacgctggtcattaccgaatagcgatccgccgggcttttaccctgcatggattccaccatggttttacccatgctggcggtcaggtaagtatcttccccgaagccttcggaaccccggccccagcgcggatcgcgggagacgtcgaccatcggcgcccaggtcatgttcaggccatcgtcagcggcttcataagcggaaatgcggccgacggttttcaccgcctcaaggttaaaggaggacgcgagaccgaggctaatcgggaagacggtgcgctgaccgtgcaccacgtcgtaggcaaagaacagcgggattttcaggcggctgagctgcatcgcctgatcctgcatggcgcgaatgtcctggcgggtaacggtgttaaaaatcgccccgacctgacttgctttgatcatctcgcggatggcttctttcgggttatccggcccgacgctgataagacgtaactgaccgattttttcatcggtggtcattttgccgagtaattcggtgacaaaggcatcacgcgcttccggcgtaaggggatgattgccggtcgtttcttccgccagcgcgggttgcagcgccagactcacagcgacacctacagaacatagccatttcatgtcgtatatctctcgtaattacagccgtatcagcggcagagcgtgcgaaaaccgcagtgtgccataatcgtagtagctgttgcagggttattctcttatttttctgacgattacttccgcgtgatgtattttcccgcgctatgctttaaagcgtcaattttgccccgccacaaggagtggatcatgtctggtcatcatcctgataataacgctgcttttttgcaggaacttacccgcctcgtgggccacgcccatctgctgactgaaccggccaaaaccgcgcgctaccgtaaaggcttccgctcgggccagggcgatgcgctggccgtcgtcttccccggctcgctgctggaactgtggcatgtgctgagcgcctgcgtgcgcgccgataaaattattcttatgcaggcggcgaacaccggtcttaccgcaggatcaacgccggacggcaatgattacgaccgcgagatcgtcatcatcagcacgctgcgtctcgataagctgcacctgctggaaaaaggcgagcaggtgctggcgtatccgggcaccaccctttattcgctggaaaaagcgctcaaaccgctgggtcgtgaaccccactcggtgattggatcctcatgcataggcgcgtcggtcattggcggcatctgtaacaactccggcggctcgctggtacagcgcggcccggcctacaccgaaatgtcgctgtttgcgcgtattaatgaagacggccagttacagctggtgaaccatctggggatcgatctgggcagcacgccggagcagatcctcagcaagctggacgacgatcgcattaacgacgccgatgtgcgtcacgatggccgccacgcccacgatcacgactatattacccgcgtacgcgacatcacggctgacactccggcgcgctataacgccgatccggatcgcctgtttgaatcctccggctgcgcgggcaagctcgcggtctttgccgtgcgtctggacaccttcccggcggaaaaacgccagcaggtattttacatcggcaccaatcagccggaggtgctgacggagatccgccgacatattctggcgaacttcacccatctgccggtggcgggtgagtatatgcatcgcgatatttacgacatcgccgcgcgctacgggaaagacactttcctgatgatcgacaagctcggcaccgacaaaatgccgatgttcttcaccctgaaaggccgcaccgacgcgatgctggaaaaagtaccgctggtgaaaccgcactttaccgaccgggcgatgcagaagctgggcaatctgttcccgaaccatctgccgccgcgcatgaaaacctggcgggataagtacgaacatcatctgctgctgaaaatgtccggcgagggcattgcggaagcacagagctggctgaagtcctacttcgctgatgcagagggcgatttcttcgcctgtaccaccgaagaaggcaataaagccttcctgcaccgctttgcggcggcgggggcggcaatccgttatcaggcagtgcatgcggaggaagtggaagatattctggcgctggatattgccctgcggcgcaacgacgagcagtggtttgaaacgctgccgcctgaaatcgacagccagttagttcacaagctctattacgggcatttcatgtgctacgtcttccatcaggattacatcgtgaaaaaaggcgtcgatgcccatgcgctgaaagagcagatgctggcgctgttgcatgcgcgcggggcgcagtatccggcggaacataatgtcggtcacctgtacgaagcggcagaaagtttaaaacaattttatcgcagcaatgacccgacaaacagcatgaaccccggcatcggcaagacttcaaagctaaaaaactgggcgtaatgcaaaccgaaagcgtaaccgcatagcgcaagcccggcgctatgcattgcactgtgatgtatggggtattccgtgttcctttttcgtactagagtagcgctatgtcgccatagaaacgtttctatggcatgccattcaggagcctatgcccatgtctgttattgatgttttaacgggaattgaagtggaggttcgcgatgcacggcctgacgatgcccatgccgtagccgcgatctacgcctggcatgtgctccacgggcgtgcctcttttgaagaagtcccgcccaccgtcgatgagatgcgcgaacgcatcgaggcggtgaccgccgacgggctgccctggctgctggcgctctatcgcggcattgtggtcggctactgctacgccagaccttatcgtccgcgccacgcctaccgtttcactattgaagaatccatttatgtggacgccagcatgaccggtcacggcattggcggcgcgctgatggatgcgctgatcgcgcgctgcgaagaaggcccgtggcggcagatgatcgccattgtcggcgacggccataataatgccggttccctgcgcctgcatgaaaaacacggctttaccgtggcaggccagctgcgcagcgtcggctataagaaaggtgactggcgggatacgttgattatgcagcgcccgctcaacgacggtgactggacgctgccggaataattaatcgttctgcgcggtttgctcgcctgcggcactgccgccgctgctgaccatttgcgccgctttctggcgcttataggccagcgccgccgccggtacaggctgcgctttaccggtttcgatccaggtgcgcagacggctggcatccgcaaagtgggtgtatttgccgaaggcatccatcaccaccagcgccacggatttgccgttaatcaccgtacgcatcaccaggcaatgacccgccgcattggtgaagccggttttggtcagctgaatattccagttatcgcggtataccagatggttggtattacggaacggcagcgtgtaggccgggctgctgaaggtcgccatctcttcccgcgtggtgcttaactgaccgagcagcggatactgtttggtcgccaccagcaagcgcgtcagatcccgcgccgtagagacattatggatcgacagccccgtcggctccacaaagcgcgtgttacgcattcccagggctttggctttggcgttcatcgcgcggataaaggcgtcatagccccccggataatggtgcgccaggctcgccgccgcgcggttctccgaggacatcaacgccagcagcagcatattcttacggctgatttcactgtttaagcgcacgcgggaatagatacctttcatctccggcgtatggctgatatccactttcagtttttcatccagcggcaggctggcgtccagcaccaccatcgccgtcatcagcttggtaatggacgcgatcggacgcaccagatcggggtgactggaatagatcacctcattggttttcagatcgacaatcatcgcgctgccggaggcaatttcgggctgggcagaagtcgcgactgcggaggttttcgccagcgcctgtggcatgacaggcacgctcagtaataacgcaaggcttaataaggaaacacggaatttcagcatggtgaggcttctgataattattcacgcacgtaataacgcgcaccgctaatgtcggcaattaaaaaataacaaaagctggctaaggcatgatagccgcccgttcgggttgtcgccacagaagaatcgttgcataaggttgcattgctggcattcacgccagcaatgcaattagctcagaacagccggtaaccgtagccccagaggatcaccgtcagcgccagcagcacttccagcaccagcacgccgatggcgagggtcgaaccggaaaagtttaggctttcttcacgattgatattgaggaaggtgggaatgccgacataaagcagataaccggtccacaacagcgccgcggtgcccaccagcgcgcacagccagaccagcggataaagcgcgacgataccgcttaaaaacagcggcgtggcgacataaccggcaaacaccatacagcgcgccagcgacggacgctgcggtatgttacgcgccatccagtaaatcacccggcccatcaccgccacccctgccagcatcagggcgtaaaacagaacgcccagataaaagccggtgaacagcgagagttgcatgacgttgccatcgccaaagtcccagccgatctgcgtggtgccgataaaggcgcagatcaccggaatggcggccatcagtaaaacgtggtgcgtatagtggtgcgaaaccgtttcgttttcgcgtttaattacctgcatttcacgatcgggatgggaaaagagtccccagacatggttcataacgcccccttgcagtcagccgaacgtcgaccctgtaagtataatgcatgaattggttattttttgagcgaaacgataagtctgataaatagtcagtcaacggacgttgcgatccggttcgcgtttgagggtgtatgctttaaaaaatggatgtaaacaatgagttgaatttgtcgtggatataaacggtctgatagcccagtacggctatgcggcgctggtgatcggcagcgtggcggaaggtgaaaccattaccctgctcggcggcgtggcggcccatcagggtttgcttcgtttctggctggtggtggcggcggtggcgctcggcggtatgattggcgaccagctgttgtacctgctcgggcggcgttacggcgagcgcattctgcgacgcttttcccgtcaccagaagaaaatcacccgcgcgcagaaactgatccagcggcggccttatctctttgtgatcggcacgcgctttatgtacggttttcgcattatcggcccgctactgattggcgcgagccgcctgccgccaaaagtctttctgccgctgaatattctgggggccattgtctgggcgctgattttcaccaccctgggctatgtgggcggcgaggtgataggaccctggctgcaccatctggatcagcatctgaagcatggggtgtggatcgttctggcgctggcgattgccctggcgctgcgttactggtttacccgccgtcgcgataaggacgacgaataagccgggctacggcccggcctgtaaagcttattttgcgttgaactgcgggttcgccagcataaagccgccatcgacgataaacgactggccggtggtgtagctcgactcttccgagcacagccagcccaccaggcttgcgatctcctgggttttaccagggcgggtcagggggacaatcggcagcgagccgtctttggcgtcttcgtcgtccatatcgttcattggcgtggcgatagcgccaggggcgacggcattaaccagaatacggtgatccaccagctccagcgccatggatttggtcagcccgcccagtgcatgtttggcggcggtgtaggcgctggcttccggcagcggggtgtgttcatgcactgaagtgatattcacgatgcgcccgccctgtccctgctccgccattttgcgcgcggcgatttgcgagcacagaaacgcgccatcgacatcaacggtaaacaccttacgccagtcgtcaaacgccacttcaaggaagggcgctttactcatcgccccggcgttattcaccagcgcatcaatacgaccgaaacgttcgatcagcgtgttgatggcctctgcaccttccggcaggtttcccagatcaaggtgcacatgttctgcgcgtcgccccagcgcctccacttccttagcggtggctttggcgccttcctcatcggaatgccaggtaataccaatatcgaagccctgcttagccagcaccagcgcgcactgtttgccgatacctgaatctgacgccgtaacgatggcaactttattcgtcgaaaccatgtagaactcctccgggaaatgagcctttagcggcaaagaggtaagtataggtaattcacgagggttaacaggctgatgcagaaacgatcttcgcgatcgaccaggcaaagctgccaatgtgtgcctaaacttattcgtgcaggcatatgactcttaaaaggaaaggacgatgaaaattttactatgggcggttttgattatttttctgattgggctgttggtggtgaccggcgtgtttaaaatgattttctgaaaattgcccccgttatgggggcaagtcatttataaagctactgaatctatcgccgccgcaatggcggccgaatgtttcaggatgcgcacctgttcaaagagcgcggtggcttcagcatattctttacgtaaatatcctaaccactgcttgatacgcgccacgtgatacagcccggtatcgccctgcttctcaagctggctgtagcgctgcaacagttgcaccacttccggccacggcatgcgcggcgcgttgtatttcaccacccggcttaagttcggcacattgagcgccccgcggccaatcatcaccgcatcgcagcccgttgccgccatgcaatcctgcgcgctttgccagtcccagatctcaccgttagccaccaccgggatggtcaggcgtttgcggatctcgccaatcgccgcccagttgatgcgctcggctttgtagccgtcttctttggtacggccatgcaccaccagctcgctggcccctgcctgctgcacggcatcggcgatttcaaactgtttatcgccggaatcccagccgagacggatttttaccgtcatcggcagatgcgcaggcaccgcttcgcgcatcgcttttgcgccccggtaaatgaggtcaggatctttcagtaaggtggccccgccgccgctgccgttcaccagccgcgacgggcagccgcagttgagatcgacgccccaggagcccagttcgacggcgcgggcggcgttttccgccagccattgcgggtattgtcccagtaactgcacgcgcaccggcgtgccgctgggggtacggctttgatgctgtaattccggacagattttatagaaggattttaccggcagtagctgatcgaccacgcgcaaaaattcggtgatgcagtgatcgtaatcgttcacgctggtcagcagctcacgcaccagcgaatcgagcacgccttccatcggagccagtaatacacgcataacaatacccaataattaagaggcgcgtatggtagcgtctctgtggcggggaggaaagaggccagccgccggagggcgggcggttttacgcctaatcttgtgtgaatgcataacgttaatctcaggattctttgttatgctcggctgcatgttgtgatcggtagcacatttcagattttaattgtatgatgaatgcatctcgtcaagggtagtcaccatgaataaatcactcattgttgtctggcaatatctgcgtgcgtttgtcctgatttatgcctgtctgtacgcgggtatctttatcgcctcgctgctgccgatcaccattccgggcagcattatcggcatgctgattatgttcctgctgctggcgctgcaaattctgccggcaaaatgggtgaaccccggctgctatgtattgatccgctatatggcgctgctgttcgtgcccattggcgtcggcgtgatgcaatattatgacgtgctgatcgcccagttcgggccggtagtggtctcctgcgccgtcagtacgctggtggtatttctggtggtcagctggagttcgcacattgtgcacggcgaacgcaaaatcgtcggtgagaaggagcagaaacaatgatggcttcgatctggtggtctttgccgctcacgctggcggtattcttcgcggcgcgcaaactggcgacccgttttcgtatcccgttactgaacccgctgctggtttccatggtggtgatcatcccttttctgctgctgaccggcattccttatgagcgttactttcagggcagtaaaattctcaacgatctgctgcaaccggcggtggtggcgctggcgtatcccttatacgaacagctgcatcagatccgcgcccgctggaaatccatcatcaccatctgttttgtcggcagcctggtggcgatgatcaccgggacatctattgcgctgctgatgggagcgacgccggaaatcgccgcctccatcctgccgaaatccgtgaccacgcccattgccatggcggtaggcggcagcctcggcggtattcccgccatcagcgccatgtgcgtgatttttgtcggtattctgggcgcggtgttcggccataccctgcttaatgtgatgcgtattcgcaccaaagcatcgcgcggcctggcgatgggtaccgcctcgcacgcgctgggcactgcccgctgcgccgagctggattatcaggagggcgcgttcagttcgctggcgctggtgatctgcggcattatcacctcgctgctggccccctttgtcttcccgctgatccttgcggtgatgggctaaaatttgcgatgcgtcgcgcatttttcatttgaatttcataagttgcatatacagtgtgatatgaatcacatataaaggcctgaccggcccgtaaactacgctcccattacactgttatgaggcaatgccatgcattcacgttttcacgctgctttcgcaagtctcgcggcggatctgcaatccgcgctggcgccggttctggcggatgagcacttccctgccctgctgaccgcggagcaggtcgccatgcttaaaaacgcaacgcgactggacgaagacgcactggctttcgcgctgttacccctcgccgcggcctgcgcacgcacgccggtgtcgcattttaacgtcggcgctattgcccgcggcgtcagcggcacctggtattttggcggcaatatggaatttatcggcgcgaccatgcagcaaacggtgcatgccgagcagagcgccatcagccatgcctggctgcgcggcgaaaaatctctcgcgtctgtcaccgttaactacaccccttgcggtcactgccgtcagtttatgaacgagctgaacagcggtctgtcactgcgtattaacctgccggggcgcgatccccatacgctggccgattacctgccggatgccttcgggccgaaggatctggagattaaaacgctgctgatggacgaagaaaatcacggctttgccgttaccggcgatgcgctgacgcaggcagccattactgcggcgaaccagagtcatgcgccttacagtcaggctccggccgggctggcgctggagtgtcgcgacggcacggtattctccggccgttacgccgagaacgccgcctttaacccgtcgctgccgccgttgcagggcgcgctgaacctgctcagcctgaatggttatgattacccggacattcagcgcgcggtgctggccgaaaaagccgatgcgaccctgacccagtgggacgccaccgccgccacgctgaaagccctgggctgccagaatatcgatcgcgtactgctggcctgatcccctttactgcggacgttcgcgtccgcagtgatgaaaatcttcgcaatcgaaccgccgtttcttgcgcaaaaccggcgcgtaaagtagcctgagtgaaatttcttcctttactgagctatctgcatgttgaagcgtttgttttacagcctgttagtcctcatcggcttgctgctgtttactgcgcttggactggaccgctggatcagctggaaaactgcgccttatatctacgacgatttgcaggatttgccctaccgacaggtgggggtggtgctcggtaccgccaaatattaccgcaccggcgtcatcaatcagtattaccgttaccgcattcagggagcgctcaacgcctataacagcggcaaggtgaattacctgttgctgagcggcgataacgcccagcagagctacaacgagccggtgaccatgcgtaaggatttgattgccggtggcgtcgatccgcaggatatcgtgctggattacgcgggcttccgtacgctggattccattgtgcgcacgcgtaaagtcttcgataccaacgactttattattatcacccagcgttttcactgcgagcgggcgctgtttatcgccctgcatatggggatccaggcgcagtgttatgccgtgccgtcgccgaaagatatgctgaccgtgcgcatccgtgaatttggcgcgcggctcggcgcgctggcggatctgtatgtcttcaaacgcgagccgcgtttccttgggccgctggtgcctattccgaacgtcagtgaaactactgacgacgcgcagggctatccggcggtgacgccggagcagctcagtgagcagctgagcaagcctaaaggccgttaggccgagatattatcggcccactcaatcgactgctgcatcgccccgataaccgtcgcctgatccagcttaaagctgtccagcagcgcgccggcgttatcccagtcctgttcctcgtaaagacgggccagcgtcaggaattgccagatcaccccttcgtgcttcgttaacgcgttcatgacgttctccggcagcagaatttgccggaacagatcttccatggaaatgcccagaatggtgtcgagcagcgagaacaggccgcagaaaaaggcatcgcccgaaagccgcgcgttgccggtttctttcgccatcagttcacagaacatgccgcgcaccaggctcatatgatagagctggtcggttttcacatccgccatattggtcaggcaggaaatggagacaaagcgccgcacttcgttaatgcctaaataaagcagcgtatccctgagggtggcgtttttacccagtacaatgccgcggtttttaaacagcacatttttggtgtaacgcatcagggtataggagagggtcaaatcacgcttgaggtaattctcaactttgaacatatcaggattaggggtgttcacttcctgaataagctgaagctgtaataccttaccgggggccaggcgcttgtttttgataatttccggcttactgtagaaataaccctgatataagtgaaaaccgaaggctttgtagcgttcaaattcctcggcggtttcgactttttccgccagcaattttaccttactgaggtgtttcttatgctggttgatgtactgggtaatttcttcaaaggagtaagcgcggatgtcgaacttcacaatgctgatgtacggcataaagcgttcccagccgttctccagcgtaaagtcatccagcgcaatcttgaagccccagccaaacagacgacgcaccgcgtcaaagagctcatcggtgggttttgccgtttcgaggatttcgatcaccactttgtcatgaggcagcgtatccgcaaagccctggacgatcatctccggcgggaaattgataaaacagttattattgccgaccagcttgggtagtgaggtcgagagaaacagatcggagatgatctgtctggtggcgtattccggcgagacatccggaaaccgattcgtcatgccgtcgcgaaagagcaactcataggcgaccgtcgacatgttcttgtcaaataccggttgccgggcgatgaatgaatacatgagattgcctccatggcgtatacgcattgacggaaatgaatgtcgcgatccgccctcttaaaacctgttttatcttataccatgatttggcaatttattcccggcacgcacggtgaccagctttaatagtaatagcatagtctggcagctttaaacgcgcctcgttaaacatctcacctatactgatggcaggatttacaaaacatgacgaattagtacgttttccattttgcatggagaggctatgaaaatcaggtcatcatcttccacacccccttcccattcacaacccgtatcggaaaatgcgttctggctgaattttgaagcgaatgcccgacgctacggcttttttctgctgctgttaatcgtcatcgcggcgctgtgcggcgcgttttctaagggctggctcagccaccagcaacgtaccacggcggacggcggcctgacgctggagtatgagcgctttaaccggctgatgagcgatgcggaaatgaaaattgtcgtccatgcaggcacccgtaaagaggtcactgtggtgctgggaggggattttatggaaaccttccagattaccaccctccagccgcagcccgatcgtatgcaggcgcagaacaaccggctggtgctgagctggtcacgcgacgcgcttccggcagaccatgccatctggctgggcgtgcagcctttgcagtggggccaaagccaaagcacggtagctgtggatcaggggccctctctccccttctggcaatttatttacccgtaggagcttgtcatggatatggttttaagagcgattgctatctatctgatcctggtggtggtcttcaagatcgccggacggcgggcgctgctgcaaatgacctcgtttgatttgattttactgctcatcatcagcgaagcgacccagcaggcgctgctcggtaatgacttttccgtgactggggcggccctgaccatcattacgctggtggtggtggacattctgtttggcttactgaaaaaatatctgccgtccgtggaagcggctattgacggtacgccggtgatcctcgtcgaaaacgggcgactgctggaagcgaaaatgaagaaagcagatatttcctgtgctgatattatagtgtccgcccgcaataaccacggcattgataagttgtcggatattaaattcgctattcttgaacaaaacgggcacatctcgattattccgctgtcagagtcttcataaaggccgacaggcacatcttaaggttaccttaagctgataagcactatacttactgaggctttaacattatttttacactgagccagcaagaaggggcctcaccattgacagaatagccaaaatcgcactgcgtcgccggggcattggcgtaagagaaaaaattgttcgctatcgcggtcagtcggtcttattccggctgaacggcgaggcgtatgatgtgtataccaacgaagaaaagatcgcttctcttgaaaccaataatattaacgaagccatccagctgtataaaattttagaagcgaaacattaagttgccgggtggcggttaattgcaggcccggcaaacagagccataaaaaaacccacgctaacgtgggttttttgtttaagccggtacttattttttgcgcgcgtacttcagggagtccagcgccacggcgaagatgatgatgccgcctttaataatgtactgccagtacgggttcacgccgatataggtcaggccatagttgatgacggtaaagatgatcacaccggtcaccacgccaaacaccgtacccacgccgccgctgaaggagacgccgcccaccacgcaggctgcgatggcgtccagctcatacataaagccgaggttgttggttgcagagccgatacgccccgcttccagcatcccgccgaaggcgtagaacacgccggacagggcatagatcatcagcaggttcagcgccacgttcacgccggagacttttgccgcttccgggttgccgccgatagcaaaaatgtttttgccgaagcgggttttgttccacagcacccagacgaaggccacggcgatcagcgcgtagaaggtgatgtaggacagacggaaggtgccgagcgccacaaagccctgggtaaaggtcgagaagccgctgtcaaagccggaaatcggcgacgcgcccacgaagtcgtagtacagggagttgatgccgtacacgatgatcatggtgccgagggtggtgataaacggcgttacgttcaggtacgcaatgataatgccgttgataaggccgatgatcgcgccaatcacgcagacgatagccacaacagcaataatcggcatggtcgccatttccgggaacaccttgttggcgttctccatcgactgcaacagcgtcgccgcgaccaccgccgccagaccgacctgacgaccagccgacaggtcagtaccctgggtgacgatcagccctgccacgcccagcgcgatgataatacgcactgaggactgggtaagaatgttacttaagttcagcaggcttaagaaggttggatcctggaaaataataatggccagtaacactaaaagaacgacgtaaataccgccctctttcagataagtgagaaagctttttttatttaacgcactcatgaggagcccctgatcttaaaggtgcaaagacgcaagacgcaaaatttcgttttgcgttgtcgttttagtgtcaacaattccggaaacgaggccattgctcattaccagaatacggtcagtgatccctaacaattccggcatttcagacgaaatgataatgatccctttgcctttcttagccagctctgcaatcaactggtaaatttcaaatttcgcacctacgtcgataccgcgcgtcggttcatcgagcatcaggatttccggctgggtcagcaaccagcggccgataatgactttctgctggttaccaccggagagggaaccaatctgcgtgcgatgacccggcgttttaacgcgcatggcgtcaattacccactgggtatcgctcttcatgcgggagttatccagcagaccgactttgtttttgtagttctgaatattggaaataagtgagttaaatccaatgtccagataggcgtaaatgcccgttgagcggcgctcttccgtcaccagcgcaaagccgttattaatggcttcgttagcggtgtggttattaatcggcttatcgtgcagcttaatggtaccggatgatttttcgcggataccaaacagggtttccacaatatcggtacgcttcgcccccaccagcccggcaataccgaggatttcgcctttacgcagatcgaaagagacatcgcgaatggaaggctgccgcagtgaggtcaggttgcgcacttccagaatggtttcgccagggacgttttgtttgtccgggaaacgctggttcagcgagcggcccaccatcatggcgatgatcttgtccatatccagcccttccagcggctgggtggcaatccactgtccgtcgcgcagaatggtgatttcatcacacagctggaagatctcttccattttgtgcgagatatagacgatgccgcagccgcgatctttcagcttgcggataattttgaacagatgattaacttctttttccgtcagcgatgaggtcggttcatccatgatgacgattttggcgtcataggagaacgctttagcgatctcaatcatctgcatttgcgaaacagataaggtaccgacgcgcgctttcgggtcaatatcaatatccagttcgtcgaaaatatctttggtgtctttatacattttgtcctgatcgacaaacacgcctttggtgggataacgccccagccacatgttgtccattacagaacgctgtaataccaggtttaattcctggtgaaccatagagataccgttttccagtgcttctttagttgaatggaaatcgatctctttcccctgaaaaagaatgctgccggaatctttttgatagatcccaaaaaggcattttaacaatgtggatttgcccgccccgttctcacccattaatgcatggatggaatgtggacgaacttttaaattcacattatcgagcgccttaacgccaggaaacgacttgttgataccgctcatttccaacaagaattcgcctgacgactgagtagtattgctgaccatatttataccttgttggcctggcacatcgcgttataaaagggcgcaaattaatgcgcccagtggaaccttcttatttgttgctgaactgagagaggttttctttatcaacaccaacgtaaggaatacggacaactttattgtcgagtttccagttggtgccggcagtggcttctttaccgtcggccaggtttttcgccagatcgaaggtggctttcgcctggttgttggcatcgttcagaacggtaccggccagcgcgccagatttaaccagtgccagcgcttctggcagggcatccacgccaaataccggcactgctgatttgttgtgggctttcagcgcttctaccgcgcccattgccatcgcatcgttgttggcgataaccacttcgattttgttagcgttcgggccagagagccacgcgtccattttgtctttcgccattgcggtatcccacatggcggtatccatttgcagctgctgggttttgatgcccttgtcattcagctctttgataacgtaagtggtacgtgcttcagcatccgggtggcccggctcgcctttcagcagcacgaactggatctggccgtctttgttcagatcccagccctggttagccgcccagtgtttggcaatcagatcgccctggataataccggactctttagagtcagtaccgacgtaataagctttgtcgtagctgtccagcgctttacgtgaaggttctttgttgtagaaaacgataggaacgttttgaccacgtgctttttcgataaccgtgcccgccgctgccgggtcaaccaggttaatagccagggctttcacgccttttgccagcagaacgtcgatctggtcgttctgtttggactggtcgttctgcgagtcgttcatcagcagttcaacgccctgcgcttctttagcatctttctcaattgctttacgtacaacagacatgaagttgtcgtcgtatttataaatggtcacaccaatgcgggtatccgcagcatttgcagccgcgccaaaaagcatgcttgccataacagcagacagagtcaaaaccttcttattcatggtatctccgggtttatgcagggtagttcttgtgaataatgatcggcaggacagcaggttggtgaaacgttactgtcgccgaaggtcacttaaaattattttcttccgtgttcggtaacgctccagaattcgaacggttcgtcgttttggggccacggtacgacgaattagcttcattaccgttacatgatgtttcagcccctggaacgctgacatcatagacatggcgatgttaagatactgtgaatttactcacagattgaaaacggttacatacaacatcgttataagttagtgatcggcgacacagtttgccgcaccgccacggaatgacggcgtaccagcgtgggcataaagcaatgagaatcagcaggatccagcattcccgccgcgccctgcagggccagctccgtcgccagtttcgccatagaggctatcggataacgcaccgtggtgagctgcggatcggtgtagcgggcaatgggaatatcatcgaagccaatgagtgataaatgctgcggcaccgcaatgccattatctttcagcgccgtcagcgccccggcggccatgctgtcgttataggcaaaaacggcggtgagttgcaggttgcggcccagcagttccaccatcgccgcctccccgccctgcatgtccggctcgccggtgccgatccagttctccggggccacaatcccctgctctgccagcgcccgctgccagccttcacgacgtaagtcgttgtcttcaatctgatgtctggacgccagatagccgatgcgctgatgaccctggctcagcatcatgcgcgtggccatcatcgccccgctgacgttatccagcgccacgcagcgatgggcatagcccggcaccacgcggttgattaataccataccggggatctgctccataaaaccggccagctcttcatcacttaaggcttttgagtgcacaatcagggcgttacagcgctgacgtatcagcacctcaatggcatgacgctctttttcagcttcatgataactgttgccgatcagcacatatttttgatgctgttgggcgaccatatccaccgctttgaccagcgcgccgaagaaggcatcggagacatccatcaccaccacgccaatggtatcgctgacctgcgtcgccagcgcctgggcgttggcattcgggcgatagcccagctgcgccacggctttcatgacggtttcacgcgtatcagggctgaccagcgcgctgttattcagcacacgggaaaccgtcgcgacggaaacggccgcaaggcgggccacgtcacgaatggtgatcatagatattttcctttctcaggttgcaacagctcacagacaccccctgtgttaagcaagggggtattctgtcaggcagagcggacaaccagcgtgaaggacatcacacagatggaaacggttacatccgttttgttaatgattgtgatccagatcgttatctggatgtatgggacaatgaaacgcctgacgcccgcgcggtaagctgacgccacagccattccaccggtccctgacggaagcggcgcaaccagcagaccgagagcaacagattaacggcccagatgaatggcacaaaggccagcagttgcagacggtcaaatttcataaacagccccagctgataaaacagcgtggtgcatatcaaagtttgcagcagatagttagtgagcgccatgcggccgacgcaggccaccgcatgcaccagcttcaggcggcttaactgcggccagtagccataggccagcgcagcataccccagggtttgcagcggcgcgctcagttcgcgtggtacctgcagaaagaaggcgcaccagcgataatcccagccgagctgccactggacgagggttgacggaaggttgatcaacaggccgaccgcaatcaataccagggcggtgcggcgataatgacgcaggctgaactgcccttttaaccagccgctgcgcatcagcgccgcgcccaccagcatcagccccgccagctgccagccatactgcgcgccgatggcgagcagcgtgtcggacagcatatccgcccggttgccgatagcttccagaccgccggtggttttccaccaggcttcatattgcaggttagccgcatcggggatccaggcgcggttcggctcattgccggcgataaatcccagcagcaacagcaccgcaataccgatgagatagagcgccacgccggtgttaaacagcgttttcagggatgccgcatcgcgtatcatgcgccagcacaccagcccgaccaggccataggcgagcaaaatatccccgtcccagaacagcagcccgtggataaatcccagcagcaccagcagcgttaagcgacactggatccagcgcttgccccgcccctgcaacagttgcagcccggcgccgaacagaatggcaaataaagagaggaatttcgcctgcgcgaagatgtccagcagtgcccaggtccaggcgtcccgcgaggtgatctcgccataccaggccgcattcagataagccgcctttggtaaaccaaaggcgttaatattcagcagtaaaatacccagaatggcaacgccacgaatgaaatccagcgtgacatgacgttccatggggtttgcctgcctcaattattgtgatgacgcacagcgcgcaggaactcctggcgggtgttctggctggatttgaataacccgcccagcgaggtggtggtagtggcgctggtggcatcgcgaatgccgcgcgctttaacgcagtaatgcaccgcatcaatagacacagccacattgttggtgccaagcagcgtttgcagggcgatgaggatctgctgggttaagcgctcctgcacctgcggacgttgggcaaaaaactgcacaatgcggttaattttggacaggccgatcaccgcatctttcgggatataggccacggtcgctttgccgtcgatgatcacaaaatggtgctcgcaggtgctggtcagcgtgatgtcacgcaccgtcaccatctcgtcgactttcattttgttttcaataacggtgatcttcgggaaattggcgtaatcgaggccggagaagatctcatcgacgtacattttggcgatacgctgcggggtttccatcaggctgtcgtcgctcagatcgagatttaacagttgcatgatctcggtcatatgcccggcaatcaggcgtttacgggtttcgttgtccaggtcggccggtgcgcgcagcggggtttccaggccgcgggcgacaagggcttcatgaaccagcgcggcttctttactcagtgatggcatctctttattctcctgcaggtgtcgctacctttgccgctcagcaggcaaagtgcgcagtcattgtgcgtgaggtcacgcacataatccagtgtattcaccgcgataattagtgaaatcgttacggcctttcatgctgacgtttccacaccagcccgccgccgataaacagcgccgcccccgccaggccaagggcaggctccagctgatgcgtcagccaggtggagagcgcagaggtcatcgggccgaccagttgtccgatggcgtaaccggtggtcagcagcccggccatatagcgcgcatgggccggagccagttcacgaccacagaccagcgacagctgcaccgcgcagagaaaaccgccgcccaccagcagcgccccgctcaccagccccgccatacccggcagcagccaggcggcaatcacgcccgcgccctgtaaccacagcaccaccgccagacgctgatggctgtgtccgacatgacgtaaggcgatgctgagcgcaatgccgatcaccgccgccgcgccgaacaccggccagacaaactgggcgaagacgctgccggggaagcgctgcgccgccatctgcgataaaaaggtagccggaaggatgtagccaaagcccgcgagactgtagctccagaccagccgtttaatatcggcggtgagctgtaacggctgcggtttgtcgccgctgcggtgtaactgtcccggtcgcggcagccagcgggcgatgaacgcgatcaataccagcgccagcacgccgtacacctgccagcccgctgaggcggacagcgcctttgactggatgccgatggccagcagaccgctcagggcgatacctgcccccggcccggcaaacaccgccgcgttcaggcccggtttgcccgcatgggccagctggtcggtgatccaggctgcggtcagcaccatcgcccagccgctcatcatgccgatcaccagccgcagcagaccgtgtgcaatggcggtatccgccagcgcggaaagaaaagtcagcgccaccgccccgaacacaccggcatacagacggctttccacgtgccggtgcgcgcgcatggcatcccatgcgccaagcagataaccgagatagttcatggcggccaccagcccggcgctggtcagactgagctgaccgtcgcggatcattagcggtacctgcggcgtaaaggcgaagcggccaattcccatcgccacaatcagcaccacaaatccactgagcgcaattctgagcgccatggttatcccgtaagttaatgtaaagttgtgtttatgatgcaatatgttgcagggatgcggaagtgaaagttactcacagcaaagtgaatgcctgtatgatgatgccttcattctgagtatgacgagtagaggaacttcgcatggaaatgcttgaagaacatcgttgttttgacggctggcagcagcgctggcgtcatcactccgccgtactgaactgtacgatgacgttcagcgtgtttttaccgcctgaacgccgggaaacgccgccgccggtgctctactggctctccggcctgacctgtaatgacgagaatttcaccaccaaagccggggcgcagcgcgtggcggcagagctggggattgtgctggtgatgccggataccagtccgcgcggcgaggatgttgccgacagcgagagctatgatctgggcaaaggcgcaggtttttatctgaacgccacgcagcagccgtgggcggcgcattaccggatgtatgattatctgcgtgatgagctgccggatcttatccgtgagcagttcaacgtcagcgatcgctgcgccatcagcggacattcgatgggcggtcacggggcgctgatcatggcgctgaaaaatccgggccgttataccagcgtgtcggcctttgcgcctattgtgaatccctgccaggtgccctgggggcagaaagccttcagcgcctatcttggggataatcctgccgactggcaggcgtgggacagctgtgcgctgatgctgaacagcaagccggatgatgcgatcccgacgcttatcgatcagggcgacagcgatcagtttctggccgatcagctacagcctgcccgccttgcggaagccgcccgtcagaccggctggccgctgaccctgcgcgtgcagccaggccacgatcatagctattactttattgcgtcctttattgaggatcatctgcgcttccatgcgcagcatttattgaagtgacgttttgcccggcggcgcaagcttgccgggcctacaaatctgtccgtaggccgggtaaggcgcagccgccacccggcacccggcacccggcacccccatcagaaccggtaatccaccgccataaagtaacgacgtccgtcttcgttatagctgtagtcgtcgcggctgagatctttatccatcaggttcagcacacccgcacgcagcttgacgtttttcgtcgcctgccacgcaccgccggtattccagatcacatagccgcccggcgtggtgccggtggcgctgatattgcgtttttcgccactgtaattcccggacacatagaatgaccagtcctgcaccggctgccagtccagggtaccattagccgtatggaacggcagctcctgcaacggcgtattgccgccgttactcagatcgcgcccgtcgttataggtgtaattcagcgtcagcttccactgatcgtcaaacggcactttcagctcggtttccaccccgcggatacgcgccttgttaacgttgtaatagcggaaaatcggttcaccatcggcattcagaccgacgtagttcgggtagccctgcgccgcgttgacgtcggccgtacggctgatgctgatacgatcttccacgtcattctggaaggtagtgatgctcgcctgcacgccttccagccagccctcttccccggcgtaatacagaccgaattcgtagctttcgctggtttccggcttcagatgcgggctgccgacgatttcgcacgcgccgcggcaggagccggtgacccagtccgggctgagctgtaacagcgatggcgctttgaaggctttcgcccagccgcctttcaccgtcagcgtgtcggtagcgttgtacaccagataagcacgcgggctccagtgatcgccataggtctcgtgatcgtccatacgcacgccggtggtcagcgccagcggctcaaggagacgccattcatcttcaacaaagagtgcgtactgactggtggaggtttcgctgctactgctgccggtaatgttgacgggatctttcagcttatcgtgccgccattcaccgccaaaggtgacgaactgattaatcgcctccaccggcagcacgtatttgccgtcgatggtgttgctttcagaggtgatggtgtggctgttgccggggtttttgttatcgactttctcgccgtaatatttcagctcgctgttacccagatcccagcgtccgttgtggctcagggagaagttctgccgctccaggcggttctggtcgagggagtcggagctgcgatcctggcggtcaaaaccataaccggcagtgaaatcgtgattgtcattcggcgtccaggcgaactccacgttcgcatcgcggctggtaaagccttcaattcgcggcgtttcgcctgtggcagccgtgtctgagggttccgctttatctttttcgcgtttcgccacgctgccgaacgctttcatgccgagcacgccgtcaatcagcgggccgctggtgaagaactgaccgttccaggtatcgccgcgatcgcgtttttcctgaatagtggtgtcggcggtgaggctaccggtccactgttgaccaatttttttggtgatgatgttgaccaccccgccgagggcatctgaaccatacagcgacgacatcggtccgcgtaccacttcgatgcgctcaatggcatccaccgggatccagttcaggtcgaaatcattgtgacggaatacggcgttgcgggaattcacgcgtttaccgtcgaccaggatcagcgtgtagctgctgtcgaggccgcgaatgctgacgcctttgcggttatcgccttcgttggtgagctgtacgccgggtacttcctgcagtacatctttgaggttctgtaccggcctgcgttgcagatcctgctgcgtgatcacgctgatgctggccggcgcgtctttcacattctgctcggtggcagcggcagtgaccaccatggtttcactggcaaaggctggcagcgcgagtgaaattgcggacgcacagagtcctccccgcacgacgggattcagggtaaacattccaaattctccatgaactaaatacagcaaataaaaaagaagttgctcacaatgcgcagattcccgcccgctacggtggcgaaggcggtgataataatgcaggtgacccgccgcgttacgccgggtttttatcattctgaaaacgagcgtaacgataatgcaaacaataacaattatcaattgaattgttaaaagttatgtcaatatgggagattaaggagaagggatagcaaagaaaaggccgggtggcgcaagccccacccggcctgataacatcgattacttcttaacgcgttccgggaattccatctcgcgatagctgacgaacttagtaccgcgactcagtttgtagccaaaccagatgatcaggaacagcggaataccgatataggtcgccgccacgccgccccagtcaatggtatctgacaggaaggcttcgtaattctgaccgagggtgatgataaggcacagcacaaaggcgaagattggccccaacgggaagaaaccggaacggtacggcagttcgctcagatcgcgcccctgcacctcatatccacgacggaagcggtaatggctgatggcaatgccgagccatgcgataaagccggtcatgccagaggtgttcagcagccacaggtaaacggtctggttaccaaacatggaggtcaggaaacagagtccggcgatcaccgtagtggcatagagcgcattacgcggcaccccgcccttcgacagcttgctgaaaatgcgcggcgctttgccgtcacaggccagggtatagagcatacgggttgacgcgtacatgccggagttacccgccgacagcaccgccgtcaggatcaccgcattcatgatcgccgccgccgacagcaggcccgcatgctggaacaccagggtgaacgggctgacgctgatgtctttcacatcgttacgcagcaggctcggatcggtgtacggaataatcaggctgatcaccagaatggcgaacacatagaacagcaggatacgccagaacacctgacgcaccgcgcgcgggatgttcttctcaggatcttcggattcaccggcggcaatgccgatcagttcggtgccctggaaggagaagccgacgatcatcgccacgccaatcatggcagcgaaaccgcccgcgaacggcgcttcgccgatgccccagttgctccagcccgcaggctctgcgccctggaagataccgaaaatcatcatcacgccgacaataataaagatgatgacggtggcgactttaattaaggagaaccagtattccgcttcgccgaagccttttaccgagatccagttgaggaggaaaatcacgcacaggaagagcgcgctccagatccagcctggcgtatccgggaaccaccagctcatcaccagctgcgccgccacaaggtcaacggcgatggtcaccgcccagttgtaccagtagttccagcccagcgcgaagccgaagccttcttcgacgtatttctggccgtaggtggcaaaagagccggaaaccggcatataggctgccagctcgcccagactggtcatcaggaaatagaccatcaggccgatcaaaatataggagaacagtgcgccgcccggccctgcctgggagatggtcgcgcctgatgcaacaaacaagcctgtgccgatagaaccgccaatggcgatcatcgtcaggtgacgcgccttgagttcacgacggagcgtgggcgcttgtgtggttttagattcggaaaccatgggaaaatgctgtccttccaaaaaatgaggccggattgtagcagaccagacggcatccttccggcacaaatgcgctgttataagagaccttcatgaccggccctggattataagtaaagcagtggatgggccgcttttcgataataaaatgcaatgacgctattcaccgcaataacgcaaaaaccgcttcagggcgctggagagatgtttttgccggtgatgaatacgccacagcgtgcgtaccaggcgcggcagcgggatcggcacttcaaccagcgagccggagtcgagctgctcggcgatcacccgccgggataaacagctgatgcccagcccgtggcgcaccgcatgtttaatggcttcggaattgcccagctccattgccagctgaaactgcggcaaatgtgacagcagcagataatccaccagctcgcgggtgccggagccgcgttcgcgcaggatccagggcgcggccgccagctgttccagcgtcacgtcatgctttaacaatggcgatgatggcgcggcaaagaccaccagctcgtcctcaagccagggttcggcgatgatttccgccgtgtggcatggcccttcgataagcccaatatccacgcgaaaatccgccacggcgttgatcacctcctggctgttaccgacgctcatctccagcggcagatcgggaaaatcacggcgatagcgggcgatcacttccgggagaatatagttgccgatggtgctgctggcagacacgcggatcgcgccgttatcctcgcggaacagctgctcgatctctgtggcctgctccagcagcgccagcgcacggggatacagcagccgtccgtgctcattgaccaccagccgtttgccgacgcgatcgaacagctgtacgccgagctgcccttccagatcgcttaacgccgcgctgaccgccgactgggataaggccagcatttgcgaggcctgggttgtcgagccacttttcagcacttccacaaatacggccagttgccgcaacgtaatatgcatggttcaccgcatccggtaaggcattgcttaccacttataaagattaattataaatatataatcaattttatttttaagccagcagcccttacgctttgtccacacaaaggagagaggttatgactgagcttaccttacacacgcattcttcatttcaacgttatgcgcccggccttgcgctgagcgcgctggtggcgggctttgccctgtgggttggcggcattccggccatcgcgggggccggattcagcgccctgacgctggcgatcctcgtcgggatgcttctcggcaacacgctttacccgcaggccgcgcaccattgtgataccggcgtgctgttcgcgaaacagcatttattacggctggggattattttgtacggcttccggctgaccttctcgcagatcgccgatgtcggcatcagcgggatcatcattgacgccctcaccctttccagcaccttcgcgctggcctgttttctgggacaaaaagttttcgggctggataaacagaccagctggctgataggcgcgggcagcagcatttgcggcgcggcggcagtgctggcaaccgaaccggtggtaaaagcgcaggccagtaaagttactgttgccgtggcgacggtggtcattttcgggacgctggcgatcttcctttatccggcggtctatccgctgctgaacacggttttcagcccggaagcctacggcgtttatatgggctcgaccatacatgaagtggcgcaggtggtggctgccggtcatgcggttggcccggaagccgaaaacgctgcggtgatcgcaaaaatgctgcgcgtgatgatgctggcccccttcctgatcctgctggcaatgcgcgtcaaacgcctcgctccggcagatgataaccagcgcagcaagatcaccatcccgtggttcgccgtgctgtttatcgtggtggcgggttttaactccttcagtctgttgcccgctgcgctggtgcaggcgctggtcacgctggataccgtactgctggccatggcgatggcagcgctcggcctgaccacccacgtcagcgccctaaaaagcgccggggtgaaacctctgctgatggcgctggcgctgtttgtctggctgattgtcggcggcgggatgattaacctggcggtggaggcgctgactaaataaattcctggtttggcgaaagggtgatgcatctccggatccgggacgggtgatgaggtaaaacatcaccctcttccacttacagggtaaaaaaaatgaaagggaatttttgcggtatcaataactttaagccaggccaaagaacgcgggatgcactggcggaagtggatcggatcacacgctcggcaaatatcctcacttatttactttccgccgtgccgctattccagtttttcgcggggcgcagtagctatctcggcagcagcgtttttagtagcagttataacatcagcacttatgactggagcaaacttgccaatgcgctttcgagcgtggataaggttaagcgagagcaacttgagatactcgcatggaatatgaaggaacagacatcctcggaagaaagcaagttttgggagtgtgtttataatgcgctttaaaagcagaaccgtgctctggttagcctgttgcctttatatatctccggtcttcggtggtttgtctcacattgaaaaactcactcaggaaacaaccactgcccggcaggtacttgaacaccaatacggactatgcagagcattgcgcgatcgcgaagtgaactattttgacttctggcttcaggcgcaacgccgggacgttaaagtcaaaatgctcagggagctttcggaaattgctttcaataactgtattaaaccgcagtccgatgcctatacccttatagttgtgcgccttgcggccatcagcaaagataaaagtaagctggaggagtggcttgatctctatcctgaagataatcgtgatgattttacgcaaaccgcgataccggaatatgtttacgagcagcagcttcagcggcttagtcagtcacccacctttcatttcccctttaatccaatggacgcatctaacaccattattcatggcgacgaaaaaaaattaatggaaaccctcagtgaaaccgttataagagaaccctatatccagggacttatcccgcccctgtaatggctgcggccctcacaaccataaccccccatgtaaaattcctgttaacccgttatcatagcgtttttgcccggccgggtttgccaggagtttttatgaaatacattggagcgcatgtcagcgccgcgggcggtgtcgccaatgccgcaatgcgagcggcggaaatcggggccacggcctttgcgctgttcaccaaaaatcagcgtcagtggcgcgccgcaccactgaccagcgacactattgatgactttaaagccgcctgcgaaaaatacggctacacctcagcgcagatcctgccgcacgacagctacctgatcaatctggggcatccggtgagtgaagcgctggaaaaatcccgcgaggcgtttcttgatgaagtgacccgctgccagcagctcggcctgagcctgctgaactttcaccccggcagtcatctgatgcagatcccggaagaggaatgcctggcgcgcatcgccgagtcgatcaatatcgtgctggataagacggaaggcgtcaccgcggtgatcgaaaacaccgccggtcagggcagtaatctgggctttaagtttgaacatctggcggcgatcatcgacggcgtggaagataaatcccgcgtcggcgtctgtattgatacctgccatgcctttgccgccggttacgatctgcgaagctttgcagagtgtgaaaaaaccttcacagaatttgagcgcattgtcggctttaaatatctgcgcggtatgcacctgaacgatgcgaaaagcgcgtttgccagccgcgttgaccgtcaccatagcctgggcgaaggcaatatcggtcatgaggcgtttcgctggatcatgcaggatgcgcgcttcgacggcatcccgatggtgctggaaaccgtcaaccctgatatctgggcagaagagatcgcctggctgaaagcgcagcagtatagcgaagtgaccgcataaaaaaaggacagcctgggctgtcctttttgcatacctcatcagggcgatgcaggccgggtaagctttgcgccacccggcaactcgtcctcaggcgactttctcagccaccaccgtttccggacgtttcaggaaggcgtaagccagaccagccagcagggtaccggcaataatcgccagcagataacccactaccggtgtgattgcgcccgggatcagcagtacgaacagaccgccgtgcggcgccatcagcttcgcgccaaccgccatcgagatagcgccggtcaccgcgccgcccacgatacagcatgggatcacgcgcatcggatcacgggccgcgaacgggatcgcgccttcagagataaagcacagaccgagcaccagcgcggctttgcccccttcctgctgacctttgtcgaactttttacgggcaatcagggtggccacacccatcgccagcggcggcaccataccggcggccataatggcagccataggcgcgtaagtctgggtactcagcaggcccacaccaaaggcgtatgccgctttgttcaccgggccgcccatatcggtacacatcataccgccgaggatcgcgcccagcagaaccgcgttagcggtgcccatggtttgcagccagtgggtcagacccgtcaggatgcccgcgaccggtttgccgatcaggtagatcatcgccaggccaaccaccaggctggagaacagcggaatgatcaggatcggtttcagcgcttccatgctcggcggcagcttcagtttctggctgatggctttcgccacataaccggcaataaagcctgcgatgataccgccaataaagccggagccggtgcttaccgccagcataccgccgatcagacccggcgtcaggcccggacggtcagcgatggagaacgcaatgtaacctgccagtaccggcaccatcagcgcgaaggctgaaccaccaccgatttgcatcagcgcggcggcaagggtatccggcgttttgaaggcttctataccaaacgcaaaggagagcgcgatacacagaccgcccgccactaccatcggcagcatgtaggacacgccggtcagcaggtgacgataagcaccgccgccctctttcttgccttcgcttgccgcctgcggtttacccgacggttgatacggcttcgcttccgcctgggctttatccagttcctgcgcggttttcttcagcgccagaccggtcgaggtgcggtacatcggcttaccagcgaatttcgccagatccacttcgatgtcggccgccacgatcaccagatccgcttccgccacttcttccggggtgatggcattgcccgcgcccacagagccgcgggtttccactttcacccaccagccgcgttttttggcttcggtttctatggcttccgccgccataaaggtgtgcgccacgcccgtcggacaggcggtaaccgccactacgcgcttcacgccgccggttgcagcgggtgcagcctcggccactggcgcgctgtacggcgcggcgtggtttttggcttcacttaaaaacagctccgggtgggccacggcgcgattgatatcgcccagccacacttttttgccgttcagcgcgctgtcgtccggcacgcgggttcctaatacaatagccagttctgcatcatgcggattgtcgatgatttcgacattggctttttgcgccgccactcccaacaaggttttcgccatgtaagcgcgggcctggccgagactggagtcaattatcagcagcgttttcattatgctctcctgctgttagttaaagggttttaagtcaacgcgcgccatcatcgcggccaactgggtacggtcggtaatgccgacgttgctctggctgacagccagggctgcgacggcggtagcaagacgtaatgtatgctcactggattcacgcatcagcaggccataaatcaggccgccaaccattgaatcccctgcgccaacggtgctgaccacttccattgacggcggtttggcgatccattcgccagaggcgttaacccacaacgccccttcagcgcccagagaaatcaccacatgggcgatgccctgctcacgaagtgcatgcgccgcttcgataacatctttcagttccggtaatttacgaccggcccagatttccagctcgcggcggtttggtttaaccagccagggcgcggctttcagaccggccaccagcgcttcgcggctgctgtcaaaaatgatgcacggacactggctgcgcaggcgcgtcatccagtcggtgaaggcttccgggctgacgccagccggcaggctgccgctcacgcaaaccatgtcgaactggcccagccagctcagggaatccgcaacgaaacgctcccagtccgccggggtgacatcaaagccggagaagttaaagtcggtcacttcgccgtctttttcggtcagcttgacgttgatacgcgtacggccctgcaccacctgaaaacggttggcgatacctaattcgctgaacaactgctgaaagccgtcctggttatctttaccgaggaagccgccaacggtgacatcgatgccaaggtctttcagcaccttagccacgttaatgcctttacctgccgcatgcagaccggtagtccgcaccaggttgacttcgccgcgctccacttccggggtgtaacccaccagatcgtaagccgggttaagagtgatagtcgcaacacgtctgctcattatgcgccctccccaagaccagccgcgatggcgtcgccaatcgctttcagcgcctgttcagcatcttcgccctgtgcggtaaagcgcaggcgatggccttttttcacgcccagcgccaccactttcatcaggctgcggccattggccggtttgccgctgccgtcgaggttggtgacggtcacgtcgcagttaaactgcttgatggtgttgaccagcatggtgcccggacgggcatgcagaccgtgttcgttacgcaccacgaactccgcgctcagcacgtcttccgccagcgcgtcgtcgctggtcagcagtgccagcagcgtggcggcatccgccgtcagcagacggtcagctttattgttcagcagcagatccgtcagacggttgagcacggcgaccggctggtcgtcggccatcgccacgctgatcaacagctgggcgttttcaccgtcaacggtaaaggcgctggcggcgcggcttactgcaatggcgctgccgaggttgccttcggcgctgtcgttcagccatacaccctggccgaggttcagcggtttttcattaatggcgcgggtcacaaaagcggtgtcaacggcaccggcctctttcagacgtccggcgtttacggcctggagagttacaatatcgctggcagtgatgtcgagcgtcagcaaatcgttatccagcttcagcgcttcactctgtttttcacccatcagcagggcgcgaagctcttcagtcgtggtggcagactgcaactgcgccgccaccgcatcgtcgcttaacacgtgcgtcagctgacgcagcaggccgagatgttcgtcagaactggcggcgatgccaatagcgacgtaagccacctgcccttcgccccacagtacgccctgcgggaactgataaacctgaacgccggttttcagcacctgatcgcgggtatctgtcgtgccgtgcgggatggcgatgccattgccgaggaaggtggaggtttgctgctcgcgggcgagcatgccgttaacatagccgtcggccacgttgccagcctgcaccagggcggcggcgatctgacggatagcgtcttctttattggtggcctgctggccgggatgaatatcctgaacggataactggaacatagatttccactcctgctgaagttgaatcgtttcagccttctggtgaattaacgcgccaaccggtaacggggaagttaaaggatagcgctgaaacgtttcaagaagtcttgctctttatccgtcagcacgcaagaaatctcgtctttccgcttaaaaaatttagatgtacagcacatttttgctgcggcgctggtttttttgctgatgctgctgacgccgccgctgcgtctgtttcagcaacttcagccgtaatgagaattattttgaaatgctattttgattttttgtggcactttttcgttagcgtctgtctattttctgagtagcggcgtaaactccgcgtcttcttcagaacgcagaaccgaaaagatgcacattacccccgcagccgcctctcccaaaccgtttgacgtcacctccacggcgtttttgattgtggcctttctcaccggcattgctggtgccctgcagacgccgacgctgagcttatttctgactaacgaagtgcacgcccgtccggcgatggtcggctttttcttcaccggcagcgcggtgatcggcattctggtcagccagtttcttgccgggcgttcggatcgcaaaggcgaccgtaaaaacctcatcgtcttctgctgtctgttcggcgtgctggcctgtacgctctttgcctttaaccgtaactatttcattctgttgtttatcggcgtcttcctgagcagctttggctcaaccgcaaacccgcagatgttcgcccttgcccgtgaacatgcggatcgcaccggccgcgaagcggtgatgttcagctcgatcctgcgcgcgcaggtgtcgctggcctgggtgatcggaccgccgctggcctatgcgctggcaatgggattcggctttacgatgatgtatctgagcgcggctattgcctttgtggtgtgcgggatcatggtgtggttttttctgccaaccatgcgcaaagagccggtgctggcgaccggtgtgctggaagcgccgcgcaccaacagacgtgatgcgctgctgctgtttgtcatctgcacgctgatgtggggcaccaacagcctgtatatcatcaatatgccgctgtttatcattaatgagctgcatctgccggaaaagctggcgggtgtgatgatgggtaccgccgccgggcttgagatcccgaccatgctgattgcgggttactacgctaaacgcttcggcaagcgctttctgatgcgcatcgcggtggtcgccgggctgattttttacgccgggatgctgaccgtgcacacgccggtattactgcttgctttacagctgctgaacgccgtatacatcggtattcttgccggtatcggcatgctctattttcaggatctgatgccaggccaggcgggggctgccaccacgctttatactaataccacccgcgtcggctggatcatcgccgggtcgctggcgggcgtggtggcggagttctggagctatcacgcggtattctggtttgcgctggtgatgatcgtcgtcaccatggcatgcctggcgcgcataaaagatgtttaaggcgcggtcagcctttccagatcgataaggtaaaccatcgcctgggcgcgcgtgctgccgcacatctcgcgggagggttgcagtccggcgcagactttcgggcgcagcggcgagcggaacagcttacagcgctgctgctcgtcaagctgaacgcagggggtattggcgggtttgccgtccggcataccggggatcgggctgctgatggatggcgcggtacaacaggctccgcaatcgctgcgacactccataaacggctctcttttggcgggggtgatcggggttgtcatcccacgtttgcgcacgctatcactttttgtggtgaacatgcaaaacatgctgattccccttgcctgaaacgcccctcgcgagtaatttgtcgcgatatttttacccttttcccaaacaggattaataatgccaagagcgaatgaaattaaaaaaggtatggtgctgaattacaacggcaaactgctgattgtgaaaaatatcgatattcagtcaccgagcgcccgtggcgcagcgacgctgtataaaatgcgtttttctgacgtccgtaccgggatgaaagttgaagagcgttttaaaggcgacgacatcgtggataccgtgacgctgacccgtcgtttcgttgacttctcttatgtcgacggcaacgaatacgtgtttatggataaagaagattacacgccgtatatcttcaccaaagagcagatcgaagacgaactgcaatttattcctgaaggcggtatgccggacatgcaggtgttaacctgggatggtcagctgctggcgctggagctgccgcagacggtggatctggaaattgtggaaacggcaccgggcattaaaggcgcttcagccagctcccgtaccaagcctgccaccctgagcaccggtctggtgatccaggtaccggaatacctgaccacgggcgagaagatccgcattcatatcgaagaaagccgttatatgggccgagcggattaaggcacattttcgcccggcggcgcaagcttgccgggcctacatgtaggccgggttagcgcagcgccacccggcaattgttttaccattttaccgttctaaagcagttccgggaacagcgtatgtttcagcgccagttccacgccgcgtacttccgccatccctttcagacgaccaattgccgaatagccagggttggttttcttacgcagatcgtccagcatctggtgcccgtgatcgggacggaacgggatcggtcgtaaatctccggccttcttacgacgcagttcttcagtgaggatcgctttcaccaccgccaccatatcaacgtcgccctgtaaatgcgcggcttcgtggaaggttttcgggttcgcctcgcggcaggtagaacgcagatgcgtaaagtgaatgcggtcgccaaaggtttccaccatcttcaccagatcgttatctgcccgcacgccgtaagagccggtgcacatggtgaagccgttatggatgctgtcgacgcacgttttcagccactgcatatcttcaatggtggaaacaatacgcggcaggccaaggatcgggcgcggcggatcgtccgggtgaacggccagacgcacgcccacttcttccgcaaccggcacaatggctttcaggaacacggccatgttttcacgcagctgttctttattaatgccatcgtattccgccaggcgcgcgcggaactgatccagcgtatagccctcttccgcccccggcagaccggcaataatattacgcgtcagcttttcaatttccgcgtcgctggcggcgttaaagaattccagcgcctgacgctgctcttcttcggtgtagtctgcctgcgccccttcgcgtttcaggatatgcagctcgaaagcggcaaaagcaatctgatcaaaacgcagggctttggagccgtccggcagcgtatattccaggtcggtacgcgtccagtcgaggatcggcataaagttgtagcagacggtatcgatgccgcaggccgccagattacggatactctgctgataattggcaatccaggttttgtattcgccgctgtgggttttgatgtcttcgtgtaccggaatactttccactaccgaccaggtaaggcctttttcagccagctgcgcctggcgctgtttgatttcttccaccggccatacctgaccgttaggaatatgatgcagtgcggtgaccacgccggttgcgcccgcctgacggacgtcatcaagagataccggatcgttcggtccataccaacgccaggtttgttccatcgcctaaccctctaaaagttgttataccaatacagtcaaagccaatgacgactaccatacatgtttatttccggcgatcaaaccccaccgtatcccagattgatccagctcacattccccgtaaaattaaggcataccaattcaatttgctgtcatataactttacactgcatcttgttaattattagttaatcaggtgtttattaatgaagacaatcgcctcgcaaacgctgccggaaaacgtccgcttaccgcagtatgatcgctccctgctgcgctcgcgcatcgtgcatttcggctttggcgcttttcatcgcgcgcatcaggcgctgttaacggaccgggtgctgaacgcccggggcggcgattgggggatctgcgaaatcagcctgttcagcggcgaccggttaatgatgcaattgcgtgagcaggagcacctgttcaccgtgctggaaaaaggcgcgacgggcaacgaggcgattatcgtcggcgcggttcacgaatgcctgaacgccaaactggactccctgcctgccatcatcgaaaaattctgcgagccgcaggtggcgattgtgtcgctgaccatcacggaaaaaggttactgcatcgatccggcgaccggcaaactggatcttaatcagccgcgtatcgtgcacgatctgcaaaaccccaccgagccgcactctgcgccgggtattctggtggaagcgcttgcccgccgtcgcgatcgcggccttgcgccttttaccgtcctctcctgcgacaatattcccgacaacggccatgtggtgaaaaacgccgtgctcggcatggcgcagcagcgctccgctgagctggcacagtggatcaacgacaaagtgagcttccccggcaccatggtcgatcgcatcgtaccggcggcaacggatgaatcgctggcggagattacccgcacgttgggggtggaagatccctgcgccatcagctgtgagccttttattcaatgggtagtcgaagataactttgttgccggacgcccggcatgggaagtggctggcgtgcaactggtgcaggatgtgctgccgtgggagcaaatgaagctgcgtatgctgaacggcagccactctttccttgcctatctgggctatctggcgggttttgcccatatcagcgactgcatgcaggacgcgcatttccgccgcgccgcccgccgtcttatgctggaagagcaggcaccgacgctgcgcatcaccgatgtggatctcaccgcttacgccgacagcctgatcgaccgttttgccaacccggcgctgcaacaccggacctggcagatcgccatggacggcagccagaaattgccgcagcgtatgctggacgggatccgcgtgcatctgcaacgcggtacgccctggccgctgctggcgctgggcgtcgctggctggatgcgctatgtcagcggcgttgacgatgccgggcaggcgattgatattcgcgatccgctggtggaaaaattccgcgccatcgtcgaaaccagcgagccggacgatcgcgtacccgccctgctgacgctgacggaaatcttcggcagcgacctgccggccgatccggcgttcgtcaatgcgatccaggcggcctggcaacagattgctgataaaggcgcgcatcaggcggtgattgacacgctcgctcattaacaattcctgccattaaagcggacagagaagccatctgtccgccctttcacttctcttttccttcttttttcgccaggattagcattattgttacttaataacagttaacagatctaatcatggagcttatatgaccaggaccaacctgatcaccggttttctgggtagcggtaaaaccacctctattttgcatctgctggcgcagaaggatcccgccgaaaaatgggccgtgctggtgaatgaatttggtgaagtcggcattgacggcgcattactggcggacagcggcgcgctgttaaaagagatccccggcggctgtatgtgctgcgtgaatggtttgccaatgcaggtggggctgaataccctgctgcgccagggtaagccggaccgtttactgatcgagcctaccggcctgggccatccgaagcagatcctcgatatgcttaccgccccggtttatgagccgtggatcgaattacaggccaccctctgcctgctcgatccgcgtcaactgctggatgaaaaggccgtgaataatgagaacttccgcgaccagctggcggcggcagatattatcatcgccaacaaagcggatcgccgcacgccggaaagcgagcaggcgctggcgcagtggtggcagcagtacggcggcgatcgggagttattcaccgccacccagggaaatatcgaccccgccctgctggatcgcccgcgccgcaaccagcgtgagctgcccgaaagcgccgcgcatcagcacagccatggcgataaaaaaggccttgccgcgctaagtctgccttcccatcagcgctggcgtcgcagcctcaacagtgggcagggccatcaggcctgcggctggatctttgatgctgaaacccgtttcgacaccattggcctgctggagtgggcgcggctggcgccggtggatcgtgtaaaaggcgtgatgcgcattcccgaagggctggtgcgtattaatcgtcagggacaggatttgcgtatcgaaacgcaaaatgtatcgccgccggacagccgtattgagctgatcaccgctgatgaagcggactggaatgcacttcagtcaactttgttgaagcttcgtttagccgacgagaattaacgttacggttgataccttagtttctgatgaatacatgaaaacgcgacttcccctgattttactgttaaatgccgccggtctggcgctgtttttatcctggttcctgccagtaaaccatggcatgtggtttaccctcgactcggctatttttcatttctttaatgaaaagctgactgaaagccgtgcctttctgtggctggtcgctatcaccaacaaccgcgcctttgatgcctgctccctactggcgatgggcgcgctgatggtgagcttctggcgtaacgccgatgcggcgggtcgtcgccgcgtggtgatgataggcctgatgatgctgttcaccgccgtggtgatcaaccagctggcgcaggcgctgtacccggtaaaacgcgccagcccgtcgttattctttgagcatgtcaaccgcgtcagcgatttgctgagcgttattcctactaaagatgcctcgaaagacagcttccccggggatcacggcatgatgctgcttattttttcagcagtcatgtggcgttattttggtaaaggcgcctttgccattgccctgcttattgtggtggttttcgcgttcccgcgggtaatgataggcgcgcactggtttactgatattgtcgtcggctccctttctgccgtgctcattggcttaccctggtttttgttgacaccccttagcgataaaatcgtttcactgtttgactattatttgccttataaaaacaaacaacttttaaacaaataaataacttctttttaccgccattgcagggatcgacaaggatccctgcaaaataaagttggctctttctcctttccgtcatacgcctgtcacaaaatttctccagctaaatgagcggcatgcatggtttttaagctaaattgcttgctttttgtacaaagatttattttcactttcggtatcataatttcttataaaaaaacacataaaaagtctcgcattgcctggggtgataaggtaatctcgactgcgtttcgcctcacagacataaaatattcccgctgtgaataaatttgtgcgttaaaccacagatttgacctggaggaattgtgtcgtagtgcgcaggtaattaatctcgtcacgtttggcatttatatagcgatatttatcgttaaggacttcaagggaaaataaacaacatggtcaaatctcaaccgtttttgagatatctcgggcgggcgatccccgcgttagcagtagcggtactgctttcagcttgttcaactaataccgcaaagaatatgcaccctgagacgcatgttgtgggcaccgaagatgcctcgtcactgcaagcctctcaggatgaatttgagacgatggttcgtaatctggatgttaaatcccgccttatggatcaatacgcaagctggaaaggcgttcgttatcgtcttggcggcgataccaaaaaaggtattgattgctccggtttcgtacagcgtactttccgcgaacaatttggtttagaactgccgcgttccacctatgaacagcaggaaatgggcaaatccgtttcacgcaccagcttacgcaccggcgatctggtcctgttcagagccggttctaccggacgtcacgttggtatttatattggcaacaaccagtttgtccatgcctctaccagcagcggtgtcgtgatttcaagtatggatgagccatactggaaaaaacgttataacgaagcgcgtcgcgttttagtccgcagttaacgtatcgcctgttggtttcccttgactgacatgacgacataaaaaagaagcgctgctccggcagtgctttttttttgcctgctgacggctgaagtctttccaggctatagtctgacaattcaaagcgatcctctgtcttatctggataccgtacccctatgccgatccgcttaacgcatgccagccgcaaaattctgatcatcagtattctgacaggcattctgacgggcatcgtggcaggaggcctgcaatttagcattgcgcaacaccatcgtgaaattcagttagatcgtttattcagcgatattaaagctaacgttgaacattattttagcgatctgcataccaccagcgatttactgcaaccgttagccttaagcccctgtgaaaaagtcagcagcgaattaacatcgcgggcggcattcagcgtgaacgtgcgggcgtttttactggtacgtaaccataatgcgttttgctcctccgccaccggcgcgatggatgtgccgctgaccgatctgataccgggtattgatgtcagcaaaaagctcgatatggtgatcctgcccggcacgccgatgatgcccgatactcccgccatcggcatctggtatcaaagcccgctgcgggatgaacacggggttttcgtctccgttaacgttaatctcgccccttcgttgatcaactcttccctgcgggataattatcagggcgttgcgctggcgacaggcgataacgctatctccaccttttccgcccggctgatttccccgggggatgtctctgcgcagtcggtacgtcatgcggccatcgacagcctgccgctcaccctctggctgtatgccgaacgctggacgccgcaggacattcagctggcgctgcttcccgcgctgatggcgggtctgctggcgggtttactctgcgccctgttgctgcaccggcgtctgcggcctggcagagagattttgcaggccattaagaacgaccaattttatgtggtgtatcaaccggtggtggatgcgggcacgctgcgcgtcagcggcgcggaagtgctgctgcgctggaagcatccgacgaagggtgagatctccccgaatacctttattcccctcgctgaagcgcaaaaactgatggtaccgctgacgcagcacctgtttcgcctgatcgcccgtgacgccgcggcattacaaagcgtgctccccgtgggcggcaagctcggcatcaatatcgccaccggccatctgcatgccgccagctttattgaagatcttgatcgtctgaatgccgccctgcccgtgcagcatttcagcatcgtactggaaattaccgagcgtcatatgcttaagcatggcgaagcggcggcgctgtttaaggccctgcatcagaaaggctatgaaattgccattgatgatttcggcaccggccacagcgcgctgatttatctggagcgttttaccctggattacctgaaaatcgatcgcgcctttgtgagcgtcattgatatggaaaccgccgcctcgccggtgctggacaccgtgctgctgctggcgaaacggctgaacatgcagaccgttgcggaaggcgtggaaaccgctgaccaggccagatggctgcgcgcccgtggggtaaactttttgcagggctactggttttgccgcccgatgacgctggcccagctgcaaaactggcagccaccgcctttttctgttcagcttcaggggtgaagcatttaccatccaccagcctgtaccttattattcaccggtcttagcgctggtaaaaggaagccgcccgatgatgtctctgcgcgtaataatgatgctgttcgccatgttgagcctgaccgctcaggcacagaccataaaagagagctacgccttttcggtgattggcgagccgaaatacgccgcggatttcagccattttgattacgtcaatccggcagcgccgaagggcggcaacattacgcttgcggtgatcggcacctttgataacttcaaccgctacgccctgcgcggtaatgccgcggtacgcaccgaggcgctgtatgacaccctattcaccacttcggacgatgagccgggcagttactacccgctgatcgcggagatggcgcgctacgcggatgacttttcctgggcggagatcgccattaatccaaaggccacctttcaggacggtacgcccgtcaaagccagcgacgtggccttttcctttcataaattcatgaccgaaggcgtgccgcagttccggctgatttacaagggcaccacggtcaaagccatcgcgccgctcaccgtacgcattgcgctggccaaacccggtaaagaagatctgctgagcctgttcagcctgccggtgatgccggagaaattctggaaaaaccataagctcagcgatccgctgtccgtaccgccgctgggcggcgggccgtatcgcatcagccagtggcgtatggggcagtatatcgcctacacccgcgtgcgggattactgggcagcagatctgccggtcaatcgcgggcgctggaatttcgataatattcgctacgactactatctggacgataacgtggctttcgaagccttcaaggcgggggcatttgatttccgtcaggaaggcgatgcgaaaaactgggcgacacgctacaccggcaaaaatttcgctaatcactttattgttaaagacgagcagaaaaacgaatcggcgcaggatacgcgctggctggcgtttaataaccagcgtccgctgtttcaggatcgccgggttcggcaagcgctgacgctggctttcgattttgagtggatgaataaggcgctgttctataacgcctattcacgaaccaacagctatttccagaatacggaatacgccgcccgtggctatccggatgccgccgaactgacgctgctggcgccgatgaaagcagggctgccgccggaggtgtttacctccatctaccagccgcccgtctcgcagggcaacggctttgaccgtaataatctgctgaaagcaggtcaattgctggatgcggcgggctgggtgctgaagggcaaacagcgtgtgaatgcgaaaaccggaaaacccttcagctttgagctgctgctgcccgccgggagcaacaatctctgggtgatgcccttccagcataatctggcgcggcttggcgtaacgctcaacgtacgccaggtggataactcccagctcaccaaccgcctgcgcagccgtgattttgacatgataccgcgcaccttgcaggcacggccatggccggataccgatctgcaaatttcctggggctcggcctacctgaattccacctacaacacgccgggcgtcaccagcccgatcatcgatgcgctgcttgaaaaaatcattgccgcgcagggcgataaaaaaaagctgctgccgctgggccgggcgctggatcgggtgctgacgtggaattattacatgctgccaatgtggtttatggcgtccgatcgcctcgcttactgggataaattttccatgcccgcgcagcgcccggtctattccatcgggtttgatacctggtggtacgacgtcaacaaagcggcgaaactgcccgctgccagacgttaaggagaggctatgggcgcttatttacttcgtcgtttactgctgctgatccccaccctgtgggcgatcatcaccattaactttttcatcgtgcagatcgcccccggcggcccggtggatcaggcgattgccgctattgagtttggtcagaaaggcgcgatgcccggcggcggcgatggcggtatgggcgcgtcccatgcgcgtaccggcgtgggcaatatcggcgagggcaactatcgcggcggccgcggcctggatccggaagttatcgaagagatcaccaaacgctacggcttcgacaaaccgctgcatgagcgctatttcactatgctgtggaattacctgcgctttgattttggcgacagcctgttccgcagcgcctccgtgctacagctcatcaaagagagtatgccggtgtcggtgacgctcgggctgtggggcacgctgattatctatctggtgtccattccgctcggcatccgcaaggcggtgcacaacggcagccgcttcgatacctggagcagtgcctttattataatcggctatgcgatcccggccttcctgtttgccgtgctgctgatcgtgctgtttgccggcggcagctattacgatcttttcccgctacgcgggctggtgagcgccaatttcgacaccctgccctggtaccagaaaatcaccgattacctgtggcacatcacgctgccggtgctggcgacggtgatcggcggctttgccgccttaaccatgctgaccaaaaattcctttctcgatgaaattcgtaagcagtacgtggtcaccgcccgcgccaaaggggtgagcgagcgcaatattctgcataaacacgtctttcgtaatgcgatgctgctggtgatcgccggtttcccggccacctttatcagcatgttttttaccggctcgctgctgattgaagtgatgttttcgctgaacggtctggggctgctcggctatgaagccaccgtctcgcgggattatccggtgatgttcggcacgctctatattttcaccctgattggcctgctgctgaatatcctcagcgatatcagctatacgctggtggatccacgtatcgattttgagggtcgctgatgcgtcaattaagcctcgttaaccaggcccgctgggcacgctttcgccataatcgtcgcggctactggtccttgtggattttccttgtgctgttttccctcagcctgtgcgcggagcttattgccaacgataagccgctgttggtgcgctatgaaggccagtggtacgccccggtgctgaaggattacagcgaaacggtattcggcgggcagttcaccaccccggcggattatcaggatccctggctgcaaaagcagctggatgaccacgcctgggtattgtgggcgccggtacgcttcggcgcgcgcagcattaatttcgccaccgacacgcctttcccgtcgccgccgtccgcacagaactggctgggtactgacgccaacggcagcgacgtgctggcgcgcattctctacggcacgcgcatttcagtgctctttggcctgatgctgacgctctgctccagcgtgatcggcgtgatggtcggggcgatgcagggctattacggcggccgtatcgatctctttggccagcgggtgatcgaggtgtgggcaggaatgccgacgctgttcttgatcattctgctctccagcgtcattcagccgggcttctggtggctgctggcggtgacggtgctgttcggctggatgagtctggtgggggtggtgcgggcagagtttttacgcacccgtaattttgattatatccgcgcggcgcaggcgctgggggtcagcgatcgcagcattatcctgcgccatatgctgcccaacgccatggtcgccgtgctgacctttatcccctttattctgtgcagctccatcaccaccctcacctcgctggattttctcggcttcggcctgccgctcggctcgccgtcgctgggagagttgctgttacagggcaaaaataatcttcaggccccctggctgggcatcgcgggctttttatcggtggcggtgctgctgtcgctgttgattttcatcggcgaagcggtgcgcgacgccttcgatccgaacaaggcggtgtaagatgagcgctcccctgctggcgataaattccctgacggtagccttccgccatcagcaacagctgcgcaccgtggtcagcgatctgtcgctgacaatccatgccggtgaaaccctggcgctggtgggcgaatccggctccggcaaaagcgtcaccgcgctgtcggtattgcggctgctgcccgcgccgccggtggaatatcctgcgggcgatattctgtttaaaggcgaatcgctgctgcatgccagtgaaaaaactctgcgctccgtgcgcggcaataaaatcgcgatgattttccaggagccgatggtctcccttaacccgctgcatacgctggaaaaacagctgtatgaagtgctgtccctgcatcgcgggatgcggcgtgaggcggcgcgcagcgaaatgctcgactgtctggatcgcgtcggcatccgcaatgcccgtacccggctgaatgatttcccccatcagctttccggcggcgagcggcagcgggtgatgatcgccatggcgctgctgacgcgcccggaactgctgatcgccgatgagccgaccaccgcgctggacgtttccgtgcaggcgcagatcctgcaactgctgcgtgaactgcgtgatgagctgaacatggggctgctgttcatcacccataacctgagcattgtgaaaaagctggcggacagcgtggcggtgatgcaaaacggccgctgcgtggagcagaaccgcgcagcagaactgttcgcccgcccgcagcatccttatacgcagcggcttctggacagcgaaccggctggcgatccggtgccgctcacccctgccctgccgccgctgttgcaggtcaaaaatctgaacgtcgcctttccggtacgcagcggccttttccgccgcgtgaccgggaaaaaaccggtggtcaacaacctgagcttcagcctgcggcccggcgaaacgctggggctggtgggggagtccggatcgggaaaaagcaccaccggactggcgctgctgcggctgattgccagcgaagggcaaattgaatttgatcatcatccgctgcacagctgggatcgccggcaaatgctgccggtgcgtcaccggatgcaggtggtgtttcaggatccaaactcctcgctgaacccgcggctggatgtgcagcagatcatcgaagaagggttacgggtgcatcagcctgccctgtcgcgggcggagcgggaagaacaggtgaaagcggtgatggtggaagtgggtcttgatccggacagccgccatcgctatccggcggagttttccggcggccagcgacagcgtatcgccattgcccgggcgctgatcttaaagcctgagctgatcgtgctggatgagccgacgtcatcgctggatcgcaccgtgcaggcgcagatcctcacgctgttaaaatccttgcaggaaaaacaccgcctggcgtacatctttatcagtcacgatctgcgcgtggtgcgcgcgctctgtcatcaggtgatcgtattacgtcagggagaggtggtggaacagggggagtgcgcgcaggtgttcagccagccgcagcaggcttatacgcgccagctgctgtcgctgagctaactcagaaaggattgttgttcgagaacggctctgcgatggcgacgccaaagtttttcaggcggcaggtggccgcaaactcgtcctgacgattaacaaacaggcacggctcgccttcgcattccagcaccgagcagtccacttcgatatcgtttaacgcctggctgagcttatgcatcactggccacgcgctatcgccatccgggcttaacagtttcaacgcgaccagacaattttcgccgctctgtccattgtgcggaatcggttcaactttcgaacctgcgcttcccgccagccagcgatagttctgcggcaaccggtgcacgatagagaggtttaatgtattcacgttatttccctgaaagcaaaatcttcacaattaatttacatctgtaactacacaggctatatgtacccgtttatgagatctaactcaacctttttaactacaacggtgtgactttttacacaaatacattttacataaaagaaacaaatcggggaaatgcgatcgcaggatccgttgatatgcatcaacgaagggggcagtttttgccccctggaaaggattaggcggcgcgctttttcgagcgactggcgtagaaatagaagagtacagagctggccgcgcagaaggcgatagaccagatcatcggccaggcgctgttaaaggtcgccagcgacagtaacgcgccgacaatagcaccgatgccgaaacggaaggtgcccgccagcgacgaggccgtccccgccatatgcggaaattcatccaggatcaccgccatggcgtttgaggccaccagcgacacgcagccgataaaggccgccacgcccaccaccagcgcccagaatccgacgtccagcgcggcgcacaccaccatccatatcgccatcgccagttgaatgtacagcccggcgcggaacatattgatcgccccgacccggcgcacgaaacgtccgttaatgatggtcataatgaacaggaagacgatgttcagcgcgaagtaatagccgaaatcctgcggcgaaacatggttgatctcgatgtagacaaaaggcccggcgctgaggaaggagaacatcccggcgaagctgaagccgctcgccagcatatagctcagcacccgcttgtggcgaaacagcgtggcgaaattcccgagcgtggtgcgaacgcggaatttttgtcgccgctccaccggcagcgtctctttaatgaaaaagaagatcatcagcgaggccagcagcgcggcaatggccaggatccagaaaatcgcatgccagctcatccacaccagcaccgccccgccgatcatcggcgccagcagcggcgcgatggtggtcaccagcatcacaaaggacatcatccgcgagaattcctctttcggataaatatcccgcatcagggcgttgatcaccacgctggcagcggccgccgccagcccgtggaagaaacgcatggtgatcagctgctcaatgctctgcgccagcgcacaggcgacggcagcggcggcaaaaatcagcgtcccgccgaggatcaccggcttgcgcccgatgctgtcggccatcgggccatacaacaactgccccagcgcaaaacccagaatataggtgctgagcgtcatctgcgcgctgcctgccggcacggcgaactgctctgcgatcaccggcagagcgggcagatacatgtcgatggagagcggcatcagcatggccagcaggccaaggataaagacgatactcagagatgagttttgcctggcggtcactcaggactcctgggaaagttcagaaggcatgccaacgctggcaatctcttcgtctgttaacgggcggtattcaccgggggctaaatcatcgtcaagggcgatggcgccaatacgttcccggtgcagaccgacaacgtggttacccacggcggcaaacatgcgtttcacctgatggtagcgcccttcgctgatggtcaggcgcacctcggtcggagtaatcacttccagcaccgccggtttggtgagatccttttcgttatgcaactggacacccttcgcaaactgttcggcagtgtcatcgctgaccggggattcgagggtcaccagataggttttttcgcagtggtggcgcggtgaagtgatgcggtgcgaccactgaccgtcgtcggtcatcagcaccagaccggtggtatcaatatccagacgcccggcggcatggagtttgtgcgccaccggctcgtcgaggaaatagagcaccgtcggatgatcgggatcttcggtagaacagacgtaaccctgcggtttattaagcataaaatagcgcgggccattctgctgcgccagcgggttgccgtcgaacgccacttcatgttcgggcagcagtttaaacgccgcttgtcgtacaatttcgccgtcaatagtaatacggttggcgcggatctcacgcccggcaatagcacggcttacgccaagctgctgagcgataaacttatcaagtcgcatgaaattaaatttgcctgtaaagggtgccggagtcgggctaactgcccgaaaaaaagaagcaatgttgcatggctaagtataacgggctgcgcgtatcgctcaagggaaaaaaaccgtggcatactattagtctgctgatgaaaattaaagagaccatgacttttacactccgcccctaccagcgtgaagctgtcgacgccaccctcgcccactttcgccatcatcgtcacccggcggtgatcgtcctgcccaccggggccggtaaaagcctggtgatcgccgaacttgccagggtcgcgcgcggacgtgtgctggtactggctcacgtcaaggagttggtggcgcagaatcacgcgaaatatctggcgttaggccttgaggcagacatttacgccgccgggctgaaacgcaaagagagccacggcaaagtggtgttcggcagcgtgcagtcggtagcgcgtaatctcgaccattttcagggggagttttcgctgctgattgttgatgaatgccaccgtatcagcgatgacgacgacagccagtatcagcaaatcctcgcgcatcttacaaaagtgaatccgcaactgcgcctgctggggctgaccgccacaccctttcggctgggtaaaggctggatctatcagtttcattatcacggcatggtgcgcggcgatgaaaaagcgctgttccgcgactgcatttatgagctaccgctgcgctatatgatcaagcatggctacctgacgccgccggagcggctggatatgccggtagtacagtatgatttcagccgcttacaggtgcagcgcaatggcctgttcagcgaggcggatctcaatggcgagctgaaaaagcagcagcgcattacgccgcacattatcagccagattgaggaatttgccgccacccgtaaaggggtgatgatttttgccgccaccgttgagcacgcccgggagatcaccggcctgctgccggcgaatgaggcggcgctgatcaccggtgaaacgccgggcagcgagcgcgatgccctgattgaggcgttcaaagcgcagcagtttcgttatctggtgaacgtctcggtactgaccaccggctttgatgccccgcatgtcgatttgatcgccattctgcgcccgacggaatccgtcagtctgtatcagcagatcgtaggccgcggcctgcggctggcccccggtaaaaccgactgcctgatcctggattacgccggtaacccgcacgatctcttcgcgccggaagtgggcgcgccaaaaggtaaaagtgataacgtgccggtgcaggttttctgcccggactgcggtttcgccaacaccttctggggaaaaaccaccgccgacggcaccctgatcgagcattttggccgccgttgccagggctggtttgaagacgatgagggtcatcgcgcccagtgcgactaccgcttccgctttaaaaactgcccgcagtgcaacgcagaaaatgatattgccgcccgccgctgccgcgagtgcgacacggtgctggtggatcctgacgatatgctgaaagccgcgctgaagctgaaagacgcgctggtgctgcgctgcagcggcatggacttacagcatggcgcggatgagaaaggccagtggctgaaaattacctattacgatgaggacggcgcggacgtcagcgagcgattccgtctgcaaacgcctgcccagcgcacggctttcgaacagctttttattcggccccacacccgcacgccgggcgtgccgctgcgctggatagtcgcggcggatatcgtcgcgtcccgcgcgctgctcaggcatccggattttgtcgtcgcgcgcaaaaaaggccagttctggcaggtacgtgaaaaggttttcgattacgaaggtcgcttccggcgcgccaatgaattgcgcggctagcggcgcttttcgttgaagtcacatacgttcgggtatagaataccgcccgctttacaaccgtaaagccgatcatctgcctgttgctgggtcgcctgtaacaggattaattagagagattcaaatgtttactattgaagcacaagcacgtaaagagcagggtaagggtgcgagccgccgcctgcgtaccgctaacaagttcccggcaatcatctacggtggcgctgaagcaccgattgctatcgaactggaccacgacaaagtgatgaacatgcaggccaaagaaggtttctatggcgaagttctgaccctggttgttgacggtaaagaagtaaaagttaaagttcaggctgtacagcgtcacgcgttcaagccgaaactgactcacatcgacttcgttcgcgcgtaatcgccaacaggttgaataaaaaaccccgctccggcggggtttttttatggctgttatttgccaccgctcagacggcgctgcaactggtcgcgcagattgggcggcgtgcctttgatggtcagcgtgtcggtggccggatcccagaaaatgcgttcgccgagcagcatggcgtcgaaattaatggtcaaaccgccgccgctgcccgcgtatttggtcagctgacgcagcgtactgcgatccgccgggaagctctcttccagctcgtagcctttatcggcggtaaaatcctggaagctgacgtcgctcacacccgccagctctttcgacagggatcccagctcgatctcttccccggcctgcaactgttcgttgcagtagctgtatacctgctgacgcacactctggcgttccgctttatccagatccgcttcagcggtaaagtcgtccaccgcctgtaacagccctcggttctgcgctttggcattcagaccttcgctggcgccgaggaaatccataaagaaatcggcaaccttgcgccctacccgccctttcaggaacgtcaggtagcgggtcgattccggcctggtttcccattcggttaaatcaatgcgcgccacgatgtcggcatggttgatgtcgagatagtgcgtggagctgatatccagctcctcattcacccgcatgctgcttaaattattcagcacggcaatgagaagatactctaccgccagatagcgataatggcagaacagcacgatcccgccgtcagcgaaggggtattttgacagctcatcccgcagacggccggttgccgcacggctgaaagcgagaaaatcttcgtcgcccttgcgttgcaggcgcagcgtttgcgccagttcgctctcttcattaaacaggccataggctttatttttggcgctgtagacccggtgcagctcggccaccatgtcgttgacggtagccgtcggttccagcaatgaatcgcgtaacaccagctcaagggtttgctcatcgcgcttgataagctggtgcagggcaatctggttgatgtccagactcatgataaactctccttttagaccgggcggtattcaaccaccgccagcacatctgtgcaatagcggataaaaatgcagaaaaaaagctgttgctacggtaatatgttgccctttcatgaacaaactgattccgaatttatgccacagatttcccgttatagtgatgaacacgttgaacaactgctgagtgaactggcaaacgtgctggaaaaacataagacgccaaccgatctttccctgatggtgctgggaaacatggtgaccaatcttatcaacaccagcgtcgcgcctgctcagcgtcaggctatcgcccgctcttttgcagaggcgttgcagtcgtccgttaacgacgataacgcgcactaaggaacacgacgacattttatggtgactcatcgtcagcgctaccgtgaaaaagtctcccagatggtcagctgggggcactggtttgccttgttcaacattttgttgtccatggttttcggcagccgctatctttttgtcgccgactggccgaccacgcttgccgggcggttttactcctacctgagcgtcgtcgggcatttcagctttctggtgttcgccacctatctgctgatcctctttcccctgacctttgtcattatgtcgcagcggctgatgcggctgttgtccgctattctggccaccgccggcatgacgctgctgctgatcgacagcgaagtctttacccgcttccacctgcatttgaatcccatcgtctgggagctggtgatcaaccccgatcaaaacgagatggcccgcgactggcagctgatgtttatcagcgtcccggtcatattgctgatcgaaatgctctttgcaacctggagctggcagaaactgcgcagcctgacgcgtcgtcgccattacgccagacccgtcgccgccttcttctttgtggcctttatcgccacgcacgtgatgtacatctgggcggatgcgaacttctatcgcccgatcaccatgcagcgcgctaacctgcccctctcctatccgatgacggcccgccgttttctggaaaaacacgggctgctggatgcgcaggagtatcagcgtcgtctggtggaacagggtaatccggaagcggtgtcggtgcagtatccgttaagcgatctgcattaccgcagcatgggcgcggggcagaacgtcctgttgatcaccgtcgatggcctcaactattcgcgttatgagaaacagatgcctgcgctggcaagcttcgcccagcagaatgtgacctttacgcagcatatgagtaccggcaacggcaccgacaacggtatctttggcctgttctatggtatttcgcccgcctatatggacggcgtgctgtcgtcgcgtacgcctgcggcactgatcaccgcgctgaatcagcagggttatcagcttggcctgttctcctccgatggcttcagcagcgccctgtatcgccaggccctgttgtcggacttctcactgccgcctgcgaaatcgcagtcggacaaacagaccgccgatcagtggatcgactggcttggccgctatgccgccgaagacaaccgctggttctcctgggtggcgctcaacggcaccacgctggatgagacgcagcagcagggctttgcccgccgctacgcccgcgccgccggtgatgtggatgcgcagattgcgcgcgtgcttaacgccctgcgcgatgccggtaagctggacaatacggtggtgattattaccgccggacacggccagccggtggataaagccgagcagacctttgactggtcgcgcacgaatctgcacgtgccgctggtgatccactggccaggtacgcctgcgcagcgcatcaacctgctgaccgatcataaagatgtcatgaccacgctgatgcagcggctgttgcaggtgaccacgccagcgaacgaatactcgcagggtcaggatctgtttaacgccaaccgtcgccataactgggtgacggcagcggatgccaccacgctggcggtcaccacgtccagtatgacgctggtgctggatcataacggcacttatgaaacctataacctgcgcggcgagaaaatccgcgatcagaaaccgcagctcagtttgttgctgcaggtgctgacggatgaaaaaaggttcatcgctaactgattgattaattataaatcagtcagcgttacccggcttgcaatcagccgcaaaacgggtactattatcgccacagttcggcacgtagcgcagcctggtagcgcaccgtcatggggtgtcgggggtcggaggttcaaatcctctcgtgccgaccaaaaatcccggaaaaaccaaccttcgtggttggtttttttatatcagcattgtagttcattcagcctcttcccttatcttttcccctcattaaagttttctatccacagcagtgctgaatgtatatatacccttcggcctgcgattgagaccgctctttcactcacgacatgttatttgcacaataataacctgatagttacaaagacaatgttgcgacaatgataataaaactggcatctgccaggctgcgcggctactattttgcgctttgctaaaccgcatggatgcctgtttgcccgcactgtatgcggcgcgcctaatttgcgaaaccctatgcctgatccaatgtcatctgtaacggccagccacgatggtcgtgtaagtactgttcttcgctctccttcgctgctgatgcgcgaaaccctggccggggtgatcacggcccttgcgctgatcccggaagtgatttcgttttcagtgatcgccggtgtggatccaaaagtcagcctgatcgcctccgtggtgctgtgcctgtcgatgtcgctgctcggcggacgtccggcaatggttaccgcggcggcaggttccgtggcgctggtgatcggcccgatggtgcatcagcatggtgtggagtacatcctgccagcggtgctgctggccgggcttatccagatcctctttggcctcgcgggcatggcgcgtctgatgcgctttattccgcacagcgtgatgaccggctttgttaacgccctcggcatcctgattttcttcgcccaggtgccgcacttctggagccgggaaccgctgatcctcgggctgttcggcctgacgctgctgatcgtgctgtggttgccgcgctgggtgaaaagtatcccctccccgctggtggccattgtgctgctgacgctgtttaccgtgaccagcggccagatcttgccgaccgtcggcgatgaaggcccgatgcagggtggtctgccgggcttcacgcagtggctggtgccgttcaatctgcacacgctgagtatcatctggccgtgcgcgctgagtatcgcctttgtcgggctgatggaatccctgctgaccgccaaactggtggacgatctcaccgatacgcgctccagcaagcgtcgggaaagcgccggtctgggcatcgccaatatccttgccggactgtatggcggtatcgcgggctgcgcgatgatcggtcagaccatcgtgaatgtggaaatgggcaaaggccgtagccgtatctccacggtggcggcgggtctggtgctgctgctgttagtcaccgccctcagcgaggtgatggcaaaaatccccatggcggtgctggcaggcattatggtgattgtggcggtgaaaaccttcagctggcacagcatccgtccggcagagctgaaacaggcaccggtggcggaaaccctggtgatgctggtgacggtggccgccaccgtcagcaccggtaatctggctattggcgtcgccgctggcgtggcgctgatgtttgtgctgccaggccgccgccagcgcgccgcagacgctaaagcaaaaacagcgtcgccagacccagaaaaataaagaagccaccggtatccgtcagggcggtgatcatcacgctggagccgaccgccgggtcgcgccccagcctgaccataatcatcgggatcaacacccccatcagggcggcaaccagcagattcagcaccatggcgagggtcatcaccccgccaagggccatatcaccgtacaaccaccaggtgatgccgcccatgatgccgccccacaccaggccgttaatcagcgccacccccatctcacgaaaaatcagaaagcggaagttgccagggtggatcttttgcagcgccagcgcgcgcacgatcatggtgatggtctgattgccggtgttaccgccgataccggcgacgatgggcatcagcgaggccagcgccaccagctgtgaaatggtgtgctcaaagccgtcgatcacccgggaagcgataaacgcagtgcagagatttatcgccagccacgcccagcgggtacgcaccgctttgcccacaggcgcgaagacatcctcttcggcgctcagaccgcccatcagacgcatatcgttatcggtttcctgatacaccacgttcacgatctcatcgatggtcagacggcccatcagcgtgccggtggtgtccaccaccgcggcgctgagcaggttgtcacgctcaaaggtacgggcggcattttcggcgtcgtcttccggcgagaagatcaccggatcgctttccatcacttcactgaccttcaccgatccggtattgagcaggatggtctgcaacggcagctcgcccagcagcacgttgtcccgcccggtgacaaagagtttgtcggtgttttccggcattttgtcgagacggcgcagaaagcgctgcacggtggccagcgtcacatccgggcgcacggtgataacggcgaactccatgttcgcgccgacgctggtcttcgggtagtgcatgacctgatgcacccgcgcgcgctcccccgccggtagcgaggcgaccagccgtccggtcaggttacgcggcaggcgctgaacaagataaatctgctcgtcgatgtcgagggttttcagggcatcgagcaacgctttgtcgctcatgccctcaataaggtcgtcccagacgttttccgaggcttccagcagcacttcgccgcgtttggtgtggtcgatcagctgccagaccgcgtgacgggcatcggcgggcagcgcctccagcgcatccgccagatccggcggcggcaaatgcgccaccagcgcgcccacttccgccatatcttccgccagcgtgccgacgtcatactgttctgcgagcgtcagcttgttgagtaaggtggaggtgatcgctttatcggtggtgagcagccagatcaggcgcgctcgttcttcatcgcgcaaccgggcgctgttgtttggtatgactgacataggacatccctgcattcgtgatcatgatgacagggtaaagcatagcggcaggtaagataaataaatggaatgaataaaaaaacccggcgcaacgagccgggctttttcgatcaggcggtacgggacaccgcatcgcgtgacgcggcatcgcgctctgcgccggtcagctctgacaatttgccgtcccgcatctccagcagacgatcggcgtgaataaagtagtgatcgtcatggctgatggcgaaaatggttttacccatttctttcatcaatggcagcagcacctgatagaactcgcgacggaaatgcggatcctgatcggcggcccactcatccagcaggatgatgtcacgatcttccgccagcgccagcagcagggccacgcgcttcttctgccctttcgaaagcttgagattgaggattttgccgtccttcagctccagcttgtgggacattttcagctgattaagccatttgtccaccagcgccggatcggcagatttgccctgcgggccaagcaattgatcaaacaaccagacatcggtaaacactgccgagaacagctgacgatagtcttccggtttgtttgccgccagcggcttgccgtcgataaggatttcaccggacaccggctgatacagtccggtaagcagcatcgccagcgtcgatttgccgctgccgttgccgccgatcagaaataccagctcgccccggtgcagcgtcagattcagcgggccgacggcaaaggcgttgtcctgataggtaaaggtgacatcgcgcatttcaagcgtctgccagccctgtagcgacaccggacgcgggaattcttctttataaggcgcgagatcaaactggttcagcttgttgaacgccacctgcgcgctgagcagcgtcggcagcgcgccgaccgccgacagcaacggcgtgcgcaggaacagcacggtaagggagaagatcgccgcgacattggtatccgcccagccgaggctgttggccatccagaacaccaggccaatcgcccccagcatcataatgtttgaccagttcaccgcgctcaggtggaaagtgtcggcgcgaataatatggtggcggtattcccgcgcatccggcagatagagctggttatagatgtattcggcgcgttcgcggttgagggtcagttctttacgcccttccagcaccgtctggtaatcgttatgcagtttgtcttcggtttcacgcagcgtggcgatatgtttgtacacccgcgccaccagcacaaatcccacccaaatggtgatcgccatccataccgcggtgaccatcagcattttaccggacagccagcccatgtaagccgtgcagccgacggtcagaataatgccctgcaccagttccggcagacggacaaaggcgatggtgatattacgcacgtcgctggtcagccccgccagcagagaggcgctgccgagctgctcaatacgctcgacgtgagtatccagaatacgcttgataaattcactgcgcagacggtaaacgaaatggtgaccgagggtggtcagcgccagctgggagccgagggtgaccgccatcaacaggatcagcagcccgagaaattccggtagcacggagagcgaaatatcaacgttttcaatcagccgctggttgataaaggcaatcagcccgatacccagcgcggcgctggcaaggcttaacgccagcacggcaataaaaggccagcgatattgtcgccagacgagaagaagaagtggcataaaagcgatccgcacagagtaaaaacagcgtgcagtgtaaacggctcttgtactggatcaagaataattgctatttatgttcgcaataaccccgcctggcggaacgtcaggttgtagcggtactcgccggtgtccggatgctgcccggctttgagcggcagaatgccatgataaaagagacgcgattcgccgccccataccaccacatccccctgctccagcatcacccgggcgacaggatcgttacgtttcaggccgccaaactgaaaaaccgcgggcagccccagcgaaacggacacaataggcgcgcgcagatccggctcgtctttatcctgatgcaacgagagtttcgcgcccggcgcatagcggttaatcagacaggcgtcaggggtaaaatcgggatagcccgccgcctgcgccgcgcgatcgcacaatgaacggaacacctccggcatcaatggccacgggcgctgcgtgaggggatcttccgtcgcatacagataaccccgcgcattggtcgcccagccgaggttaccgcagttggtcatcgccaccgacatggtgtagccgccgggggtgatcatatggcgaaacggcgactgcgccgccacctgcgcgatgccgtccagcaacgcctgcgcctcgctgacggcaaaacggcgcaggatcaccgcgcccggtgcgagtggctcctgccagggttcttcatcggcaaacaaatccagcattacggctcctcctgttcagattcacgggccagcaattgcgctttgcgcgccagtccccagcgataaccggaaagcgcgccattgacgcgcagcacgcggtgacaggggatcaccaccgccagcgtattggccgcacaggcgctggcgacggcgcgcacggcacggggtttgccgatggcttgcgccacccgctgatagctgacggtctctccggcagggatctggcgtagcgcgttccatacctgccgctgaaaggcggtgccgcgcagatccagcggcagcgccagggtatgtcgcgggttatccagcaccgcaatcacctgatgcacccgtcgggtgaaatcctcatcgcccgcttctctgtgcgcaccgggaaaggcgcgcgccagttcggcaagcagctgctcgtcgctgtcagccagcaaaatggcgcagataccgcgctcgctttccgccaccaggcagcgccccagcgtacagccttccagcgcatagcgaagggtggtgtccctgccgccgctgcggtattgctgcgccgtcatgccaagcgcccgatccgcgtgacgataatagctgctgctgtccgggaatccggcggccagcacggcgtcggtcaccgttgtgcctgcggccagattttgccgcagacgttctgcgcgatatgccagttgccaggctttgggcgtcatgccggtagtggctttaaaaaggcgatggaaatgataaggactcatcgccacctgccgcgccagcgcgtcgagggtgacgggggtgtcctgctccagcagacgacatgcctgttcgattttatcgcggcggtgctgaccggcggcaggaagatccggctggcagcgtttgcagggacgaaagcccgccgccctggcgctgtcggcatcggggaaaaaacgcacgttctcccgcagcgcatgacgggcgcggcacgacgggcggcagtaaatcccggtggtgatcaccgcaaaaataaagtgaccatcagcgtcgggattgcgatccagcaccgcctgccagcggtgcgcatcgttttgcaacagtagttcagacatggcgggctcctccgttaagtgtagcctgaggatgagccacaccggcagccttcgcacccgcaatcttgcggtttaatttttttcgctcaccagaaaggcctggaactgtggcgtcatccagggaacaaatttatccccctctttggtgatcatatacaccgccagcccctcgcggcgcgccacttctttcgcctgctgcggcccgagcaccatcagcccggtatcccagccgtccgcctccagcgccgttggcgcgatcaccgtcaccgacaccagattgtgcgtaatcggactgccggtctgcggatcgataacgtgggaaagccgtttgccgtccagctcatagtagttgcggtagctgccggaggtgctgataccgtggccgttaatatcgacaatggcctgcaccgcgttttcgcgatcggtgggcttctggatcgccacccgccatggcttgccgtcgccgttcatgccgcggctggcgagcgcgccgcctacggataccagatagcgcgggatcccctcctgcgccatcagatgcgccagatgatcggcggcgtagccttcgccgacggtggagaggtcaacaaacagatccggcagatctttttgcagatactgtcgcccggcctcctgggtgaccgtcagatgttgcagaccggtacgcgctttcgcggcgtcgatttgttcctgcgacgggatggtgactggctgtttgtccgggccaaagccccacagattgaccagcgggccgacggtaatatccatcgcgccctcggttttatagccaatgcgcagtgaggtggtgacaatatccgccatcgcttcgctcacaggccagggcgtcaggctggaggaggcgttaaagcgcatcagggcagagtcatttttccaggtcgacatcatctgatcgtcagcatcgagctgcgcctggattttttgccggagttcgtcggcgcgcggtttttccaggttcacaacgctgacgcgccatgaggtgcccatggttttaccttccagcacggtgaccgctgacgccgccggttgtgggctggataccgcgtcacagcccgctaaaaaaactgaagccgcgagcgtcgcggcacgaagaaaacgcagatccatgtcttttccccccttgctgaatgcgcgcaagggtacactaaaagtctaagtttgtgagcaataaaaaaaggggccgtgcggccccttcgctaagcgtctcagttgattagaactggtaaaccacgcccagcgcaacgatatcatccgtgctgatgccagcctgacgggtgaaggtgttgtcgtccagcaggttgattttgtaatcaacgtaggtggagaggtttttgttgaagtagtaagtggtgcccacatcaacatatttcagcagatcctggtcgccgaaatcacggccgttagcgctgctgatgtctttcccgcgggattgcaggtacgcgatggacggacgcaggccgaagtcgaactggtactgtgcaacggcttcgaagttctgtgctttatccgcaaagccccatgcggcagtacggccggaaccgttagaggtaccgaaacgggtcgcgttgtaagtctgggagaactgcgctgccaggtaaacgttgttggcatcgtatttcaggccgccgctgtagacgtcagcgcggtcgccgttaccgtaagcgtctgccacgttctggtcagaggtacgtttggaggaagacattgcgccgcccacgctgaagccttcgcccagatcgtaggtcagggacatgccgtagccgtcgccgttctgtttcagggtgctgcgaccattgtcgttttcaccgctggtgctgccgtttttgccctggtactgcaccgcaaagttcaggccatcaaccagaccgaagaagtcggtgttacggtaagtcgccacgccgttagcacgggactgcatgaagttgtccgcgccgtaggtatcgccgccgaattccggcagcacgtcggtccaggaggtcacatcgtagatcacgccgtagttacgaccgtaatcgatggcaccggcatcaccgaaacgcacaccggcaaaggccagacgggtccatgcctggtcgcttgcgccttcggcttcgtccgcctgtacgttgtattcccactggccgaaaccggtgatctggtcgttaacctgagtttcgcccttgaagccgaaacgtacgtaggttttgtcgccgtcgtcgccatcgttatcagagaaatagtgcaggccgtcgactttaccgtacagatctaatttgttgccgtctttgttataaatttcagccgcatttgcagcgcctgctacgagcagagcaggcaccaccagggaaaggactttgcgtttcatgttattaaccctctgtaatatgcttatttttatatgccactgcttactgattaacctgctaaccagtcggcgagttcattctccctaaaaatacagaataatccaacaacattatgatacgaaaaatctaaaggtgtttctctttaccgcttagatgtttcaatatgtaaactgcacggaactttttttagcactaatagctaaaaaatagcgcacggaaaatcaaagatgataattaaatcaatataatcaataagttgaaatgacaaacaatgatagcactgaatgataaaacaaaatcataacctgcgactaaaataatctggctatcatcattaacttttatttattaccttcattcggcttcgaatgactgtttacccctattacaaccggatgctctgcattcggtttttttttgccctgcaccgcccggataacagaaaaagcggtaccgcaggtaaattataatgactattaattaatcacttagccacagggtgatattagctaccaatactccgtaaattaatttcttgattaaaagtgctatccctttacttttcagagttaataacgggaaaaatggtgattaattgtacgtgccttaccgatccgctgtgccgcctccctttttgtccccccgctgcggcctttacctgcaagagagtctggaaattcattcattaggctttatactgcctgctgtacactgccgtgtaacataacaactacaagcccgacgcaggcgcgagcggcgcggtagtctcctgtcttagtcttacgaaaggcgctaaatggctttttcttcgcgtgttggcataacgggttacacacactaatgagtcgatctgacaccatgaaccctggaaaattttccctgataccgggcagcattacccgtttctttcttctgttgatcatcgttctgctggtcaccatgggtgtaatggtgcaaagcgccgttaatgcctggctgaaggataaaagctatcaggtggtggatattacgcatgccatgcataagcgcattgatacctggcgctacgccacctggcagatctatgacaatatcgccgcggcgcccgcctccccggcggatggtctgcaggaaacccgcttaaagcaggatgtctattatctggagaagccgcgccgtaagacggaagcgctgattttcggctcccatgacggctcgacgctggagatgacccagcgcatctcaacctatctggatacgctgtggggcgcggaaaccgtgccctggtccatgtattatctcaacggccaggataacagcatgatcctggtgtcgacgctgccgctgaaagatctgtcctccggctttaaagaatcatccattggcagcattgtcgatgcccgtcgcgcggagatgctgcaacaggccaatgccctggatgagcgggaaagcttctcgccgttgcgccgtctgacctggcagaatggttactatttcacgctgcgcactactttcaaccagccgggacatctggcgacggtggtggccttcgatttgccgatcaacgatttgatcccgccgggcatggtgctggacagtttccgtctggagagcgatgcctcccagagcgccctgcgcaccgcggataaagagatggcggacagcgcgtcggtgaatttcaacagctcgcagattgagatttcctcctcactcaactctacgggcatgcggctggtgtggcaggtgccctttggcacgctgctgctggacacgctgcaaaacatcctgctgccgctgctgttaaacatcggcctgctggcgctggcgctgtttggctataccaccttccgccatcagccgggccgtctgagcgaaaacgccgccctgcccggcgcgaataacgaactgcgcatgctgcgggccatcaacgaagagatcgtgtcggtgctgccgctgggactgctggtgcacgatcaggaagccaaccgtacggtgatcagcaataaaatcgccgaccacctgctgccgcatcttaatttgcagaacatcaccagcatggccgatcagcatcagggcgtgatccaggcgacggtcaacaacgaactttatgagatccgccagttccgtagccaggtttcgccgcgcacgcagatttttgtcatccgcgatcaggacagagaagtgctggtgaataaaaagctcaagcaggcgcagcgtctgtatgagaaaaaccagcagggtcgcaccgcctttatgcagcatattggcgcggcgctgtcgcagccggcgaaacaactggcgcaggacgcggcggcggtagatagcgaaaacgcgcaaaagctggcagcgcaggctgaccggctggtacagctggtggatgagatccagcttgccaatttgctggaaaacgacggctggaaaagcgccgccagcatgttctcgattcaggatctgatcgacgaggtggtgcccgcggtgctgccggtggtgaagcgtaaagggttgcagttgctgatcaataatcatctgccagccaacgaacagcgccacggcgatcgcgacgccctgctacgcattctgaccatgcttatccagtacgcggtgaccaccacgcagattggcaaaatcacgctcgaagtggacgccgatgaatccgcaggggatcgcctgaccttccgtatcctcgataccggggaaggcgtgacggcgagcgaagtggataatctgcatttcccgttcctcaacgacacccaggaggatcgctatggcaaagctaatgccctcaccttctggctgtgcgatcagctggcgcgtaaacttggcggccatctgaatattaaagcgcgtgaaagtttaggaacgcgctattctttacacgttaaaatggatgcacgtccgcaggcagacgatgaggaagagaaattactggatgatgtcgtcgccatgattgatattacgtccagcgatattcgtaatatcgtggtgcgtcagctggaaaactggggcgcaagctgcattaccccggacgaacgcctggcgagtcaagaatatgatctctttttaacggataatccgtctaatcttactgcctcgggcttgcttttaagcgatgatgagcccggctcgcgtaaaatcggcccaggccagttgcgcgtgaactttaatatgagtaatgcaatgcaggaagcgatattgcaactcattgaagagcaactggcacaggaagatgttccggcgtccccgctggggggcaatgaaaatgccgaactccatgccagcggctattacgcactgtttgtggatacagtacccgacgatgttaagaggttgtatactgaatccgccgcacgcgatttagcggcgctggcgcagacggcacaccgcctgaaaggcgtgtttgccatgcttaacctggtacccggcaaacagttatgtgaaacgctggaacatttaattcatgagaacgatgttccaggcatagaaaaatacatcagcgacattgacgattatgtcaaaagcttgctgtaagcaaggtagccttatacatgaacaatatgaacgtaattattgccgatgaccatccgatcgtactgttcggtattcgcaaatcactcgaacaaatcgagtgggtgaatgtagtcggtgaatttgaagattctacacagctgatcaataaccttcccaagcttgatgcccatgtactgattaccgatctttccatgcccggcgacaagtacggtgacgggatcaccctgattaaatatatcaagcgccacttccctaacctgtcagtgattgtgctgacgatgaacaacaaccctgccattttaagcgccgtactggagctggatatcgaagggattgtattaaaacagggcgcgccaaccgatctgccgaaagcgctggccgcgttgcagaaagggaagaagtttaccccggagagcgtttcccgtctgctggagaaaatcagcgcgggcggctatggcgacaaacgcctgtctccgaaagagagcgaagtgctgcgtctgttcgcagaaggtttcctggtgacggaaatcgccaagaagctgaaccgcagtatcaaaaccatcagtagccagaagaagtcggcgatgatgaaactgggcgtggaaaatgacattgccctgcttaactacctctcgtccgtaacgctgagcgcggcggataccaaagagtaactgccataccgacgttaccccgcccggcggggtaacgccttttcctgctttatccccgcgcttttcttacccgttccgcatagaccgccagcgtctgctggatcacgtccagcgttaccggcttcgacagacagctgtccataccggactccagacaacgctgcttctcttccgccagcgcgttcgccgtcacgcccaccaccggcagcgtcagcccaagctgacgaatacgctgcgtcaggcgatagccatccatgttcggcatgttcacatcgctcagaatgatgtcgatatggtttttgctcagcacattgagcgcgtcgacgccatcgttcgccgttttgcactgatagcccagcgaaccgagctgatccgccagcaggcgacggttaatcggatggtcatccaccaccaggatcatcatgtcgtcattgctggcgaccagcgaatccggcagttgcagcgcacgtgaggcgtcgttattttccatggtaatgctgtagatacgcgccagcagcgcgatcagctcatggggagaggcaacactgtgcacccactgtccggccgcccgctcctgcggaatgccgatatggcgacggcagaaggtaatggtggcgcggcctggccacggcgtatccagatcgtcgtcggtgatcagggtatcgttggcgtccggcgtttgcccttcgtaacgcagcacgcggatgccgttctgcgtcagcaaggagtcaataaaggcgcttaacgccgcattgcgcaccgccagccagcaggtggttttcttcaggccgtcaacgtccagcggctgcgctggctgcgcggcataaagcggaatacgcaccgagaactgactgcccatgcccggctcggtatccacggcaatatcgccgtccatcatgctgatcagcttttcgcagatcgccagccccagccctgtgccctggaaattacgttgcacgccggtccccacctggaagaagggatcgaagagtcgcaccacttctttacccgggatacccaccccggtgtcccgcacgcggatacagagatattccccggcgcgctgcacatgcagcacaatacagccgacatcggtaaacttgatggcgttgctcagcaggttggagatcacctgttgcagacgcatcggatcgccctgaagcgccaccggcacgtccggctcgataaagcagtacaggccgagctgtttacgcaccaccagcggcagatagttggcggtgatatggctcatcagctcacgcggcgagaattcgcgcggctcgattttgagctgctccgattcgattttggagaagtcgagaatatcgctgatgattttcagcagcagactcgacgagttgttcatcgccgtcaccaggcgatccacccctttcggcagctctttggtttgcagcagatcgaggttgccgataataccgtacagcggcgtacgcagttcgtggctgacggtggcaaggaacatggatttcgactggctggcctgctcggccgcctgcgccatatcctgcaacgactcttccatcttcacgcgcgcgctgacgtccaccagcacgcagatcgccacgttttcgttgcgatagcgggagtgcacgaagctgatttgcagattggtattgttgctggtcagcacatccacaaaattgacctgctggccgcagatgatttgcgtcagccgctgcctgtcctcgtgggtgagcatattgagataattatgcgccagctcgttactgaggatattggtgccgtcaatggtgcgcagaatacagatcccgaccggtgcggaggcgacaattttgcggttgaactgctcatgctcttccagtcgctgggcatcggcctcggcgggaataaagatccgccgctcgtacatgcgcgccagggtgaacaacgccacgcccaccagcacgttgagcagtaccgcgttaaggataaggatgcgcacgcgctccagcaccagatcgacaggtacggaataaactacgctcagggacgacggcggcaggctcttcttcagtaccagctcgcggaagccagaggagtagccaaaccaggtgcgctcctgtatccactccggatcgatttccaggctattttccggcccggtcagggaaatcagttgatgcccgttttcatcgagaatggtcacgcccaccggcagattgcccggcgtgtaaaagttatccatgcggatggtctgctctgatcccagcagcgcctgtaagcggttgcccagatagaccggcgttaaggcatagaaatagccgatgcccggacgcggcccctgactcatccagaagatattattgccgcgctcttcctgcggggcattacggtatttgagaatacgctcgtgcaggcttttcagcgccgtttcacgctccagcggtacgttgcgcaggccgaagtccgccatacagagggattcgttgccaatgaggaacacgcggttcagctcataagcggcagaaaagttatcgcgccagtagcgcataaaccacgccagcgattccagcgagccgcgccaggtgttgcccatggccgagcagtcggaatccgcaaacagcggcgcaaactccggcacatcgttacgggcgttgggtccccgtgacgtcataatgccgttttcagcggtcaggcgattttcggcaatgtacttaagctctttcatcacgtctgaggtgcgctggacatagcgttgcgcctgctcagaactgagattaagttctttgcgaatgtcggactctttgttctgcaaagcgttaacgatataaaacaccgaacacagggcaatcaacagccagagcagcagcgccagcgcccggaacaggtatcgtgatactttgagggtggtgcggaaagaaacaaggtatttcaagggggcgaagctccgccgcagaatgtaaaaagaatgtggataaagtagcggtaaaacgtcatacccgcaacgctaaagaaaacgccaataaaaagggccggaagcccggcccttttatcgacaaagctgattattcttcagcgtcgtctgcgacatcatcatcggtgtccgcttccggcacgatctcgtcgtcaccttccgctacgctgccgtcgatggcatccagctcttcttcatccaccggctcagccacgcgttgcagccccaccacgttctcatcttccgcggtacggatgaggatcacgccctgggtgttacgacccacaatgctgacttcagacacgcgggtacgcaccagcgtaccggcatcggtgatcatcatgatctgatcgctgtcggccacctgcaccgcacccaccacggagccgttacgctcggtgactttgatggagataacgccctgggtaccacgggatttggtcgggtattccgtttccgccgtacgtttaccgtagccgttctgggtgacggtcaggatcgccccttcaccgcgcggaacgataagcgacacgactttatcttcgcccgccagtttgatcccacgcacgcccgttgcggtacggcccatggcgcgcaccgcgttctctttaaagcgcaccactttaccggcggcagagaacagcatcacttcatcagagccggaggtcaggtcaacgccaatcagctcgtcgccgtcgttcaggttcaccgcgataataccggcagagcgcggacggctgaattcggtcagcgccgttttcttcacggtaccgctggcggtggccataaagacgttcacgccctcttcgtactcgcgtaccggcagaatagcggtgatacgttcgttcgcttccagcggcagcaggttgacgattggacgtccacgcgcgccacggctcgcttccggcagctggtacactttcatccagtacagacggccacggctggagaagcagaggatggtgtcgtgggtgttggccaccagcagacggtcgataaagtcttcttctttaatacgggcggcggatttgcctttaccgccgcgacgctgcgcttcgtaatccgtcagcggctgatacttcacgtagccctggtgagacagggtgaccaccacgtcttcctggctgatcagatcttcgatgttgatatcagcggtattggcggtgatttcggtgcgacgcgcatcgccaaactgttcacgaaccagttccagctcttcgcggatcacttccatcagacgatcggcgctgcccagaatgcgcagcagttcggcgatctgttccagcaactctttgtattcgtcgagcagtttttcatgctcaaggccggtcagtttctgcagacgcagatccagaatcgcctgtgcctgctgttcagtcaggtagtactgaccgtcacgcacgccgaattccggctccagccactcaggacgcgcagcgtcatcgcccgcacgttccagcatggcagagacgttgcccagctcccaggaacgcgccaccagaccggctttcgcttcggccggggtcggcgcgcggcggatcagctcgataattggatcgatgttggccagcgcaatcgccagcgcttcgaggatgtgcgcacgatcgcgggctttacgcagttcaaaaatggtacgacgggtcaccacttcacgacggtggcgcacaaacgcagaaagaatatctttcaggttcatgatcttcggctgaccatggtgcagtgccaccatgttgataccgaaggagacctgcatctgagtctgcgaatagaggttgttcagcaccacttcgccaacggcatcgcgcttgatctcaatgacaatacgcatcccgtctttatcagactcgtcgcgcaggccgctgatgccttccagacgtttttctttcaccagttcggcgattttctcaatcaggcgcgctttgttcacctgatacggaatttcatgcacgataatggtttcgcgaccggttttggcgtcggcttccacttccgcgcgggcgcgaatgtagattttgccgcgaccggtacgataggcttcttcaataccgcggcgaccgttaataatggcggcagtcgggaagtcaggccctggaatgtgttccatcagcccttcaacgctgatattttcatcgtcgatatacgccagacagccgttgatcacttccgtcaggttgtgcggcggaatgttggtcgccatacctacagcgataccggaggccccgtttaccagcaggttagggattttagtgggcatcacgtccggaattttttccgtgccgtcatagttgtccacaaaatcaacggtttctttttccagatcggccatcagttcgtgggcgatcttcgacatacggatttccgtataacgcatcgccgcagcggagtcgccgtctacggaaccgaagttaccctggccgtcgaccagcatgtaacgtaaggagaatggctgcgccatacgaacgatagtgtcatataccgcggtatcaccatgaggatggtatttaccgatgacatcaccgacgacgcgggcagattttttgtaggctttattccagtcattgcccaatacgttcatggcgtatagtacgcgacggtgaaccggttttaagccatcgcggacatccggcagcgcacggccaacaatgaccgacatcgcatagtccagataggagctcttcagctcttcctcgatgttaaccggtgtaatttctctcgcaaggtcgctcatgtaaccgctatccctctactgtgtcccggattcaaaggtcgcaaattataacacagcccgcgcgtgagaggtaaaccaatcggtttattcacgcccgtggcctgatatacttcacggtcttgatgataaaggagtaaaagcgcccatgaatgtcgaaaaaccgtcggtggctcataacgtcgaccacgatgaaattgcgaaatttgaagcggtcgcgtctcgctggtgggatctggaaggcgagttcaaaccattgcaccgtattaacccgctgcgcctgggctatatttccgaacgcgctggcggcctgtttggtaagcaggtgctggacgtaggctgcggtggcggcattctggcggagagcatggcgcgcgaaggcgcaaccgtgaccggcctggatatgggctttgagccgttacaggtggcgcgcctgcatgcgctggaatccggcgtcaacgttgactacgtgcagcggacagtagaagaacacgccgccgcccacccgcagcaatatgatgtagtgacctgcatggagatgctggagcacgtgccggatccacagtccgtggtgaacgcctgcgcaaaactggtgaaacccggcggccacgtcttcttctctacccttaaccgcaacggcaaagcctggctgatggcggtggtcggtgcggaatacgtactgcgcatggtgccgaaaggtacgcacgatgtgaaaaaattcatcaagccggcagagctgctgggctggatcgatgacaccgtgctgaaggagtgccatatcaccggcctgcactacaacccgctgaccgacaaattcaagctcgcgccaggggttgacgttaactatatgctgcatacaaaagcacgaaacgactaacgtcatgcgaaattgttatgaagattgcgtgacaggacgttacgcattttctcccgccgatgaagaaatcagcactcgatcaaatttcttattttttttgcaaatgattgactttccctggaggccttacagttcggggacttagcgattcttaccttttcgcaaccttaaattaacgccaaaatcaactcttgtactcaaaagaatccctactagaatactcaccatatagcgtttctcttatcgcaaaccccctacatgtagtatttatccacagagttagccacagcgcggacttgtggataagcgggggatattttttctatttcacggacaggtaaatcccacatgaatcagagtctgctggtgacaaagcgtgatggtcgtactgagcgcatcaatctggataaaatccaccgcgtactggattgggcggcagaagggctgaataacgtctccatctctcaggttgaactgcgttcacacattcagttttatgacggcattaaaacctccgacattcatgaaaccatcatcaaagccgccgccgatctgatctcccgcgacgcgcctgactatcagtatctggccgcgcgcctggcgattttccatctgcgcaaaaaagcctacggccagtttgagccgccgacgctgttcaaccacgtgctgaaaatggttgagctgggcaaatatgaccaccatctgctggaagactacagcgaagaagagttccgccagatggacgcctttatccagcacgatcgcgatctgaccttctcctacgctgccgtgaagcagctggaaggcaaatacctggtgcagaaccgcgtgaccggcgaaatctacgagagcgcgcagttcctgtatattctggtggccgcatgcctgttctcgaactacccgcgtgaaacccgtctggactacgtgaagcgtttctatgacgccgtatccacctttaagatttcactgccgacgccgatcatgtccggcgtgcgcaccccgacccgtcagttcagctcctgcgtgctgatcgagtgcggcgacagcctggattccatcaacgccacctccagcgccatcgtgaaatacgtgtcccagcgcgccggtatcggcatcaacgccggtcgcatccgtgcgctgggcagcccgatccgtggcggcgaagccttccacactggctgtatcccgttctacaaacatttccagaccgcggtgaagtcctgctcccagggcggcgtgcgcggcggtgcagccaccctgttctacccgatgtggcatctggaagtggaaagcctgctggtgctgaaaaacaaccgtggcgtggaaggcaaccgcgtacgtcacatggattacggcgtacagatcaacaaactgatgtacacccgtctgctgaaaggtgaagacatcaccctgttcagcccgtctgacgtgcctggcctgtacgacgccttcttcgccgatcaggacgagtttgagcgtctgtatacccagtacgaaaaagacgacagcatccgcaagcagcgcgtaaaagcggtagatctgttctcgctgatgatgcaggaacgtgcttccacgggccgtatctatatccagaacgttgaccactgcaacacccacagcccgttcgatccggctattgctccggtgcgccagtctaacctgtgcctggaaatcgccctgccgaccaaaccgctgatggacgtgaacgacgaaaacggcgaaatcgcgctgtgtacgctgtctgcgttcaacctcggcgctatcgattcgctggacgagctggaagagctggcgacccttgcggtacgtgctctggacgccctgctggactatcaggattacccgatcccggctgcaaaacgtggcgcaatgggccgccgcacgctgggtattggcgtgatcaacttcgcttactatttagcgaaacacggcgtgcgttactccgacggcagcgccaacaacctgacgcataaaacctttgaagccattcagtacttcctgctgaaagcctctaacgagctggcgaaagagcaaggcgcctgcccgtggttcaacgaaaccacctatgcgaaaggtattctgccgaccgatacctacaagaaagatctggacgccatcgtcaccaaagagctgcattacgactgggaagcgctgcgcgaatccattaaaacgcacggtctgcgtaactccacgctctctgcgctgatgccgtccgagacttcgtcgcagatctccaacgccaccaacggtattgaaccgccgcgcggccacgtgagcatcaaagcgtcgaaagacggtattctgcgtcaggtggtgccggattatgagcacctgaaagacagctatgaactgctgtgggatatgccgaataacgacggttatctgcaactggtgggcatcatgcagaagtttatcgaccagtcgatctctgccaacaccaactacgatccgacgcgcttcccgtcagggaaagtcccgatgcagcagctgttgaaagatctgcttaccgcctacaaatttggcgtgaagacgctgtattaccagaacacccgcgatggcgcagaagattcacaggatgacctggtgccgtccattcaggatgatggctgcgaaagcggcgcgtgtaagatttaataaattgcccggcggcgcaaagcctgccgggcctgaggttaggttttgtaggccgggtaagctttgcgccacccggcgtatcattgcaggacaggaaatactcgcatggcatacaccaccttttcacagacgaaaaataaccagctgctggaaccgatgtttttcggccagccggtgaacgttgcacgctacgatcagcaaaaatatgacatcttcgaaaagctgatcgagaaacaactctctttcttctggcgtccggaagaagttgacgtctcccgtgaccgtatcgacttccaggccctgccggaacacgaaaagcacatctttttaagcaacctgaaataccagacgctgctggattccattcagggacgcagcccgaacgtggcgctgctgccgctgatctccattccggaactggaaacctgggtggaaacctgggcgttttcagaaaccatccactcccgctcctacactcatatcattcgcaacattgtgaacgatccggcggtggtgtttgacgatatcgtgaccaacgagcagatcctcaaacgcgccgaaggtatttctcactactacgacgatctgatcgagctgaccagctactggcatctgctgggtgaaggcacgcataacgtcaacggcaaaaccgtgaccgttaacctgcgcgagctgaaaaagaaactgtacctgtgcctgatgagcgtcaacgcgctggaagcgatccgcttctacgtcagcttcgcctgctctttcgccttcgccgagcgcgagctgatggaaggcaacgccaaaatcatcaagctgatcgcccgtgacgaagccctgcacctgaccggcacccagcatatgctgaacctgctgcgcagcggcgtggacgatcccgagatggccgagatcgccgaagagtgtaagcaggagtgctatgacctgtttgtactggcggcggaacaggaaaaagagtgggcagcctacctgttccagggcggctccatgatcggcctgaacaaagacattctttgccagtatgtggattacatcaccaacatccgcatgcaggccgtgggtcttgatttaccgttccagacccgctcgaacccgatcccgtggatcaacgcctggctggtgtccgacaacgtgcaggtcgcgccgcaggaagtggaagtcagctcttatctggtcggtcagattgattccgaagtgaacactgacgatctgagtgacttccagctctgatgagccgcgtcattctgcgcatcactggcacagaactcctgtgccaggatgaacatccgtcgttactggcggcgctggaatcgcaccaggtggcggtggaatatcagtgtcgtgaaggctattgcggctcctgccgcacgcggctggtggccggtcaggttgactggctgaccgagccgctggcctttatttccgccggtgaaatccttccctgctgttgccgtgcgcgtggcgatattgaaatcgagttatagcgcgtcagattttccgcaaatgaattaatttccggcgtttattatttcagctccccaaacgtcagcagctaccgcaaataatataaaaaaaccctgaacagcactgttcagggttaaattcctggttgacatcactcacacaggaataactagctctcctttatttcttccggatgatgatggagttcactcacccgataataaataggggtaatatcgacataattgatgcagtaaccgcttccgcgcacgctggtgataaaatcttccggcagccctaacagactaagacgacggttaagattcttcagaacctgccacagacgctgggtggacggaaccagatcgttctcctcccacaccacgcgcagcagttcctctttggtcacgatgttctggcggccatgctggagtaaatagataaatagctgcaacatcgtatgattaaataatactgagccgaacataaaatatttctcagtacttccctgcggaaggcggtaaagtcttccgttgtcaatttcgaagtgaacttctttgcctatcacatagccgtacagccgatatcccatcgtgtcgttgctcatttgtcctgaaactttgcaaggaatgccttttttattcctgttcataggccatactgtcaataaggtcgattatatggctatgggaattagtttcaacatacagggggaaggttattttggcacaggccatcgcacgtcgacaaaatatttacacaacctaagtaaaatattaagcatctatccgcgcaaattgaactacaaaaagtccagacacctgcaggatgatcgctatccggatcattaactttaaatattaatttatgccttttttgcaggataaaatgctggtcaggaatatcgcgcaaaaaaatgcccctccggacggagaggcatcagaccagggttaaccgcgtttacgggctattgcttcgtgatgctttttctcaccgatcatcaccaccagcaacagcagcacagcgatgacgctaccgccaatcatcaccataaagccgccgtcccagccgaagaaatcgacggtatagccgacaatggcgctggccgccaccgagccgcccagataaccaaacaggccggtaaagcctgccgccgtccctgccgcttttttcggtgccagctccagcgcatgcagaccaatcagcatcaccgggccgtaaatcaggaagccgatgacgatcatgcagatcatgtccaccgtcgggttgcccggcgggttcagccagtacacgacggtggcgatggtcaccagcgtcataaagaatacgccggtcgcgccacggttgcccctgaacactttatccgacatccagccgcacagcagcgtgcccggaataccggcatattcatacaggaagtaagcccatgacgacttatccagcgcgaagtgtttcacctctttcagataggtcggcgaccagtcgagaatgccgtagcgcagcagataaacaaaaacgttcgcaatggcgatgtaccacagcaatttattcggcagcacatactgcataaagatctgcttcgcggtcagctcttcttcggttttttcgctgtaatcatccggatagtcgttcttatattcttcaataggcggtaatccgcaggactgcggggtgtcgcgcatcagggcaaaggcaatgaacgccacgacgatagccgcgaacgccggcatatagagcgccgctttccagtcgttgaaccacgccatgccgagcaggaacagcaagggcgggatcccgccgccaacgttatgcgcgcagttccacaccgacacgatgccgccgcgctctttctgcgaccaccagtgcaccatggtgcgtccgcacggcggccagcccatcccctggaaccagccgcataaaaacagcagcacaaacataatggcaatgctggaggtcgcccagggcacaaagcccataaacagcattacggcggcggcaaggatcagccccgccggtaagaagacgcgcggattcgagcgatccgacaccgatcccatgatgaatttggaaaagccgtaggcaatggaaatccctgacagcgcaaagcccagatcgccgcgggaaaagccctgctccaccaggaacggcatcgccagcgcaaagtttttccgcaccaggtaatacgccgcgtagccgaagaaaatgcccataaaaatctgccagcgtaaacgccggtaatacggatcgatctgctgctccggtaaccggggttgatgcgcggcaggtttaaagatgctcaacataaagcctccgtggcatgtgttgttttgtaatgagtgaaaacgagcgtcacgccgcctcaaaagcgtgcgacgagtgaagactggacgttaacgcaggaaaagtcgcgtcgaatgttacagaaatatgacaaggcgctcaattcacgcaacaaatgttcttttactttcgttttatgcgcgaatatgcgcgcaatcaaacaaaccacacaaggaatgtggctaaatgcgcaataagggtcattaagataagagggaagcgaaaatgcgcgacgtgactgagtacgacgtcatcattatcggcggcggcgcaaccggggcggggatcgcccgcgactgtgcgctgcgcgggctgcgtgtggtgctgctggaacgccacgacatcgccaccggcgccaccgggcgtaaccacggcctgctgcacagcggcgcgcgctatgcggtaacggatgaagaatcggcgcgggagtgtatcagcgaaaaccagatcctgcgccgggtcgcccgccactgtattgaacccaccggcggtctgttcattaccctgccggaagacgatctggcctggcagcaacagtttatcagcgcctgtacccgtgccgggatcgccgcacagccgctgtcggcggaagaagcgctgcgcatcgaaccctgcgtgaatcccgcgctcattgccgccgtgcaggtgccggacggcaccatcgatccctttcgcctgaccgccgccaacatgctggacgcccgcgagcatggcgcgattatcttaaccggccatgaagtgatcggcctgctgcgggataaagatcgggtgaacggcgtgcagatccgccatccctcaacgcaggcggtgcagtccctgtacgcgcctgtggtggtgaatgccgccgggatctggggacagcgcattgcagagtatgcggatctgagcatccgcatgttcccggcgaaaggcgcgctgcttattcttgatcaccgcatcaaccagcaggtgatcaaccgctgccgcaaacctgcagacgccgatattctggtgccgggggataccatctcgctgattggcaccacctccacgcacattgattaccgtgatattgataacacccgcgtcacgccggaagaggtggacgtgctgctgcgcgagggggaaaaactggccccggtgatggcgacctcgcgtattctgcgcgcctatgcgggggtgcgcccgctggtggccagcgacgacgaccccagcgggcgcaacgtcagccgcggcattgtgctgatggatcacgccgaacgcgacggtatggaaggctttatcaccattaccggcggcaagctgatgacctaccggctgatggcggagtgggccaccgacgccgtgtgccgcaaactcaataatacgacgccctgccgcaccgccagcgaaccgctgccgggatcgcgggagtctgccgctcagaccctgcaaaaagtgatctccctgtcagcgccgctgcgcggctcggcggtgtggcggcatggcgatcgcaccccggaatggctcggcaacgcacgtcttagccgtagcctgatctgcgaatgcgaagccgtcactgccggagaagtggagtacgcggtggataatcttaacgtccgttccctgcccgatttgcggcgtcgcacccgcctcggcatgggcacctgccagggcgaactctgcgcctgccgggcggccgggttgctgcatcgcctgaacgtcaccaacgatgcgcaatccatcgcgcaattgtccgcatttttaaatgagcgctggaaaggcatccgccccgtcgcctggggcgatgcgctgcgggaaagcgagtttacccgctgggtataccagggactgtgtggtctggaaaaggagacgacagatgaagtttgatacggtgatcgtcggcggcgggctggcgggtctgctgtgcggcatcaggctaagccgcagcgggcagcgctgcgccattgtcagccgcggacagagcgcgctgagtttttcctccggctcgctggatctgctctcgcgcctgctggacggcacagcggtgcaggatactgccgccgggctggccgcgcttgaaaccctcgccccggaacatccttacagcctgatcggggccgggcgcgtgtaccagtacgcccgcgaggcgcaaaacctgctggcagaatgcgggctgaaatttcagggtgatgccagcgccccgcaccgccgcgtgacgccgctcggtatgacgcgtccggcgtggctcagcccgccggaagtgccgctgtcgccgcgcaaaggagagcatatctgcgtggtcggcatcaacggttttgccgatttccagccccatctggcggccgcaacgctgcgtaaacagggcctgcgcgtcacggcaacggacatcgatttacccctgcttgataaactgcgcgacaaccccagcgagttccgcgccgtcactattgcccgccagctggatcaggatagccatttcgctgaactttgcgccgccctgcgcccgctcagcgaaacccatgacgccatctggtttcctgcctgcttcggcctgacggacgacaaggtttatacccggcttaatgctgaactcgcctgcccgctgtacctgctccccaccctgcccccgtcggtaccggggatgagaatgcagacgctgctacagcagcagtttatccgcagcggcggcgcgtggatgccgggggatgaggtgctgcgcgccactctggataacaacgtggtcagccagctgtggacgcgcaggcatgaggatattccgctgcgcgccgatcatgtggtgctcgccagcggcagttttttcagtaacgggctggtggccgggcgcgacggcgtgcgggaaaaggtattcggcctcgatgtgctgcacagccccgatcgcgccagctggtatcgcgataacctgtttgatgcgcagccgtggcagcagtttggcgtgcgcaccgatgccaccctgcgcggacaattacagggcgaacccctgcaaaatttatacgttatcggctcggtactgggcggctatgacgccattcaccagggctgcggcggcggaatttgcgccgtgaccgcgttacatgtcgcgcagcaaatctgcgcgccgggaggctccgaatgaacaccactcacttcgacagctgtatcaaatgcaccgtctgcaccaccgcctgtccggtaagccgcgtcaatgtcgactatcctggcccgaaacaagcggggccggacggcgaacgtctgcgcctgaaagacggcacgctgtacgatgaggcgctgaagtactgcaccaactgtaaacgctgcgaaaccgcctgtccgtccggcgtgaagatcggcgacattatccagcgcgcccgcagccagttcgcgccgcgtaaaccttcactgcgtaacgccattctcagccataccgatctgatgggaagcctgtccacgccagtcgccccgctggtgaatgccgccaccggcatgaaaccggtgcgcctgctgctggataaagcgctgaaaatcgatcaccgccgtaccctgccgaaatattcccacggtactttccgccagtggtatcgcaaacaggcggccgtacaggcggcatttgatgaccaggtggccttttttcacggctgttttgtcaattacaaccatccgcagctgggaaaggatctgctgcgggtgctgaacgcgatgcaaatcggcgtacaactgctggagggtgaaaaatgctgcggcgtgccgctgatcgccaacggcttttttgaaaaggcgaaaaagcaggccaatgccaacgtcgcgtcattaacgcgcgccattagcggcaatggcctgccagtgatcgccacgtcttcgacctgtacttttaccctgcgggatgaatacccacatttgctggatatcgataaccgcgcgctgcgtccgcatatcgatctggcgacgcgctggctgtggcgcaaactggaggaaggccgccgtctgccgctgcgcccgttgccgctgaaggtgatctaccacacgccctgccatatggaaaaaatgggctggacgcattacaccctggaactgctgcgtaaaatccctgaactggagctaacggtgctggagtcgcagtgctgcggcattgccggcacttacggctttaaagcggagaactatacgacctcacaggcgattggcgcgccgctgttccggcagattgaggagagcggcgcggatctggtgatctcagactgtgaaacctgtaaatggcagattgaaatgtccacccgcctgcgctgtgaacacccggtgacgctactggcgcgggcgctgggataacctaacgttgcccggcggcgctgcgcttgccgggcctgcgacattgtcaccgtaggcctcgtaggccgggtaaggcgcagccgccacccggcattctgctacttcgtccccgccgtcaccagagtatcgacaacattgatccagccatgatcgctggcgacgtctttacccagcaaccagcgacgcagcatattcagcgccatcatcgcgcagacttcctggcgaaccgccagaccgtggcggttgacgctgaactgcacccgcagcgcatgtacgccatccggcgttgccagcgcaaagttcaggtgctcatcatccataccgccgacaaataacgccagcccggccagatgacgatcgcgcagcgccgccgcccagcgcgccgactgctccagattatccgcctgcgacggcagcacttcgctggccagcaacggcgcttccgcacgggaaagttgcagcgccaccagcccgctggtgaactgctcgctcagggtcaggctcagctgtcgttcccgtagctgacgggcgatcagcgccggtaacccttcggtgccttcaaaaatcaggctttcgcccgccacgcgctgcacttcaggccacagggcttccatctgctcgcgcgcgtctgccggaccggtcagcttgagttcaataatcggcatggaagagcgatagcccatcaccacgccgtccggcagttgcagatgttccaggctctgggcgagatcgctttcggagcgaccaaaagtggtcagacgcaggcacagcggcggcgagggcagcgtaaagcgctcgcgcaggcgcggcagaatttcgcgctccaccatcactttgaattcagagggcacgccaggggtgaaaaacatcaggcagcggttaagctgcatggcaaagccgcaggcggtacccacagggttatcgaccatctcggcgctggagggaatttccgcctgtttgcggttgctcggcgccatcaccttgccacgttcagagaaaaaacgctccatgtgcgcaagccagtcttcatgcaacaccagcccctcgcccgccgccgtagcggcagccagcgcgctcagatcgtcgctggtcggcccgaggccgccgttcacaatcagcacatcggcgtgttcgctgcgctcgcgcagtatggcgacaaggctgtcgagatcatcgccgacggtctggcggcgcgttaaaggtaatccctgattaaagaaaacatcagccagccacgcggcgttagtgtccacaatttgtccgtgcaacacttcatcgccggttgacagcatttccacgtttaacattcttttctccagcattagcggtcaaaacactataacgcatggcgggggaatgcaggagggaaactggcgcggcagggtgccgcgccggaggatcagaagctggcgctcacgccgacgtacgggccgtcggccagtttgctgtcgccgttgccgtctttgccgctcagatcgatatagcggtaacccacttcgacgctcagcggacgcagcacggaaatacgcgcgccagcgttggcttcagagaaatctttcacgccgctggagagcgagtccggcgagtaataatattcaccgaacagcttgatgctctcgccaatcggcagctgtaaaccgccacccacggcggcggcgtagccttcgtcaccttcgttcgggttcaggtagacgcctttaccgccgacggttgccataaacgggccgagggggagattaaggccgaggcccagaccggcaatatcgccgtgatcgtcgttgtgcgcccagttgccgctcagcgccaggccgctggtttcggtgcccattcccacgccaatattggtgtaatcttcacccgcctggccgctgatgctcagggcattcgcgcccgcagaaacaaacagcaggctggtcagggtcattaatgcaatctttttcatcgttcactatccgcgcaagtaattgttagacgttctgaaaagcgccgctagtgtacagggctttgccttaacactctgcaccaaaagtgattttcccgcttcgttgtcatctcaatgcttttgggtatctctctgatagacagagccagattgcccgcgatcaagactcccggtaaaaacaagccctaaagtgatttctgaagttatacggaaacacagccgtttttttgacttccaccaggagatgtatgatgaataaaaaaggattaaccaccgccgctggcgcgccggttgcccataataataacgtgatgaccgccgggccacgcggcccgatgctgttgcaggacgtatggtttctggaaaagctggcgcattttgaccgcgaagtgatcccggagcgccgtatgcatgccaaaggctctgccgcctacggcacctttaccgtcacccaggatatttcccgctatacacgcgctaaaatgttttctgaaccgggtaaaaagactgatcttttcctgcgtttctccacggttgccggtgagcgcggcgccgctgatgcggaacgtgacatccgcggtttttcgatcaaattctataccgaggaggggaactgggatctggtgggcaacaacacgccggtgttctacctgcgcgatccgctgaaattcccggatctcaaccacgtagtgaaacgcgatccgcgcaccaacctgcgtaacccgacctacaaatgggatttcttctcccatctgccggaatcactgcatcagttaaccattgatttcagcgaccgcggcctgccccgttcttaccgcaatatgcacggttttggcagccacaccttcagttttattaatcacaataacgaacgcttctgggtgaaattccatcttaaaaccatgcagggtattgataacctgatggacgatgaggcgaaacgtctggtggcggaagatcgcgagagttcgcagcgcgatctgtttaacgccatcgaaacgggagatttcccgcgctggaagttttacgtgcagatcatgccggaagccgaagcctcacaggtgccttataacccgttcgatctgacgaaagtctggccgcacggcgattatccgctgattgaagtgggcgtactggagctgaaccgcaatccggataactactttgcggaagtggaacaggtggcgatgtccccggcgaacatcgtgccgggcattggcttctcaccggatcgtatgttgcagggccgcctcttctcttatggcgatgcgcaccgttatcgtctgggggtgaaccatcaccagatcccggtcaaccagccgcgctgcccgttccataattatcaccgcgacggcgcgatgcgtgtggacggcaacagtggcaacggtccgacctacgagcctaacagcttcggcgttttccaggagcagccggactacagcgaaccgccgttgtcggtggagggcgctgcggatcactggaatcaccgggaagatacggactatttcagccagccgcgcaagctgtttgccctgatcggtgaagaagaacgccagcgcatgtttgcccgcatcgcgggagatatgaaagatgtgccggaatttattcagcagcggcagattggtttattcagcgaagtggatccggcgtacggggcgggtgtcgccgccgcgctgaacgccattaacaccgcccgataacatcaacaccttgcccggcggcgcacgcttgccgggcctacaatgtcaaaagagtaggtcgggtaagcgcagcgccacccgacattgagttcacaccgtcgccacccagtgctgtaaggcgcggcgggagattttgatgccgccctgcgccaggtgatcgggcagcggcaaccagcggatcggttgctggaagcgggccagtttatcccggcaccagtcggccagcgctgacgacgggtagccgtcctgcaactccaccaccgccacggatcgatgaccaaattcggcgtcctctttggggacgataaacacctgccgcacctgtggatgtgcggcaattacgcgttccacttcttccggctggatcccttcaccgccgctgaaaaacagattatccatgcggccagcaatggtcagacgatcgccctccaacaggccacgatcgcgggtggcaaaccagccgtcggcattgcccagcggcaccagattcccgtcacgccagtagcccgccgccatgctggccgcgcgcagccagacttcgccatcgacgattttcacttcgcgcccaggcaacgcactgcccacatccggcagcccgtcggcttctttggcgcacaccgtggaggcgaattccgttaagccataaccgcaccagctgcgaatgccgcgcttgcgggcgagttctgtcagctccaccgggatggccgcgccgcccagcagcaccgctttcagcgccacgctggcgttgtcgttgagtaatcgccacagctgcgtcggcaccagcgaggcatgggtgcagccctgcaacgccagctgcagaggcattttttcgcgcacggtgatgcgcgcccccgccagcagccagcgccataaaatcccctgtccggagacgtggtacagcggtagcgaaagcagccagtcgtcctgttcactgaaaggcatcagcgacagcacgcccgccgcgctcgccagatgcgcatcaggcgtgtgcaccgccgctttgggcagaccggtagagccggaggtcagcgtcatggtggcgagccgctgcccttcccagggcacggcatgatggccgctaattacgccagcttccagacgcgaaagcccggcgtagtcgccgtaatccgccagatccagcgcatggcgcagcgtcattgacggcaacagctcgcggagaagcccgtcaggtagctgcggatttaccggcagaatgcgcgcgccgcattgcagcagcgccagccacgacagcagggtcagcggatgattacaggcgcgcagcatcacgccgtcgccgcactgtacgccctgggcggcaaagccgctcgccagcgcatccacccgctcgcacagcgcctgccagctcagcatctcatcgccgaggcggatcgccgccgcttccgggcgctgttcgcgccagtgtcgccagggccagtcgtgaaaggtcacagcagcggctccaggacgtctgtttgcaggcagggcagcgcgctgtccggccagcggcgcagtaattgcgcctgcatcaggttaagcgtatccagacctggcgtggtagctggcgtcagccaggcggcgatgcgcgccagctgcgtcaggcccaggctggattcaagagaggagctgatcaccgccgtcaggccgagggcgtgggccgcttcaacctgctggcgcactttttcgagactgccggtcagcgttggcttgatcaccaccgcgcttatgccctcctccgctataaaggtaaaatcatcctcgcgcaggctttcgtcccaggcgatggcgatgccggtgtcacgggcaaaggcgcgggaatcatcacgggttttacagggctcttcgagaaaagcgatacgatggcgatgcgtcgggttgacgtatttggcgaactgctgggcttttagcggcgtccaggcgcggttggcgtcgaggcgtaaatgcagctccggcaccgcctccagtaacagattgaccaccatgccatcgcgcaccgcttcatacagaccgactttcaccttcgccactttctcgcccggcatggcggcaagggcgacgatcagctcgtccggatcgccggtacagagcggcgcagcgcgatagttacctgccgcgggtaattcatcgtgcaactccgccagcgcgcagcttaatccaaaggcggcggaaggcgctgagggccaggccggtgagtcgccagccagccaggcgtttacccagtccagcgcggcgcgctctgcgtccgccagtgattcacggctgaagcccggcaggggggcgatctcgccccacccttcccgcccgccgtcacgcagctgcaccagcaggccatcgcgggttttcagacgctgttcacgcagcacgacgcccgcatccatcggcagctgccagcggtaaacctgcgcctgacgcattacggattccgtttgtatttgctgaagtcgggctggcgtttttcgttaaacgcgttgcggccttcctgaccttcttcggtcatgtagaacagcatggtggcgttgcccgccagttcttgtaaaccagcctggccgtcgcagtcggcgttcagcgccgctttcaggcagcgcagcgccatcggactgttttgcagcatttctcgacaccagcgcacggtctctttttccagatcggcaaccggcaccacagtgttgaccagccccatctccagcgcggctttagcgtcgtactgacggcacaggaaccagatctcacgcgcttttttctgcccgacgatgcgcgccatataggatgcgccccagccgccgtcgaaagagccgactttcgggccggtctgaccgaagatagcgttttctgccgcgatggtcagatcgcacatcatatgcagcacatggccgccgccgatggagtagcccgccaccatcgccaccaccggtttcggacaggtgcggatctggcgctggaaatccagcacgttgagatggtgcacgccggagtcatcctggtagccgccgtagtcgccgcgcactttctgatcgccgccggaacagaaggctttatcgccttcgccggtgaggatgatcacgccgacgttatcgtcgtaacgcgcatctgccagcgcctgcatcatctcttttaccgtcagcggacgaaacgcattacgcacctgcggacggttaatggtgattttcgcaatgccatcggtggacttgtggtagcggatatcggtgtagccttcggaacagtcgagccactcaaccggcgcgtaaagcattgtttcatctggatagatcataaggattccttagtgaagacgcagaatatgcgccagacgggccgccacagcggcggggttttcccggtgggcgttgtgtccggcgtcagcaattaacaggcaaggcgcggcgagttcatcgccgatggcgcggaatttcgcgtcgtgctcgccacataagtagtaaaacgggaaatgtcgctcacttagcgcggcgcgcagatccggctggcgtgacagcgaggtggcgtcgagcatggcggcaagcgcggtaccactgttgtgctgacgtaacgccaccagcgcgcggcgctgttcagcgctgagggacgcaaaaaccggctgctgataccagtcgatgaatacgtcctctgatggttcatggcgaaaccgcgccgcccagcgggcgtcgttttccgcgcgctggcgacgggcggcggcatcggttaatcccggatgcgccccttcgacaatcagccctgccagacccggcggttgcgcacaggcgtgatacatcccgaggcgaccgccgagggagtagccgatgagccagtattttagtatgttgtaactaagaagggtgttactgagcaacgcgctgacctgcgcaaaatccgccgctgtaatatctgccgagccgccgtgccccggcaaatcaatatacagccgggaatgatcgcgaaactgctcgcccaccggctgccattcgcggtgatcgccggaaaaaccgtgcaggaacaccagccacggcagcgcggcgttagcggcttcagcgcgggcatgcaggatcatagctggctgactcccgccagcagttgctggagcgtctgcgcgccgtcggtttcgctgaccaccagttcgataatcgtcgcctgcggcctgcgccacgcctgcgtcagcgccccgtccagcgcctgccagctttccgggcgatggtaatgcaggccaaacatggcggcggcatgttcaaaatggacgttctgcggcatctggtaaaaacgttcgcgttcagctggcggcgtgggcagcagggagaaaatctgcccgccattgttgttcaccaccatcagcacgaagggtgcggagacctggcgcagtaacgccaggccattgagatcgtagagcgcggagagatcgccgacgatggccagcgtcggtttaccgctggcgcgctgcacgcccgccgcggtggagagtaagccgtcgataccgctcgccccgcggttgctgtacaccggataacccgcgggcagctgcccgagcgcatccaccagacgcaccaccagactattgcctaaaaagagctgcccctgttccgggagatagtccgccagacggtgcgccagctgcgcctcgccgaacgtctcacgctgcgcttccaccgcctgccaggcctgttgcgccagcgccgggatgtcgctgcaccagggcgcgcgaggttccgccggatgttcatccagccagtcgccgatggcggacaccagccgccgtccgcgatgatgcgcgggatcaagccgtcccggcaggttgtccaccagccagtactcttccggctcgcaggcggcctgccactgaagcagccgttttccggtcaggctgctacctaactggataacaatctgcgcctgcgccagctcggttaccgcgcgggcattgcccagccacagatcggcacagggcagcggttggccggtctgcgacagcacgtcgccaatcagcggccagccgagcgtctgcgcccattccgcagcctgtttgccttcggcagcgctcatccgcccggccaccaccacgccgcgcttttgccgccagaaaaaccagtcgcgctggcgggcgctgtgtagccgggtgttttcccgcagccagggcttatcgctgcgccaccagtcgccaagctgttgttgccagtcgaggccggtggcatccagttcgccatacagcggttcggcaaaggggcagttaatgtgtaccgcgccgcaatgcagcgatccgagaagattatcaatcgtactcaccagccagcgggcgggaatgtcctgggtcgggcgcggaagcgacagcgcctgtgcgggatgggaggcgaagataccaggctggcggatcgcctgatttgcgccgcagtcgatcagctccggcgggcgatcggcggtgagcaggatcagtttttcgccggtcagccccgcctcgatcaacgccggataaagattggcgactgcggtaccggaggtgacgataaccgtcaccggctcgccgctgaccttcgccagcccgagcgccagatggccgaggccacgctcatcaaaatgggtatggtgaacgaaggctttatttcctgcggcggccagcgtcagcggcgtcgagcgcgagcccggcgcgatgcagacgtgtcgcacgccgtggcgggttaaggcttcgagaatgacttcggcccagcgtcggttgaatgagcttactgacataagtttgtccggtatcaatattacggcacagtataaagaacacagaacgccgggtttttgatatgaatcggtaatgagtgaatctgtcttaatccatcaggagtacggagcgcaaaccggccgctttgttttcgatctcctgccattcgagttgcggatcggaaccggcgacgatcccggccccggcgtagagccgcaccctgccgcctgagacatgcgccgagcgcagcgccacgcaaaattccgtctgctgaccggagaggtagcctgcggatccggcataccagtcgcgggaaaagggttcatgctgccggataaattcctgcgccgcctcgcgcggcaggccggccaccgccgcggtgggttgcagctgatgcagacagtgcgcgtcgtccggcgcgtttagcgtcatccagatgcagcggcgcagatgctggacttttcgcaggcgcacgacctgggcgggaagaatatcgtagccgttacccagcggttccagccgctgacagatatcctccaccaccagctgattttcccgctggtttttgtcgtctgccagcagccactggccgagggcatgggcgcgagcgtcgtcggcatggttttcaatagtgcccgccagcgcttcggtgcgcagcgcgcggtcaatgcgccgccacagccgttcggggctggaacccagaaacgcctcctgcgggctgaacgctatataaaagtgataacagctgaaattgacgcttcggctggcggccatcagcgccgcagcgttcaccggctggctgaagtgcaaatcgctggcgcgcgccagcaccactttgtccatctgctgccgttctatggcctctgtagcgagacgcacccgctggcaccagccgtcgtgatccgggctgtgttgctcgccggtcagatggaggtgcagggctgaaaacggcgtggcggggcgtaactggtcaaggaatgctgcggcgcaaatggcatcgtcgcgcagggaggtttcactccagagagtcagatacagccgggcctgctcgccctcacgacgccattcgagacgcggcaggaacagatcgccacgctgtggatcgaaggcgttcagcccccagatgcgcagttgcgcatcgccgctgtgctgtagaaatgtttgtgcgtcggcaagggagctaaagcgccggagcgcgccgagggcggcagcctcgtcttcattgccgcgctgctgccagtaaaactgtggaaaatgaggttgtccggcaagccaggcgaggggatcgcgggactcgtcaaacgccagcggaatgcacaggcggcgcagaccgggctggtccggcaacggcgttgccagttgctgtctgagctgccacaacgcttcatctattatcgccacgaatgatcccacccttttgcataaacccggacattatacggggttgttcgtgtaaaaaaagacaccccgccggggcggggtgttttggtttgatgagctggtttttgcccggcggctcttcgcttgccgggcctacaggttgtggcaggccgggtaaggcgctgccgccacccggcaaaccatcagaacttatacttgtagttcagcataaagcccttgtccttcacgccgtcttcctgccactggaaggcatccgccgtgaactgcgcgttaccggcgctgtatttcacgcccgccatcgcctggccgttcacgccgccgccctgctgggcatcgtcaacgctgaacgtctggcctctggcacccgccagagaagccgtacggttgctcttcgcatagctcaggttcgggccgccttccagcgacgctgtcgctgcccagccgtcttcacccgcgtagctcagcttcagacccaccaccgcatcaaccgccgtttcgctgctgctgctcatgctcaggttgaagtcgcccgcgcctttctcgctgtagccgtcttccatggtgtgacgcattttcagaccggcaaacggcgttaccgtcaggccttcctgcaccttgaaggcttttgacccttcggtacgaaactccatgtactgctggcgggtgtcggcgttcgccgttttgttcacgtcgccgtaacgtaccgcacggttgctgtcgaagttatgcacgtcataacgcagggcgttatcccagttcaggccgccttccgtcagcggcaggctgtgcttcagccccaggaactggctgtaaccgcccgtcacgccgttgtcgccggcgctcatcgcattaccatcaccgtccagacgggcgataccgtactccatggtcagcgtctggttgtcaccgaacgccaggctctggcgcagcgccagcatgtcgtaggtggtgtcattacccagctcggcacgcttgtcacccttcgccaccacgttgaacgccagaccgttattcatcaccggtgccgtgtccgccagcatgtcgaagcggttgctcaggatacgcgcatcgcgggatacgccggtcgccttgctgccagaaatctgcttcagggcgctggtcagctccgcgctggttgccaggttcaggctgttgtacagctcgttgctggtgtaggccgcatccagtgcattcgccacgctgttgacgctcgcatcgcccgccacgtccgcataggcgtttttggtcatggtgacatccacgttaccgctggcgtccttctcaccttccgctgtccagaccacgctggcggaggtgatgttctgctcaccctgaatgtcttccccgacaaagacgtcgttgaaggtcacagaggtgtccgccgtacccgcggtaaagccggtgtcaacgttcacgtcctgaatgtcaacgtggctcgccgtcagcgtacccgcactgccgtctgcgctggtgccgacggtgtactggttgatgctgctgcgcagaccggtgctctggggtgccacagtcggatcggtcggcagcgtataagacgcgtaatgcgcttcgctcttgtctgccgtattgccgttaaccccggcaacctcgacaccactctctttcaccagaccgctgccgctaccttccagatttaccgtgccattgttaacgatacgcccgttcgcgcccagcttgctgaaggcgtaagagttggacgcatagatgttgatcgcgccgttgttctcgatcaccgcgtcagccgtggcgttcgcgtccagctgcatggccaccatgccgctttcagtggtgcctgcggtacccaggttaatggtgccgttgttcaccagctgggcgttattgctgcccttcatgccgactgcgtcgttgccattcacgttcatggtgccgtcgttgacgcccacatagttactgtgcgtcagactgaccgcactctggccggtttgagaggcggtaaagttcaccaccccgtcatcctggttccagaagaacgccttgctggcagcggcattatccgcagatcttactacagaggtcattcccgagccgttgaccgtaccgtcgttaataaagtcagccgttccgccccagatattaaacgccgccgcatgactgctggcggtaaaattcatggtcgcgcccttgtcgtttttcacggtgctgttgtcattcatatgaacagcattttttatattatcacccgtcattacgccaccagcggcgttttcaaacacgctgttctttttcatctccagcatgctggcattcgctttgtcggatgcgctaccgagcgaaaacgcgccgctgttggtaatatgtgcagtgtcccccagaatcgcgccgcctgtaataataccgtcgcttaccaccttgccggaagcatttaccgcaatactttgagtgatggtaccgctgttattcacggtcccggtaacagtaaggggcgcattaacgattcccgtcgcctggttttcaagagtgccgtccacaaatagccggcctggaccattcagcgtgccggtattacttaccgtactaccggttagtattacgccacttttatctaaggtggtagtgtcgctcagaatggtaccgtcagcatattcaatggatgtgaattcgtcgctattatcagcagccgccggtacacctgcactttcattaacattaatctcaccacggttaataatacggttattcgcatcgccgtcggaataaaaggcaatcccgttttcagcgttaatattaatcacgccggtagtatcgttgatggcgctaccgccctcatataccgccataccgactaagggttcgtcgccggtatagttttcgttctgatttaggttgatggtgccctgattaatgacgacgttggtggcaccgactgctgccataccggcaccggcgttattaacagtaatgattccaccctcgtggtttattgcggttccgtttttgccatgggtataggtattaccggcccccatgccaacggcataatcaatggctttatcagagggaaccccttgcgcataagtggtgtcatctccttctgccacccataatgcatccgtggtgatttgcccgtagttatctgccgttgaatcctgggcatgtaatgcttcaccgcggccatacaatgtgagtgagccattattaatggcctgtgcgcccttctgagccgtcataagaacgatggagcctacatcatcattcgtcatttgaccgctttcgatgtcgcccgcaggcaggatgcttcctcggttaagcagatatccggtaatgctaccctcgttacgtacaagggatcctttattcatggccgttggccctaccaccacggcgccatccgttcctgcggaaaccatcgttttttcgagcgtaatttcgccttcgttaataaaggttgacccgtttgcgacctgagcaaaaccaatatcgttgatactgatcgcccccttattgaccatggtgctgttagtatcgatatagccaagataattataattataaagcaggtatttatttatgctggttatatcggtttcgagcgtggcatcttcgctaatttcaaagtaaccaccatcagaaacaccaataatgctcttgaacggctgaccaaaatcaccatttatagacgactcaccatgcagatacacggatgagtttccgctcacgctaattactttagaggaactgggaccatttcgcttatttccggtttcattatcagccgtctgatttatttccccggtcagttcgataccacccatgatatctacacggttgccctctccggcgaccaccaggccaaaaataggctcctgagaaccatcatattttgcccatttgtggctatctgccatttcggtatcgagcaccacctgcatgtgcccgtccagcaccacggtattatcattacctgccacgttaatgccggtagatggcttaaagaaatactctttcgcgagcggtgatttctgatctttatccaccaccatatctccggtcagggtcaccgtgttggtgttcccggtaatattcaccccggtcgcgtcatagcctgtgattttcagctcatcggagataagattcacgttattgctgtccccggtaacattgatgcccgtggagaaatctcccacgatcatcttaccgttctgattgagggtattgctgttaccactgatttgcgttccggtgccgccatcagtgacgctggtcgcgccggtattattaatggtgttctcattaccagtgacagcgaaaccggtgccgtccgtagtggccgtaatcccaccttcattgttaatcgtatttttatcaccctttacttgcgtgccgataccgctatccgtgccggtgctgtcgcctttgataatgataatcttgccgtcaacgtcaatttcttcaccaacgttgtccgtggctgtaccagtgccgccattaatcactagcggctcatcgccaccgtcatcgccatcatcgccgttatcgttattgtcatcattgccattgtcgccgttatcattgtcgtcaccattatcgtcgccgccgttatcaccgccgtcattatcatctccgccgttatcgccgccatcatcgttaccgctgtcgctgttatccgaactttcaccatcgtgatcgttttcaaccgcaatacccactgccgctactaccgccgccatgccaccgataacccagtttttgggatcttccataaacgaaggctcttgcagacattcagccgctaactgcgctttttgctcttccgtcagcacactcatattcgcggggcagaggttagcggtacgatcttttgctaagtgttcggtttcggcatagccattgccgcttaacgccagggcgatacagatcgacaggactgattttcgttgcatgatgaatgttccttattcagctgatatatatattaacgacagaaaggtatggcggtgtcgccagataagattgattaaaaaaatttgagggattttatagagggttactattttttgttcaagaggattatgattcaaatcgttgtaataaaagtcaactgcttgatatcaggagagatataaataccgggagtggcgacgacaaattataagccggcagaatatatagacgatattaatgtattttttcataaatcattctctgaattaataaattaacccccaccaataattaaatacattcatgtctacaataataaaaaaacaccccgccggggcggggtgttttgaggttgggtgattgtttttttgcccggcggcgcttcgcttgcacgggcctacatgttcatcgttaagtcatgcaggccgggtaaggcgctgccgccacccggcaaaccctcatcagaacttatacttgtagttcagcataaagcccttgtccttcacgccgtcttcctgccactggaaggcatccgccgtgaactgcgcgttaccggcgctgtacttcacgcccgccatcgcctggccgttcacgccaccgccctgctgggcatcgtcaacgctgaacgtctggcctctggcacccgccagagaagccgtgcgcttgctcttcgcatagctcaggttcgggccgccttccagcgacgctgtcgctgcccagccgtcttcacccgcgtagctcagcttcagacccaccaccgcatcaaccgccgtttcgctgctgctgctcatgctcaggttgaagtcgcccgcgcctttctcgctgtagccgtcttccatggtgtgacgcattttcagaccggcaaacggcgttaccgtcaggccttcctgcaccttgaaggcttttgacccttcggtacgaaactccatgtactgctggcgggtgtcggcgttcgccgttttgttcacgtcgccgtaacgtaccgcacggttgctgtcgaagttatgcacgtcataacgcagggcgttatcccagttcaggccgccttccgtcagcggcaggctgtgcttcagccccaggaactggctgtaaccgcccgtcacgccgttgtcgccggcgctcatcgcattaccatcaccgtccagacgggcgataccgtactccatggtcagcgtctggttgtcaccgaacgccaggctctggcgcagcgccagcatgtcgtaggtggtgtcattacccagctcggcacgcttgtcacccttcgccaccacgttgaacgccagaccgttattcatcaccggtgccgtgtccgccagcatgtcgaagcggttgctcaggatacgcgcatcgcgggatacgccggtcgccttgctgccagaaatctgcttcagggcgctggtcagctccgcgctggttgccaggttcaggctgttgtacagctcgttgctggtgtaggccgcatccagtgcattcgccacgctgttgacgctcgcatcgcccgccacgtccgcataggcgtttttggtcatggtgacatccacgttaccgctggcgtccttctcaccttccgctgtccagaccacgctggcggaggtgatgttctgctcaccctgaatgtcttccccgacaaagacgtcgttgaaggtcacagaggtgtccgccgtacccgcggtaaagccggtgtcaacgttcacatcctgaatgtcgacatggctcgccgtcagcgtacccgcactgccgtctgcgctggtgccgacggtgtactggttgatgctgctgcgcagaccggtgctctgggctgccgcagtcggatcggtcggcagggtgtaagacgcagcatgtgtctcggtaccgttgccgccggtgccattaccttccagcgcaacgtcctgctggatcaggccgctgccttccccggccagggttaccgtgccgttgttaacgatacgcccgttcgcgcccagcttgctgaaggcgtaagagttggacgcatagatgttaatcgcgccgttgttctcgatcaccgcgtcagccgtggcgttcgcgtccagctgcatggccaccatgccgctttcagtggtgccttcggtgcccaggttaatggtgccgttgttcaccagctgggcgttcttgctgcccttcatgccgacggcgccgctgccgctgacgttcatggtgccgtcgttgacgcccacatagttactgtgcgtcaggctgaccgcgctctggccggtttgagaggcggtaaagttcaccaccccgtcatcctggttccagaagaacgccttacccgcagccgcattaccttgtgaagccaccagcgacacaccagtggcgttcgctgtaccatcgttaataaagtcgcccgtaccgccccagatatttacccccgccgcgtgactgctggcggtgaagttcatggtcgcgcctttatcgttcttaaaggtaccgttgttattcagatgaacagcatttttgttattatcgcctgtcagcacgccgccagccgcgttttcaaacacgctgttggttttcagatccagtctatggacatccttaacgtctgtcgctgtacccagcgtaaagctaccgctgttgataatgcgactgtctccccacatctccgcgccgccagtagcgctaccattgttaaccactttcccggaggtgcttgtgataacaaaagcgttgatggtgccactgttattaattacgccattagtgccggaaacactgacgggtgaatcaataataccagagctctggttattaaaggtgccctcaacatataaccgtcctgtaccgttcaccgtgccggtattactcactgtgctgtcagaaagtacggacgtagtttcagtcagcgtattaataccgcttagcacggtgccgtcagcaaattccggcgtttccactgcatcactgttatcagcttccggcggtacgcctgcaccgatattaatgtggccacggttaatgatacggttatctttattaccgtctgtatagaatgccttaccgttttcggcgttgatgttaattacacccgtggtgtcgttaaccaccgtagcgccgccatagaccgccatacctaccagcggctggtcagcaacgtaattctcgtttttctcgagattaatcgtgccctggttaacagccttgttactggaaccgtaggccaccataccagcaccggcattatagacggtaatggtgccgcccacgcggttagtggcaacagaatttgactgcgcggtaatggcgttgctacctgcccccatgcctacggcatagttcattgggttatccccggaagggacactggttctcacgtcagaggtgtcggcggcatctttccacatcgcatcggtggtaatctggccaaagttatcggctgtcgagtttttattcgccaccatcccggtaccacgtccgtacagctcaagctgaccttcgttaataaccgagctaccggcataggcggtcatcagttcaatagcagcgacgtggttgttcagagcatcctcagtcgacatactgtaatgatctttaacgttggtgatgcttccctggtagaccgtcttacctgtcattactccctggttaacacccgtggctccgtttcttacagaaatgcctcgcagcgccgtacgatcggtggagagttcagagcgaaccatctccaggcgaccgttattaacgactttcgaacctttatcttttgcttcaaaggcggtcatgtctgaaatagacatttcacctttgttagcaatggtggaaccggattttgcagtgaaagcctggcttacatgcatgtcatagttatagtcgctgacttcttctacaccggaagtactgaaagtcgaaccttcggtaaattcaagatagccaccatttttaacgctaataacgttgttgatacccacggggaaatagccattaacggacgaatcgccatgcacgtagaccgaagattttccatcaacagttacaaccgaggcattgctggtgccggttctctggttagcggttttatccgcatcgtccagctggtctttctcacccgttaattcgatgcccttcatgatgtcaacacggttattgtcacccgttacggtggcgccctgtattaactccatcgagccgctgttattggcataatttctgccagcatcttcgctatcgacaaccacctgtaaatgaccgtccagcacgacagtgttattactgccgctgacgttaatccctgtggaagctttgtagaagttatctgccgccagtggtgatttttgatctttattgaccaccatattgccggtcagcttgacggtgttggactcgcctgtaacattagcgccggtggcctgctgcccggtgatgctcatatccgatgaatcaagattaagggtattgccattaccttctacgttaatgccggtggagaaatcgccgaccgccatcttgcccatctggttgatctggttgttgttacctgcaacatcaaccccggtggaaggtttggtgctgtcggtgctggacacgtctaaatcgccagagttgatgatgttgtcatcaccattcactttggtgccggtgccgccatccgtcgcggtgctgccgccggtgttatcaatggtgttgccattgccgtccactttggtgccggtgccaccgtttgcgccgttgttgccaccattgttattgatgtcgttgttatcacccgtgacatcagtaccggtgccatcgttaatcccgctgttgttgccgttgttattgatggtgttgtcgttaccgtcaacgtcagtgccggtggaacctgtgccatcaccggtgttgtcaccgttgttgtcaatggtgttgccgttgccgtctacattggtacctgtgccgccattggtgccgctgctctcaccaccgttgttgatggcgttaccgttgccgtctacatcagtaccggtggaaccttcgccgtcgccggtgtttgtgcctttgttatcaatggtgttgccgtcaccgtccactttggtgccggtgccgccgccggtgccgctgttgttaccgttgttattgatgtcgttgttatcacctgtggcatcagtaccggtaccatcattaatcccgctgttgttgccgttgttattgatggtgttgtcgttaccgtcaacgtcagtaccggtggaacctgtgccatcgccggtgttgtcaccgttgttgtcaatggtgttgccattgccgtctacatcggtgccggtgccgccattggtgccgctgctctcaccaccgttgttgatggcgttaccgttgccgtctacatcagtaccggtggaaccttcgccgtcgccggtgttggtgcctttgttatcaatggtgttgccgtcaccgtccactttggtgccggtgccgccgccggtgccgctgttgttaccgttgttattgatgtcgttgttatcacctgtggcatcagtaccggtaccatcattaatcccgctgttgttgccgttgttattgatggtgttgtcgttaccgtcaacgtcagtaccggtggaacctgtgccatcgccggtgttgtcaccgttgttgtcaatggtgttgccgttgccgtctacattggtgccggtgccgccgccggtgccgctgttattgccatcgttattgatgtcgttggtgtcgccgttaacgtcagtaccggtaccgccattggtgccgctgttatcgccgccgttatcaatggtgttgccgttaccatcaacatcagtaccggtggaaccttcgccgtcgccggtgttggtgccgtggttatcaatagcgttgccgtccccgtccacttcggtaccggtgccgccattggtgccgctgttgttgccgttattgtcgatggtgttgccgtcgccatcgacttttgtgccggtgccaccatcgttaccgttggtgtcgccgttattattgatggtgttatcgtcaccgatggtaatagagccgttattaccctcgcctgaggccgtgccgccgtttgtatcgatcttgttattgttgccttcatgccagttcacggcatcagtgaaattgatttcaccagtgatatccagataccagatcttgctgccatccgcagaggtgcctttcatagtgacggcattgctggcctcatccagagcccatttatccagcacaatggttttgccggtagccggatcggtcagggtgtaagtaccgttcggattggcggtgtaattccaggtaatgcccgcaaaggccaccgtttttttggtttcgttccaggttacgccgttgctgtaggttttaataatatcgccagtcggcgtggaagagccgtcatccccgctatcaccaccatcaccaccgccgccaccgcccgcagccaggccgactgccgccgcgacagcggccacgcctccggcaacccattcccactgttcttccagaaaagagggctctttaaggcattcaggaggcagttttgctttttgggcttcgctcagcgcgctgatatttgccgggcacgcctgcgacttgcgttctttttcgctcagatctgttccggcataactattgccgctcagcgccatcgctatacagagggataatacggattttttttgcatgatgaatattccttattcaacaagagtcaatatcaacaatgtcagacggacacgatagcgtcgtcaggagagaacattaaatacaattttcgccggttttatagggtaaagttgatttttattcaaggacaatttaattaaaagaatattaattaaggataaccgattgaattagttagaattgaatttggaggaaaatcttaggcaattttattcattttgtgaaacacattcactcaaaaaatataaaaaagcaaaaaccattcaccaagataataaattaagccatgagaatatttatttttatgcggagatgtcttttattaatatatccattaataaataagattaaacttataagacaggtaaaacaaaacagcctcctgaacaggaggctgctaacattagcgaactaatgtgaaaaattaattagcggcgcagtagcagacccagcaccaggcctgcagcagcaccaatacctacgccctgccacggtttttcatgcacgtaatcatctgcacggtaggcaacctgcttggcgcgcatgtagtagttgtcggaagcctggctcacgcgggacttcacgtcgtgcagcgcttgttcggcgcgtgctttcagttcgatatatttctggtcagcaggatcgccggaggaacgtaacacctcttccagcgtttcgctcagcagggtcaggtcgtcgtcaacgcgtgtttctgtgaattggttagtcatttgttttctccatgttttgcactggtttgctaactatagtcaatgacctgcggttacgcctggcgaacttcccgcgccataccgatgtgcgggataccgtcttcgtcataaatatcggtcaccggccggaagccaaaatgggcatagaaagattgcaaatgtgcctgcgcacccagatatatcgcgcgctgcggccagttttgctgacaactggcaaccgcccgatccatcagctgataacccagtttctcccccctgacctgtgggctgacgatgacccggccaatcactaccggggcgaaatcatcctcatttttcagaatcctcgcatacgccaccagctggttatcgcgccagccgagcagatggcgattctccccgttcagatcttcaccgtctacatcctgatagacgcagttttgctccaccacaaagacttcgcagcgtaatttgagtaattcgtaaagcgcgctgacgctcagttcgctgtggtgcagatcttgccagtggatcatggtgctctccttaattgattcgcctctcgctatactaatggcttttcatcttccggaaagggcgtaacgcacatatggaacttctctttcttggcacctcggcgggggtgccgtcgcgcacacgcaacgtcagcgcgctgttgttgaacctgcaacacccgacgcagcccgcgctgtggctgtttgactgcggcgaaagtacacagcatcaactgatgaaaaccccgtatcatcccggcaagatagagaaaatttttcttactcatctgcatggcgatcacctgtttggcctgccgggactgatatgcagccgctccatggcagggatcactcagccgttaacggtgtatggcccgcagggcatccgcgagtttattgaaaccacgctgcgtctgagcggcacctggacggattacccgttgagcgttgttgagattagcgcaggcgaagtgatggatgacgggttacgccgcgtgaccgcttacccgctggatcatccgctggagtgttacggctaccgtatcgaagagcatgataagcccggcgcgctggatgcccgtgcgcttcgggatgcaggcgtggcgcccggcccgctgtttcagcgtctgaaagccggagaacgggtaacgctggatgacgggcgtgtgatcgacggccaggattatctctcccccgccacgccgggtaaaaagctggcgatttttggcgataccgccccctgccccgccgcgcgcgacctggcgcaggatgtggatctgatggtgcatgaaaccacgctggaggcggcaatggaggcaaaagccaacagccgtggtcacagctccacgcgtcaggcggcgcagctggcccgtgacgccaatgccggacggctggtgatgacgcatatcagttcacgctacgacgccgtcagcagccagaagctggtggaggaatgccgggccatcttccccgagagtattctggctgaagatttcgttgtcatcacagtttgatgtaaaacgttcctccatttttcccccggcgtgccgataacagtgttaacgcacgcattccactccgagggcacgatggatagtttccagaaagatattgatgacagggctaatcttaccctgtccaaccgctttgagcttttgctgttccgtcttggcgcgtcggtgcatgacgcgaagtcagagctctttggcataaacgttttcaaactgcgtgaaattgtgcccatgcccaccttcacccgccctgccgggatgaagccgccgatgatgggaatggtgaatatccgcgatcaaatcattccggtgattgatttgacggcggtggcgggctgcaaacccactaccggactgaatattctgctcatcaccgagtacgcccgtagcgtacaggcgtttgccgtcgagtcagtggagaacattattcgtctggactggaaacaggtgcacacggctgagaaagccgttaatggtcgctacatcaccagtatcgcctgtctcgacgatgagcaggattccaataatctggcgctggtgctggacgttgagcagatcctttatgacattacgccgccggaccacgatctgcatgccaaaaatctggagaacactaaaaagttcaatatgaagccgggcgcggtggccattgtcgccgaagattccaaagtggcgcgcgccatgctggaaaaaggcctggaatccatgaacattccgaacaccatgcacatcaccggtaaagatgcgtgggagcgcattcaggtgctggcgcagcaggcggaagcggaaggcgtgccgattagcgataagatttcgatggtgctgaccgacctggaaatgccggaaatggacggcttcaccctgacgcgcaaaatcaaaaccgatgagcgtctgaagcatattccggtggtgatccactcgtcgctgtccggcagcgcgaacgaagatcatgtgcgtaaagtgcaggccgatggctacgtcgccaagtttgaaatcaatgagctttccgcggtgatccaggaagtgctggatcgcgccacgcagcacgtcagcgggccgctgattagccataagcagtttgtgtaagatggatggttgccgggtggcgcttatgcttacccggcatttttttaagaagacgaaaaaaaaccgccgaatcatcggcggtttttttatgggctaacgcgcttacatcagcggcttcgcgagctgcacgatgtcgatcagcggctgcgggtagacacccaacagcagtaccagcaacgcggagatcagcaccacgataccgcctgcgctgtactgccagttagacggcgcatcgcggttcagttgctgcggagcgttcagatacaggctcactgccacgcgcaggtagtagtagagaccaatcgcggagccgagcacaacagcaccggtcagccaccacaggttcgcctgcacacccacggccagcacgtagaacttaccgataaagcccagcgtcatcggaatacccgccagcgacagcatcatcaccgtcatcaccgcagacagaaccggacggtgccagaacagaccacgataggagtacagggaatccgcgtccgggccacggtacgggctggacatcaggcttaccacgccgaacgcgccgaggctgctgaacaggtaaccggccagatacacgcccaccgtttccatcgacatctgaccgctttgcagcgcaatcagcgccaccagcaggtagccgaggtgcgagatagaggagtaaccaagcagacgcttgatattgctctggctcagcgccatcaggttgccgaagatgatggaagccgcggcgataatacccagcaccatgcgaaccgcttcgctgtcgcccaccggcgcatacaggaacagacgcatcaccacgccaaagatggcgattttgctggcggttgccaggaaggtggaaaccggagcaggcgcaccctggtaaacgtctggcgtccacagatggaacggcaccagcgacagcttaaagcccagaccgacgatcatcatacccaggcctgccagcagcagcggctcgtgcagcatgccgtcgcccaggctcttaccgaggccagggaacgacaggttgccggtctgcgcataaaccagtgcgatgccgaacagcaggaacgacgaggcggcggcagacagaatggtgtatttgatactggcttccagcgagcgtttctgacggaaagcgtaacccaccaggccgaacagcggcagcgagataagctcgataccgaggaacagcgaagccatatggttagcgttcgccagcagaatgccacccagggcggcaatcagcaccagcaggtaaaactcttctttgttgtcgtagtagccctcaagccacggatacgcgaaggtacaggttgcgaggctcgccagcagcacaaggccggtgtagaacattgcgtaaccgtctacgcgcatcagcggcgtgacatccatggcgcccgcctggccaacaaaccagagcgacactaacgcggcgttaagcccaatgaccgacagcgtggcattggtaaagtggttgcgtcgccacgcaatggagagcatcacaaccaccaccgtcaatccgacgatcagcagcggtagcagcgcaatcaggtgttgtggagttattgtcatggcgatttacggccttgtagtagaaacggaattaacaaaccactgctggatattgctcatcgcagaatgcgaggtatccagaatcggctgcggatagaagccaagcagtaccagaagcacgaccagcaacagaatgataaacagctcgcgcagtgacattcccggcagttctttacttgcgatctcgctcttcgcttgcccgaagaaggcgcggtgcagcatcgccagcgagtaaactgacgcgaagaccagaccgaaggtcgaaatcacagtgatcaccggcacaacctgatagctgccgaacaggatcatgaattcaccgacgaagttaccggtgcccggcatcccgagagtcgccacggcaaagaacatcgacagcgctggcagccatttaattttgctccacaggccgcccatcatgcgcatatcacgggtatgcagacgttcgtacatctgaccgcagataataaacataccggcggcagacagaccgtgcgcaatcatctggatcaccgcgccctggaacgccagctggctaccggtatagatcgcgatcagcacgaagcccatgtgcgaaacggaggtgtaagcaatcagacgtttgatgtcggtctgtgcgaatgccatccatgcgccgtagaagatgccaatcacacccagccacatggcaatgggggcgaactcagcggaggcgttcgggaacagcggcagcgagaagcgcagcagaccgtaggccgcggttttcagcaggatccccgccaggtcaacagaacctgcggttggcgcctgggagtgcgcgtccggcaaccagccgtgcagcggtactaccggcattttcaccgcgaaggcaatgaagaagcccagcatcagcagatattcaacgccatgggacatcggcgtcttgagcagctgctcgtagctgaaggtccagacgccggtcgcattgtagtgcacgaacaccagcgccaggatggcgatcaacatcaccagaccgctcgcctgggtatagatgaagaacttggtcgcggcagtgatacgcgtcttcccgtcggaggctttatggccccacagtgcgatcaggaagtacatcggcaccagcatcatttcccagaagaagaagaagaggaacatgtcgatggcaaggaacacgccgataacgccgcccaggatccacatcaggttcagatggaagaagccctgatatttctcgatttcgcgccaggagcagagtaccgccagcacgccgaggaatccggtcagcaccaccatcagcagtgacaggccatccagcgccaggtgaatgctgatgccaaagcgtgggatccacggcagcaggaattcagactgccactgcggtaaaccagccgattgggtcagagagtagccgccctgcaaccacagttgcagggaaagcgccagcgtcagtcccattgtgaccagcgcgatccagcgcggcatcttcacgccgaagcgttcggtctgccagcacaggaagccgccaataaacgggataagtattaaccagggtaataacatagctgcgtatgtcccttatattctaaacacttcacaaaaaatcaacgcaataccatcaacagcgcgaggacgaccaccgcaccgatgctcatggatgccacataccagcgcagatagccgttctcgctaaacagcagacctttacccgccaggcgggagaggattgccgggatgttcatcaacgcattcagcgggtcacgcttgataagccaggcgatacccaggaatggttttacgaaaattttgtcatacagccagtcgaagccccaggcgttgtaccaccaggtccccagcaggcggcccggcgcgctgttggcgattgaggtcaccagagtgcgcttgccaagccacagccaggcggcaatcaggatcccggcaatggcgatcacgcccgatgcgatttccagcgtcatcacgctgccatgctcaagctcggtggtttccggcagaacaccctgcaacggcggcacgatcatcgcgcccacaaaggtggagagcaccagcagaacaatcagcggcagatggtgggtaatccccttccctgcgtgtgcgtgaatttgttctttaccgtggaagacgatgaaaatcatgcggaaggtatacagcgaggtcataaatgcgcccgccagacctgccaccatcagattcatgtgtccgttcgccatcgcgcccgcgaggatttcatccttactgaagaagcctgcggtgatcagcggcagtgcggaaagcgccgcgccacccaccaggaagcagacatacaccagcggaatagacttacgcaggccgcccattttgaagatgttctgctcgtgatggcaggcaaggatcaccgaaccggacgagaggaacagcagcgctttaaagaacgcgtgggtcatcagatggaaaatcgccgcatcccacgcctgtacgccgagcgccaggaacatgtagccaatctggctcatggtggagtaagcgagtacacgtttgatgtccgtttgcaccagcgcggcaaagcctgccagcaccagagtgacggcaccgacaatccccaccagatgcaggatttccggggtcatcaggaacagaccatgcgtacgggcaatcaggtagacaccggcagtcaccatggtcgcggcgtggatcagcgcggaaaccggagtcggacccgccatcgcgtcagcaagccaggtctgcaacggcagctgtgccgatttaccgaccgcaccgcccagcagcatcagcgtcgcccaggtcagcatattattgccagcctcgaagtgcgccggtgccagttccaccatttcgcggaagttgagcgtacccagttcgttataaagaatgaacagcgcgaaggccaggaacacgtcgccgacgcgggtcaccacgaacgctttcattgctgccgcgccattcttcggatcggtgtagtagaaaccgatcagcagataggagcacaggcccacgccttcccagccgagatacatcagcagcaggttgtccgccagtaccagcaccaccatgctcgcgatgaacaggttggtgtaggcgaagaagcgggagtagccctcttcgccgcgcatgtaccaggaggcaaacatgtggatcaggaagccaacgccggttaccacggagagcatggtcagcgacagaccatccagcaccaggttaaagccgatgttgaaatcgcccaccgacatccaggtccacaacggctggctgtaggcctgttgaccgttattaaagaagtcgaagccgacaatggcggtcaccagcgccgccagaccgactgaacccattccaaccgcggcggagaggttttccgaccagcgaccgcgggagaaggagagcagtaaaaagccaatcaatggcaaaataatggttaaggcaagcatgttcatccacgcaactcacttactgaatcgatattcaggctctggcgacggcgatgcagttgcagtaacagcgcaagaccaatactggcttctgctgccgcaaggctgatggcgaggatatacatcacctgaccatcggtctggccccagtagctaccggcgacgacaaaagccagtgccgccgcgttaatcatgatttccagcccaatcagcataaacagcagattgcgtcggataaccagaccggtcagaccgagtacaaacagtatcgcggcgaggatcagtccatgttgtaaggggatcatgcgtgctcctccgtttttcttttcgcatcgccaggacggttgctgagcacttcgcccgcgcgttcttcacgacccacgtggaaggcgacgaccagacccgccagcagcagcatggacgccagttcaaccgccagaacgtatggcccgaacagggtaatgcccaccgctttcgcgctgattggcgtcccgtcgatgccctggtcgttgacgccgagaatggcgtagatcatcaccgccagcaggatggctgacaacgcgccaggaccaatccagatttgcggtttcaaccactgacgttcctgctcgatttcagcgccgccgaggttcagcatcatcaccacgaatacgaacagcaccataatggccccggcgtagacgatgatttccagggcgcccgcaaaataggcgcctaaggagaagaagaccccggcaatcgccagcagggacataatcaggtacagcagcgcatgcaccggattagtgtgggttatcacccgcagcgtcgtcaggatggcaaccaggccacagatataaaaagcgaactccattgcccctctccttacggtaacaggcctttgacgtcgataggtttggcttcgttttccgcttcacctttatctttgccgtcgattgccatacctgccatccggtagtagttatattccgggtatttgcccggaccggagatcagcagatcctctttttcgtagaccaaatcctgacgcttgaactcgccaagctcgaagtccggcgttaactggatcgccgttgtcgggcaggcctcttcgcacatgccgcagaaaatgcagcgtgagaagttaatgcggaaaaactccggataccagcggccgtctttcgtctctgctttttgcagagagatacagccaaccggacaggcaaccgcacacaggttacaggctacgcaacgctcagcgccgtccggatcgcgcgtcagcacgatacggccacggtaacgaggcgccagataaaccggctcttccgggtacatacgcgtttcgcgtttggcgaacgcatgcaggccgatcatccagatactgcgaacctgggtgccgaagcccacaattatttcttttaaagtcatggtcttttcaccccttattgcgcctgccagagaatgacagccgcggtgcccagcaagttgagtagcgtcagcggcaggcaaactttccagccgaaggacatcacctggtcataacgcggacgaggcaatgctgcgcggatcaaaatgaacatcatcatgaagaacgcggttttcagtgcgaaccagatgaagggcggtaagaacgggccatgccagccaccgaagaacagggtaaccatcagcgcggaaatggtgacgataccgatgtactcccccacaaagaacagaccgaatttcataccggaatattcaatgtggtaaccgtcggccagttcctgctcggcttccggctggtcaaacgggtgacggtgacacactgccacgcccgcgatagcaaaggtgataaacccgaagaactgcgggatcacgttccagatgtcggcctggttgttgacgatatcggtcatattaaatgaaccggcctgcgccaccacgcccatcagcgagaggccgaggaacacttcgtagctcagggtttgcgcagatgcacgcatcgcaccgagcagcgagtatttgttgttgctcgaccagccagcgaacagcaccgcatataccgcgaggcctgccatcatcaggaagaacaggatgccgatgttcagatcggccaccacccacgacgggctgaccggcacaatagcaaaggccagcagcagcgaggtgaaggcaatcatcggggccagggtgaaaatcacgcggtcggtgaatttcggtacccagtcctctttgaagaacatcttgatcatgtccgcgaccagctggagtgaaccaccccagcctacgcggttcggtccgtaacggttctggaacaggcccaacagacggcgttcaccgaaactcatgaacgcgccgcaggtcaccacaaccagcagaataaccaccgctttgagaatgctgagcaggatgtcaatcaactccggggtaaaccaactcattgctgtgcctcctgcagatcctcaacgcgtgcgcctgccagtaccggcgcgatgcccggcatacccatcggcaagccgacctgccctgccgtcagtccttcagaaatcaccagcggtaagctgaccgtctgaccttcatagctgaaggcaagtttcgcaccgtcattcacgcccagtttcgcggcgtctgccggattgagcgcaatgtacggctgcggcatacgttgctggaagaccggtgaacgctgggacatttcgtcactgccgaacagatggtagtaaggcgcaacacgccatttcccctcttccgcctggaaaccagccggtacgtgatcgaaataatccagcgcgctgtcagaggcttcgatcagacgtacgcccggatcgccatgacgcagtttgccgcccacttcggcctggaacttgttccatgcctgcggggagttccagcccggcgcccaggcaaacggaatttgcgagcgcggcgcggatggctggttgttcccttccatagagaaggcaaacatagtgtctttgtcctgcggctgacgcggttcatgcacgctgatgttggcgcgcatggcggtacggccactgtaacgatgcggttcacgggccagtttctgaccacgaatacggaagctggcatccggcgcggcatctttaataccggccagctgcggcagcgccgcaaccgcggcgtcgatcacgtgatcgagctgcgtccagtccacttcgcggctctgcacggtgctgtgcagcgagtgcagccagcgccagctttccagcatgatggcgttgcggtcgtagtaagacggatcgtaaacctggaagaaacgctgtgcgcggccttcgttgttgatcaccgtaccgtcgctttcggcgaagctggcggtagagagcaccaggtgcgctttgtccatgatcgccgtgcgctgatggtcgataaccatcaccagcggcgcgcgggagagcgcggcgtcaacgcgggcggcagaagcatgacggtgcagatcgttttccaggatcaccaccgcatcagcacgaccggtttccagttcggtcagggcgtcgtccagcgagccgccgccgatcataccgaggccgacgctgttcactgcacgggcaatcatggtcacgccgacgtctgcgccacggcctttcagcgctttggcgacgttagcggcggcctgaatgaccgccgtgctgccggcgttagtaccggaaataatcagcggttttttcgcgctggccagcgccgagacgatcacgtcgatcttgttttgcagatcgcgatcgatgccttcaacggccggtgcgctggcgtcgagggcattcgcaatggcaaagcccaaacgcgcctgatcttcaaccggtgcgcgataggtccaggcggcgatgtcgtccatacgggtgctgtcaacgttggtgacaaacagcgggtgtttggcacgctgaccgatgttgaggatagcggcgatctgccagtccgcgactttctgcgcggcggccatttcacgggctttccctttcacggcctggcggacagccagcgcgacgcgcgcgccggtctgggtaatgtcttcgcccagcaccagcacggcatcgtaggtttcgatgtcgcgcagcgccggggtatgaatgccgctttcgcgcagcactttcagcatcagctccagacgttcctgctcgccgctggcgataccggtatagaagttttccgctcctaccagttcacgcagcgcaaagttgctttccacgctggcgcgcggggaaccgataccgatcactttcttcgattgacgcagaatatccgccgcgccctgcatcgcctgttcagcgttgagggtgatcagatcgtcaccacgacgctgaaccggctgacgcggacggtctttcaggttcacatagccatagccaaaacgaccacggtcgcagaggaagtagtggttaacggtaccgttgtaacggttttcgatgcgacgcagctcgccgtaacgctcacccgggctggtgttacagccgagagaacattgctggcaaatgctcggcgcaaactgcatgtcccatttacggttataacgctcagagtgcgttttatcggtgaacacgccggtcgggcagatttccaccaggttgccggagaattcgctttccagcacgccgtcttccgggcgaccaaaatagacgttgtcgtgcgcgccgtacacacccaggtcggtgccgtcagcatagtctttgtagtaacgcacgcagcggtagcaggcgatgcagcggttcatttcatgggaaatgaacggccccagatcctggttgcggtgagtacgcttggtgaaacggtagcgacggaagctgtgaccggtcattacggtcatatcctgaaggtggcagttaccgccctcttcacagaccgggcagtcgtgcgggtggttagtcattaaccactccaccacgctttcgcggaactgtttcgcttctgcgtcgtcaatagaaataaaggtgttatcggtagccggtgtcatacaggacatgaccaggcgtccgcgcgtgtcttccgcgttctgatactgcttcaccgcacactggcggcaagcacccacgctacccagcgccggatgccagcaaaaatacggaatatcaagacctaacgagagacatgcctgtagcaggttgtccgccccgttgacctcgtaatctttgccgtctacatggatcgtagccattagcatgcttccaaattaaaaaaatcgttaccacttcctcattcaggctgcctctgcgttggctgcctggatgaacttgtgggcttcaccagcgggctttcaacaggttcggctgaataccgttgattgcatgggtattgctgaacggctgtttgatgccagcttcgaattcttcgcggaaatatttaatcgcgctttgcagcggttcaaccgcgcccggcgcgtgtgcgcagaaggttttacccggcccgaggaaacgacacagttgctcaagtgtctcgatatcccctggctggccttcgccacgctcaatggcacgcagaattttcacgctccatggcagaccatcgcggcacggcgtacaccagccacaggactcacgggcaaagaactcttccaggttacgcaccaggccaaccatgccgatctcgtgatccaccgccatcgccagcgccgtacctaaacggctgcccgctttgccgatgctttcgaattccattggcagatcgagatgcgcttcggttaagaagtcagttcccgcgccgcccggctgccaggctttgaatttcaggccatcgcgcatgccgcccgcgtaatcttcgagaatttcacgcgcggtggtgccgaacggtagttcccacacgcccggatttttcacgcggccggagaagcccatcagtttggtgccggcatctttgctggtcgagatgccctgataccactccacgccgttcgcgaggatagccggtacgttacacagcgtttcaacgttgttaacgcaggtcggtttaccccatacgccggagcttgccgggaacggcggcttggaacgcgggttcgcgcggcggccttcaagggagttaatcagcgcggtttcttcaccgcaaatgtaacgccctgccccggtgtgcacgaaaagttcgaagtcaaaaccgctgccgaggatgtttttgccaagcagaccggcttcggtcgcttcggcaatcgcacggcgcaagtgcacggctgcttcgatgtattcgccacgcaggaagatatagccacggtatgctttcagcgcgaacgcggaaatgagcatgccttccaccagcaggtgcggcagttgctccatcagcagacggtctttataggtgcccggctccatttcatcggcgttacacagcaggtaacggatgttcatggattcgtctttcggcatcaggctccacttaaggccggtggagaagcccgcgccgccgcgccctttcagacctgagtcttttacggcgttaacgatatcgtccggtgccatgccggtcagcgctttacgcgcgccttcatagccatttttgctctggtattcttcaagccataccggctgtttgtcatcacgcagacgccaggtcagcggatgggtttcgggagtacggataatgtttttcatttataccgctccagcagctcagggatcgcctccggcgtcagatggctgtgagtatcctcatcaatcatcatgctcggacctttgtcgcagttacccaggcagcaggtcggcagcagcgtaaagcgaccgtcgaaggtcgtctgccccggcttgatattgagcttctgctcaattgccgactgaatgccctggtagccggtgatgtgacacactacgctgtcgcaatagcggatcacatggcggccaaccggctgacggaagatctggctgtagaacgtcgccacgccttccacatcacttgccggaatatccagcacttctgcgatcgcatagatcgcgccatccggcacccagccacgctgtttctgaacgattttcagcgcttcaatggacgccgcacgcgggtcttcgtagtggtgcttctcgtgctcaatggcatcgcgctcgagggcactcagctcgaaagcctcggtctgtggttgttgattctcgtgcataattagcggtccacatctgacataacaaaatcgatactacccagatagacgataaggtcggataccaggctgccgcggatcgctgacgggatctgctgcaaatgcgggaagcttggcgtacgcacacgggtgcggtagctcatggtgctgccgtcgctggtcaggtagtaactgttaatacccttggttgcttcaatcatctggaaggattcgttggccggcatgaccggaccccaggaaacctgcaggaagtgagtaatcagggtttcgatatgttgcagcgtgcgctctttcggcggcggcgtggtcagcgggtgatccgctttgaacgggccttccggcatgttattgaggcactgctcaaggatgcgcagactctggcgcagctcttcaactttcagcattacgcgggtatagctgtcgcttaccccgccgcctaccggcacttcaaagtcgaagttctcataaccggagtacggacgcgccttacgcacgtcgaagttgatgccggtcgcacgcaggcccgcgccggtggtgccccactccagcgcttctttcgcgccgtaagcggccacgccctgggagcggcctttcagaatgctgttacgcagcgcggctttctcataggaagccagacgcttcggcatccagtcgaggaattcacgcagcaggcgatcccagccgcgcggcagatcgtgcgcgacaccgccaatgcggaaccaggccgggtgcatacggaagccggtgatcgcttccaccagatcgtagattttctgacgatcggtaaaggcgaagaagaccggcgtcatcgcgcccacgtcctgaataaaggtcgagatgtacagcaggtggctgttgatgcggaacagctcagagagcatcacgcggatcacatcgacgcgttcaggcactttaatgcccgccagtttttcaaccgccagcacgtaaggcatttcgttaacgcagccgccgaggtattcgatacggtcggtatacggaatgtagctgtgccaggactggcgctcgcccattttttccgcgccgcggtggtgatagccgatatccgggacgcaatcgacgatctcttcgccgtcgagctgcaggataatacggaatgcaccgtgcgcagacgggtggttcggaccgaggttaaggaacataaagtcctcgttatcggtaccgcgtttcatgccccagtcttccggcttgaaggtcagcgcttccatctccagatcctgtttggctttggtcagctcaaatggatcgaattcggtggcgcgcgccgggtagtctttgcgtagcgggtggccggtccaggtctgcggcatcatgatgcgcgtcaggtgcgggtggccttcgatattgataccgaacatttcccaggtttcacgctcataccagttggcgttcgggaaaagtttggtgaaggtcggcacattcagatcgttttctgacagcgccaccttcagcatgatatcgcggttgcgatcgaaggaaatcaggtgatagaaaacggaaaaatccgcggcgggtaacccgtcacggtgggtgcgcagacgttcgtccatgccgtgtaaatcgaacagcatgacgtacggtttcggcactttctttaagaaatcgccaacttccagcaattgttcacgcttcacccagacaacgggtaccccggtgcgggtcgcctgaacggtaaaggcatccggcccaaaacggttgcgcagttcgccgatgatcgggtcatcgagatggtccctggtctgccatgcggcgtcttgcgcggttaagtcggtcatagtgttcaccattgcaaatggtccgtggtgactgtcgggcgtggcttcgcgctatttgttttgatatgcgaagggtttctccacagcccgcaggcgcaaattaaatctcgtcaggagaacgcagattggttacagcaatgcgttcaccgcgtttgcgctcgcgctctgactgcatgttggcgcgataaacgccctgatcgccaaccacccaggagagcggacgacgttctttaccaatcgattcctgcaacagcatcagtgcctgcatatacgcttccgggcgcggcggacagccaggaatgtacacatccaccgggaggaatttgtcaacgccctgcaccacggagtaaatgtcgtacatgccgccggagttggcgcaggcacccatggagatcacccattttggctcaagcatctggtcataaagacgctgaatgaccggggccattttggtgaaaggtgtgccggcgataaccatcaggtcagcctgacgcggggacgcacgcaatacttcagcgccgaaacgcgccacgtcgtgcaccgccgtaaaggaggtcaccatttcaacgtagcagcaggacaggccaaagttataaggccagattgagtttttgcggccccagttgaccatatcgtgcaggacattttcgagcttgcccatgaacacgctacggttcacttcctgctccagggggtctgttacgatctcctgtttttgcagggggtaacggtcgttctcaccgttaggatctatgcgggtgagcgtgtaatccatcttattgcctcgcggttagccttgacggttagtgttaccggtgatttcagggttcatacgctcgcgacgcgaacgcacaggtgtccagtccagcgcgccaatacgcaccagataaaccaaacccgccagtagcactaaaatgaaaattgcggcctcgacaaagccgacccaaccgctttcacggatagaggttgaccatgcgtagagatagagcgcttccacgtcgaagatgacgaagaacatggctaccagatagaacttggcagacaagcgcaggcgagccgtgccgacggaatcgatacccgattcaaacggcgtgttcttatgcctggcgcgggccctaccgcccaagaaccagccgcctaccaacatcaggcagcacaggcctatagcaacaataagaaagatagcgaatgcccagtgatgagcgataacttcagtggatgttgacatacgcattgcttaactcaaaaagtagcgctgaaacctctgctcttgctggcagatgaacgccacatcgatttaagggaggaacaaaaaaaaccatacatttactgcgagtagtgccgtagacagtaaaatgatgtggttttttactcctttctataaccttttgtcaactttaacaaaagttacctcacattagtttacatccaagacatttcattaacatttaatgcctttttattcgccagtggtaaaacgccgggagcatttttaccctgttgaatcgtgtccgttgtgaggttaaacaaaaattaccctcttattttgacaggatttccccaggattcctccccctaaatgggagtattttcttgatctgtgacacgcttttgttaattcacccaaaaaaacagcaacaaaccagctcgttttttaacatgaacagcagctatgaataagaccattacgggcagggatatagcaaaacgccaatcattaacataatgatatatatagatataaatgatgatttaagattaaaactgatgggatagtgaggttttcaaaccaaaggcggcattattgccgccattggtttgttttgcgtaattacattttgttacgagtttacagcacagttgttactcaagatcctgctcgacaataaagggatccccaccctcttgcggagtaacggtgctgtactgccagggcgtgtgataattttccatcgcctggaagacaacctgcgccagttcgctctctgcctgcgggttatggcagagtacgtattccgtgtcggccagcggcggcagaccgtcggccgggcccagcacgcgcagatccggactcatcatttctaccggccgggcagtgacccccagtccggctttcaccgcggctttgactgccgcaagggttgaggccacatacgccatgcgccagggaatatctgccgcattcagcgtgtgaataaccgtatcgcgcagtacgctcggatcctccagcagcaccagcggcagcgactcccctttttgcagaacgtattccgcggcgcagtaccagtgggttggcgaacggcgcagggtcagggattcgaattgcgcaggccggtgggtgctgaccaccagatccacttcattactttccagcatctccagaatatagggcgtgcgtttaacgcgcacatccagagcaattttcggatagaccgtgctgatgcgatttaacaaaaacggcagtatggtatctgcggattcgtcagacgcgccgatggtcaacacgccctggatattactgaacatcaacgaggtgcaggcttcatcattaaagcgcagaatttttcgcgcatagcccagcaactggatgccatgttcagtcaacagtttgttgcgaccatgacgggcaaacagctctttccccaccagctgctcaaggcgttgcatttgctgactgaccgctgactgtgtgcggcaaactgccgccgctgccgctgcgaaagtgttaagatcggcaaccgcaacaaaagttctcagcagatcgaggtcgagatttagtatcggacgatttgcatttatcatattttttcactcccaggtcgccctcgatgagccgcccggtatttgctgtattcgtaagaaagaagtaattccatttaaaacatgcatccagcaacgtcatggtccagggtggatttgacgcaggtcagggcatctattttgcgggcttatctggcaaatcccgcttatggtcttattttcgactgctcgggttagcattgatataagtaaacaaacatttaccggtaaaatctttatctcagtttacattcgtttgcgttttcacgcgggtaccgcaatacctgaaccccaacgtttttattatcgattacaaaataaaatcctgtaataacaatgaattgaattttgtaatagatatgacaaccaaaaaaagccatacgtatccggcatttgttacaggcatcttaccgcaaaaaccttattttcataagtgttattgggaatgttctgatgctaacgaagaccggagacgtagcttagacttattgatatttaccgtcaccctgatttttcaatcataatattaaataaatattaattgataaattgagaattcattaatactgctgaacaatagcgggcgcacggttttgattccgtctaatccagttcatgccgcaaacacgctgatataacggcctcaacgaatatcagactaaaactcccgtgatttcctttaagccaagatcaagcgctttcactgcaaattaaacaggaattttaactggacaaccactcccccgcgcagcgttaacctctgccagcgactgacgaaaggccgcaaaatcttcttctgtaaagccttctaaactgccacccggcggagtacattattcggtgctgacttccacggcagggagtggccaataacagctaaaaggtcaaaggttcatgtcacccatcgaaaaatccagcaagttagataacgtctgttacgacattcgtggcccggtgcttaaagaagcaaaacgcctcgaagaagaaggcaataaagttcttaagctcaatatcggcaaccccgcgccttttggctttgaagcgccggacgagatccttgttgacgttattcgtaatctcccgaccgcccagggatattgcgattccaagggattatattccgcccgtaaagcgatcatgcagcactatcaggcacgcggcatgcgcgacgtcaccgtggaagatatttatatcggcaacggcgtgtctgaacttatcgtgcagtccatgcaggcgctgctgaacagcggtgatgaaatgctggtgcccgcgccggactacccattatggaccgccgccgtcgcgctctccagcggtaaagccgtgcactatatttgcgacgagtcttccgactggttcccggatcttgacgatattcgcgcgaaaatcacgccccgtacccgcggcatcgtgatcattaacccgaacaacccgaccggcgcggtttattcaaaagagctgctgctggagatcgtcgagatcgcccgtcagcataacctgatcatcttcgccgatgagatctacgacaaaattctctatgacgaggcagaacaccactccattgcgccactggcgccggatctgctgaccatcacctttaacggtctgtccaaaacctaccgcgtggcgggcttccgtcagggctggatggtactgaacggcccgaaaacacacgctaaaggttatatcgaagggctggagatgctggcgtcaatgcgcctgtgcgccaacgttccggcgcagcacgccattcagaccgcgctgggtggctatcagagcatcagcgagtttatcgtgccgggcggacgcctgtacgagcagcgcaaccgcgcatgggagctgatcaacgatattcctggcgtctcctgcaccaagccgaaaggcgcgctctatatgttcccgaaaattgatgcgaaacgcttcaatattcacgacgaccagaaaatggtgctcgatttcctgttgcaggaaaaggtgctgctggtgcagggaacggcgtttaactggccgtggccggatcatgtgcgcatcgtgacgctgccgcgtcttgacgatctggaaatgtccatcacccgctttggtcgcttcctgtcgggttatcgccagtaacatacgcaagggggaagtttgcatcttcccccgctctgcgggcacaatggctttacgttgttgccaccggcaggttacccatgagtcaaagtcatttcttcgcccatctttcccgtcttaaattaatcaatcgctggccgctgatgcgcaatgtgcgcacggaaaacgtctctgagcatagtttgcaggtggcgatggttgcccatgcgctggcggcgatcaaaaaccgcaaatttaacggcaacgtcaatgccgagcgtattgcgctgctggcgatgtatcacgacgcctcggaagtgctgaccggcgatctccctaccccggtaaaatatttcaatacgcagatcgcccaggaatacaaagcaattgagaaaatcgcccagcagaagctggtggatatggtgccggaagagctgcgggatatttttgcgccgctgatcgacgagcaccagtacagcgaagacgaaaagctgatcgtcaaacaggcggatgccctgtgcgcctacctgaaatgtctggaagagctgtctgccggaaataatgaatttttgctggcgaagtcgcggctggaaaaaaccctcgccgcgcgacgcagcgaggagatggattattttatggcagtatttgtaccgagttttcagctgtcgctggatgagatcagccaggattctccactctgaccgccctgcccggcggcgctgcgcttgccgggcctgtgatttcacaccaaatcgtaggtcgggtaaaacgcagtcgccacccggcaaaatatcccctcatacctcaaaacgggaacaacaccgggatcaacactacgcacaccaccatcacgatcagggtgaacggcacgccaatcttcacaaaatcgctgaacttataattccccggtcccagcactaaggtattcaccggcgaggagaccggcgtcataaaggcggcagaggccgccatcgccaccatcatggcgaaggggtatggcgataattccatggatttggcagtcgccagcgcaataggcgccatcagtaccgccgtggcggtattggaaataaaaaggccaatggtggcgcagaggacaaacagacaaagcagcatcatgtgcggcccgtagccgccgccgaactgcatcagcccttttactgccagatccacgccgccggtcttttgcagcgccagcgcaaagggcatcatgccgacgataagaataatgctcggccagtgaatggctttccaggcgctttccgcgtcgatacagcggaacttgcccatcagcagacaggcgataatggccgcgatgggattggggatctcatcggtcagcatcagggcgatcatcagcaccagacaaaaaatggcatggggcgcctggctgtgcgcgggggaggcatcgctctcctccaccggcatattcagcaccacaaaatcgcggcccttctgccccagcgcggaaatcagcttccagttgccgatcaccagaaaaatatcccccagcgccagcggctcatcgacgatggccccctcaagggcgctgccgtcgcgcttgatacccaccacgttcaggccgtaacgactgcgaaagccgatttcacgtaccgttttaccgataagctcggaattggggatcaacgacacttccgccatgcccacatccagcgcctggtcggaaaaatactcgccgcgcaggatcatcggctccagctgctgctcgctgcaaaactcacgcaaatcaacatccgccgccgacatatcgatcagcagcacatcgcgggcgcggaattccgacacgccgttaacgttgaccatcacgcggcgaaaatgccgccagcgctcgacgccgatgacgttcgcgccgtagcgctcgcgcagtttcagatcgtccagccgctggccgatcatcggcgagccggggcggatcgccagacgccgtgcgcgcccggtcaggcgatactctttaattaagtcgcgaaaggtgcggcgcttccagccgtcgcgctgatgctccggctgctcgcctttcagcgcaaagcgcattatcagcatgtacaggatgccaagcccgaggatcgccagccccagcggcgtgacgctgaaaaagttaaagcccgtcagcccctcgcgcaacaattcgctgttcaccaccaggttcggcggtgtggcgaccagcgtcatcatgccgctgataagcccggcaaagctgagcggcatcatcaaccgcgacggcgagattttcatgcgtatggagacgctgagcacgacgggaataaatatggcgaccacgccggttgagctcatgaaggcgccgaggcccgcaacggtgatcatcaacatcaccagcattctggtttcgctgctgcccgccaccttaaccagccacgcgcccatactggtggcgacgccggtacgtaccagaccgtcgcccatcacaaagagcgcggcgataagaatgacgttaggatcgctgaagccggaaaaggcttcgctgagcgttaaggttccactaagtacgaaggcgatgatcaccagcagcgcgacggcatccatgcgcaccttgccggtagcaaaaagtacaatggccacgcccagaaggcaaagaacccaaattaattccccgttcaccctatatccttattcgttgagagggtaattattgtgccataaaaaagccccgtcggaacggggctaaatcatgggatcaggcgttaatttgtacttctacttcaccgtccggccgccgggtgatgaccagcgcctccaggctttgcagcgcaaaatccacttcatcaagacgcggtgagttttccggggcgttaacggaaatgacatggcagcccgccgccagcccggagaggatcccggcggaggcatcttccaccaccacacagttttccgctggcaggccgagcagctccgctcccagcagataggcgtccggctccggtttgccgcgtttcacctgttcggcggtgacaaatactttcggcgagggtaaaccggcggcctgatgccgcgcacgggcgaccggcatcgatccggacgtcacgatcgcccagggaatgtccagcgcgtcgagatgcgtcagcagcgccaccgcccccggcagcgcgatgataccggtggtgtcgctggcttcgatgccttccagacgggtgaattccgcggcgatctcctcttcactgcgtcctttcataaagtgacgcagcgaggtgatggcctgtttgccgtggatgaaattcagcacctcgtcatgcgcgatgccaaaacggtccgcccagttacaccacgcccgctcaacggctggcagcgagtccaccagcgtgccatccaggtcaaacaaaaatcctttacacagcacaggcaggtcctcaggcgttaataatctggttaatttcgttggcgctcagatggtactgacgcgggcaggcatgccatgcgcccagcatacgctggtatttttcccacatcggggtttgtgcattgaagccatgcgtaccggcatcgaaatcggtgtaacgcccttcggtgttcaccataaagcgaacatagctgaggtaacgggattctgtcgccgcatcgaagccgagaaaagtgacccgacgctcgtcaatcgtctgcgcgtctttcaggttggtccaggatacgtgcagcgcgtgatacatctccataatgtcgatcaccacccggcaggtctcttccgacagctcgccgaattcacgatccagttcgcgcatttgcaggccaaagccgcgttccacgatggtttgcagacggcggtaacgctcggcattattgggatccagcatggtcatcattttgtactgattcgacaggatcaggcgttgggcgttggtcatttccattcgttactcctcattacttcacggcaaaaaaaagaggcacataaattatgtgccttctttatatgcgtaatcatgggcgaattacaaatcatccaggaaagttttatccagttgtttgaaggcgcgcttaagcgtgtcagccagcgcctgataatcgggtttgccttcaacaggggccagcgcctgcccggcctcctggagtttgccccgcacttcataaaaccattgcagaatggagggcggtaatggcgtgaccgaacgcttgcccagccaccacaggccctgcatcggcaggctcagcgcaaaaagcgcggtggccaccgccggaccaagttgaccgccaagggcgatctgccagcaaagggtgaataccgcgaggggcggcataaagcgaatggcgtagcgcgtaacgcggatcgtgcggttttcaacaaaaagcggagcgaggctcttttccatgggccaggttttcgcataatgctgtccccgacgaaacaggctgaaaaagctcacatggcgatcttcaggtgcagacatggcgttacctcaacttcacatataaaaattaaaaaatttgtgcaaaacaacaactgctcgggacaacgttcaaaatattttgtcataccacgctgctatcaggtatcctgtttcagcctgatttggccatagacgacgaatcaaacatcgtcaatttaatgaatattatgccactgcctgaaatttgtacaaaatggcataaaattatctgtattccctttcatcgtgccaaaaagttaactgagcatgatgttaatcataaatgtcagcgtcatcatacgctacgctgtgagactcactgacgtttttttagccacgtatcaataataggtacttccatgtcgagtaagttagtactggttctgaactgcggtagctcctcactgaaattcgcaattatcgatgctgtaaacggtgaagagtacctttctggtttagccgaatgtttccatcttcctgaagcccgcctgaaatggaaaatggacggcaataaacaagaagcggctttaggtgcaggtgccgctcacagtgaagcgctgaactttatcgttaacactattctggcacaaaaaccagaactgtctgcgcagctgaccgcgattggtcaccgtatcgtccacggcggtgaaaaattcaccagctccgtaatcatcgacgagtccgtgatccagggtatcaaagacgccgcgccgttcgcaccgctgcataacccggctcatctgatcggcattaccgaagcactgaaatccttcccgcatctgaaagacaaaaacgtggcagtgttcgacaccgcgttccatcagaccatgccggaagagtcttacctctatgccctgccgtacaacctgtacaaagagcacggcgttcgtcgttacggtttccacggcaccagccactacttcgtgacgcaagaagcggccaaaatgctgaacaagccggtagcagaactgaacatcatcacctgccacctgggtaacggcggttctgtttccgctatccgcaacggcgagtgtgtcgatacttccatgggtctgaccccgctggaaggcctggtaatgggcacccgtaccggtgacctggatccggctattatcttcttcctgcacgataacctgggcatgagcgttgatgacatcaacaccatgctgaccaaacagtccggcctgctgggtctgaccgaagtcaccagcgactgccgttatgttgaagacaactacgcagaaaaagcggacgctaaacgtgcaatggacgtttactgccaccgtctggcgaaatacatcggctcttacactgcgctgatggacggccgtctggacgccgttgtcttcaccggcggtatcggtgaaaacgccgcaatggtgcgtgaactgtccctgggcaaactgggcgttctgggcttcgatgttgatcatgaacgtaacctggctgcccgcttcggcaaatccggtttcatcaacaaagaaggcaccaccccggcgatggttatcccgaccaacgaagagctggtcatcgcacaagacgctaaccgtctgactgcctgattcaccacaccgccagccaacgctggcggtgctgttttatcttccgcccgcagcggcggtaacgaaagaggataaatcgtgtcccgtattattatgctcatccctaccggaaccagcgtcggcctgaccagcgtcagcctcggtgtgatccgtgcaatggaacgcaaaggcgttcgtctgagcgtgttcaaacctatcgcccagccgcgcgctggcggcgatgcccctgaccagaccaccaccatcgtgcgcgcaaactccggcctgccggctgcggaaccgctgaaaatgagccacgtggaatctctgctctccagcaaccagaaagatgtgctgatggaagagatcatcgcccgctaccacgaaagcgcgaaagacgcggaagtggtgctggttgaaggcctggtgccgacgcgtaagcatcagttcgcccagtcgctgaactatgaaatcgccaaaaccctgaatgccgaaatcgtgtttgtcatgtcccagggcaccgatacggcggagcagatcaaagagcgtattgaactgacccgcagcagcttcggcggcgcgaaaaacgccaacattaccggcgttatcgttaacaagctgaatgccccggttgacgagcagggtcgtacccgcccggatctgtccgagattttcgacgactcttccaaagcgcaggtcagcaatatcgatccgacccagctgcaacactccagcgcgctgccagtgctgggcgcagtgccgtggagcttcgatctgatcgccacccgtgctatcgatatggcgcgtcacctgaacgccaccatcgttaacgaaggcgacatcaatacccgccgcgtgaagtccgtgactttctgcgcgcgcagcattccgcacatgctggaacatttccgtccgggctccctgctggtgacgtctgcagaccgtcctgacgtgctggtggccgcctgcctcgccgcgatgaacggcgtggaaatcggcgctatcctgctgaccggcgcttatgaaatggacgcccgcgtcgccaaactgtgtgaacgtgctttcgccaccggcctgccggtattcatggtgaacaccaacacctggcagacctccctgagcctgcaaagcttcaacctcgaagtgccggctgatgaccaccagcgtatcgagaaagttcaggaatacgttgccagctacatcaatgctgactggatcgagtccctgaccgccacctccgagcgtagccgtcgtctctctccgccagcgttccgctatcagctgaccgagctggcccgtcaggctggcaaacgcgttgtgctgccggaaggcgacgagccgcgtaccgttaaagcggctgccatctgcgcagagcgcggcatcgccacctgtgtgctgctgggtaacccggacgaaatcaaccgcgttgcggcatcccagggcgtagagctgggcgctggcattgaaatcgtcgatccggaagtggtgcgtgaaagctacgttgcccgtctggttgagctgcgtaagaacaaaggcatgaccgaagccgttgcccgcgaacagctggaagacaacgtggtgctgggtacgctgatgctggagcaggacgaagttgacggtctggtttccggtgcggttcacaccaccgcgaacaccatccgtccgccgttacagctgatcaaaaccgcgccgggtagctcgctggtctcttccgtgttcttcatgctgctgccggaacaggtttatgtttacggtgactgcgcgatcaacccggatccgaccgctgaacagctggcagagatcgctatccagtccgctgactccgccgtggccttcggtatcgagccgcgcgtggcaatgctctcctactccaccggtaactctggtgcaggtagcgacgtagagaaagtccgcgaagcgacccgtatcgctcaggaaaaacgtccggatctggttatcgacggtccgttgcagtatgacgcagcagtaatggctgacgtggcgaaatccaaagcgccgaactcgccggttgcgggtcgtgctaccgtgttcatcttcccggatctgaataccggtaacaccacttacaaagcggtacagcgttctgccgacctgatctccatcgggccgatgctgcagggtatgcgtaagccggtgaacgacctgtcccgtggcgcgctggtagacgatattgtctacaccatcgccctgacggcgatccagtcttcgcagcagcagtaataccggacgcccggtggcgctaacgcttaccgggcctacggttttgtaggccggataagcgaagcgccatccggcaagaaaggcgaccccatacaggtcgcctttttatttacaacaactcccgcgccgccgtgacaatatcctgcgccgtcaggccatactctttttgcaggaaatcctgggtgcccacctggccgtaccgccctttaaccccgacgcgacgcatcggcaccgggcaggtttccaccagcacttccgccaccgcagaacccagtccgttgtgaatactgtggttttcacaggtcaccactttgccggttttctcggcgtagtttttgatcagcatccggtcaatgggttttagcgtgaacatgtcgatcaccgccgcgctgacaccctcctgcgccagcgtctctgcggcttgcaacgcttccgccaccataatgccgttcgcgataagcgtgatgtcgctgccatcgcgcagcacgttgcctttgccgatggtaaaaaccgagccgggcgcataaaccgtcgccgcctgtttacggatggtgcgcagccagtaaaagccgtcgagcgtcatcagctggcgcagcacatcatcgaacatcaccgcgtcggtaacttccagcaccaccgagtgcgccagcccgcgcacaatgcccatatcctcgaaggacatgtgggtgccgccattgtgacaggcggtcacccccgcatctgaggcaataaccttcacgttattgcgctgatagtccagcgccataaacagctgatcgaaacagcgacggctggcgaaggcggtaaaggtatgcacaaagggtttacgcccagtgagggaaagccccgccgcggtgccgatgacgttagcttccatgatgccgcagttgatcacgtgctgcggataacgcttgtgcacgccatccatcgccatggaactcatcaaatccgcttccagcgcgataatatcgctgccgctctcaatctgctctgccacaaatccggcgtacactttacgcatttcaacggcgtcttttcccccgacgggtgcgagcttaatcatgcgcggcctccagttgtgcgatggtctgatccagcgcctgcttcatctcatccgtcaggcgtaaatggtgtgaattgccgagctgttccagataaggcacgccctggcccttgatgctgtcgaggatcaccaccctggggcgcgcctccgccgccggtcgcggcgccactacctccagcagcccggcaatgtcgtcgcctttaacggtataaacgtcatagccgaaggcgcggaatttcccctccagatcgaaggcgcagatgatctcgtccagctcgccgtccagctgctgtttgttccagtcgacaaataccgtcaggttattcagccggtgatgagcgataaactggaacgcctcccagcactggccttcgttcagctcgccgtcgccgacgatgcagaacacccggttcgcgcgcccggccagcttatgggataacgccatgccgcccgcgatggagatcccctgccccagcgagccggtggtcgcatccacgccgcgggttttcagccgatccgggtggcttggcaggcgtgtgccgttctgattaagggtctgcaactcctcaagcgggaaatagcccttaatggcgagagtactgtagagcgccggcccggcatgccccttcgacaggacgaagtaatcacgctgcggccagtcgggatccgccggatcgatacgcatcacttcgccgtacaataccgccagggtttccaccaccgacatgctgccgccgtaatgcccgaaacccagcgtggtcagtgatttcagggtggcgatgcggatctcccgcgccagctgcgtcagttctgcaatactgctcataatttcgctccgctattgggctgcgtgtcgccagccgcaggtttttttcgtgcaaacagattccacgccaccagcgcggcgaacagcgccaccaccagcccggtgatcgccagcggtgagagatagcgcgccagattgcccagcacgatgccgatcacgccgaaatccgcgtccgagaaggtggtattggcgaaaccgatggcccccagcaccggcaacagcagcactggcaggaaggtaattaacagcccgttggcaaacgcgcccagcatcgcgccacgccgtccgccggtagcgttaccaaacacgcctgcggtggcaccggtaaagaagtgcggcaccacgcccggcaggatcagcaccagtttcatctgaccgagcaggaacagccccaccagcccgccgaggaagctgaacaggaaaccgatcagcacggcgttgggcgcatacggataaaccaccgggcaatccagcgccgggcgggcattgggcaccagtttttctgaaaagccggtaaatgccggaacaatttccgcgaggatcagacgcacgccctggagaatgataaataccccggcggcaaaggtgatggcctgaataatggcgtacacgaggaagttctgtccgccgctaatggtgctttcgatatattcacgtccggcacaaaccgccatgatgagataaataatgatcatggtgagcgagatggagatagagctgtcgcgtaaaaagctcaggttcttcggcaggttcatctcttccgttgaacgcgagcccttaccgcagacgctgccgatccagccagccagcacataacccagggtgccgaagtgaccaaagccgatgtcgtcggtgccggtaatacgccgcatatagcgctgggcaatggccgggaagaaggccatcaccagacctaaaatcagcgagccggtaaataccagcccgacgccttcaaacccggcgacggtaaggatcacgccgatcatacaggccatgtaaaacgtatggtgcccggtgaggaagatgtacttcagccgcgtaaagcgcgcgacgataatattggcgaccataccaaaggccatgatcagcgccgtcgatgcgccatatttttccagcgcaatggaaacaatcgcctcgttatttggaatgatcccctgaatattaaaagcgtgttcaaacataccgcctaatggattaagcgatcccactaataccgtggcaccgccgcccagcacaataaaaccgagaatggttttaaccgtgcctttaaccacatccgaaaaggattttttctgcgccaccagaccaattaaggcaattaagcccaccagcactgacggcactttcagtatatcaacaataaaattgagcgtttcaaggataaacatatccgcctcgctttatatgcagttaccggttggcaaaataagtctggagcttggtttccagctcattaatatcgataatattgttgatgaccaccagctggttgtccggcacgctggcgctggcggcgatgtctttcgccatcacgaacagatcggctgcccctggcgtggcggaggagagatcggagtgttccacctccgcctcaatattcagctttttgagcacttttttaatattcatttcgaccataaaactgctgccgaggccggatccgcaaattgccataattttcattattatcacctttcgtagggtaaagttcaggcgcaccacgcaatatggcgtgatgttataaaagcattagcgtgtataaatctaaaagcgttgaataatgttttctatttcctcccgggtggttgcctgatgtaattctgctaagtcctgatcgctggaaaataattccgcgagggtggcgatcatctcaatgtgactgtgcttatcggctgccgcgagcataataatcagatccaccggatcgaattccccggcgttaaatgaaacaccgtgctgtagtttcaacagtgataagccgtgcgcctttgccccctcttccggccgggcgtggggcatcgccagccctggcgccagcacgtaatatgcccccagcgcctgctgctggctgatgatggccggtacgtaatccgccgtgatgacccctgcatccagcagcggctgcgcgcagatcgccagcgcctgttgccagtcatcaacccgttcgcggcgttgaatggtgggaccgttaagccatgtttccagcactctgcttccctctttaatggcaaaagatggacaaactttatgcaaggatccgcagactgaccgtgacgatagtcacaaagatagcgctatcaaaaaccactgtgcagaattgtgatagcgctatcagatcacattcattgttctgaatcgcggtaataatggggttatacggcgtatacttcttttgccacgaataaaataaatcgaaaaaagccactgagatcatcgtctttacgcaggaacgagaatgtctattacccgaaaacggcgcaataccggaaaggtgacgctggcggatgttgcccagctggcgggcgtcggcaccatgacggtttcccgtgcgctgcggacgcccgagcaggtttccggcaagctacgtgaaaaaattgaggcggcggtacaggagctgggctatctgcctaatctggcggccagcgccctcgcctccgcctcgtcgtggaccattgcgatggtggtgcccaatctggcggagtccggctgttcggaaatgtttgccgggcttcagcaggtgctgcaaccggcgggctaccagatcatgctggccgagtcgcagcaccggctggagcaggaagaaaagctgctggaaacgctgctggcctcgaacctggccgccgccattttgctcagcgtcgagcacagcgaaaccgtgcgtcactggctgaccaacgccagtattccggtgatggaaatcggcgcgacgcgaaccgatcccattgatatgaatatcggcattgataacgtcgccgccatgcaggaattaacgcaaacgcttatccagcgcggttatcagaacatcggcctgctgtgcgccaatcaggaacagtggatctttcagcagcatttgcagggctggtataaagccatgctgcgccaccatatgtcgcccaaccgggtaattaacgccgccgcgccgcccaccttttcgaccggcgcggcgcaactgccggagtttttactggcatggccggagctggatgcgctggtttgcgtgtcagatgagctggcgtgcggcgcgctctatgagtgccagcggaggcgcatcaaagtgccggacgatctggcgattgtcggctttggcgacagcgatgtcagccgggtatgccagccgccgctgaccaccatcgccgtaccgcatcgccagattggtattgaagcaggtcgcgccctgctggcgcgactgaatgatgatgactggacgacacgcgcgcctattgcctcgacgctgtgtctgcgggagagttgctgaggttactgcgccgtttccagctttggctgatcgttgttggcattgcgggtcatccacagtgccagcgctttcagcgaatccggggtgaactcatcgcagcgggcggtgatctcttccggcgtcatccagcatacttcgctgacttcatcttcctgaagggcaaaggggccgtgggatacacagctgaacagcgcgccccagacgcggcagtgttcatcttcgaaatagaactgcccgtgctcggcgaggggcacgcccgcaatgcctaattcctcttcggcttcccggcgcgcggaatcgagcaagacttcatccgcctgtaccacgccgcccgctgtggcatccagcatacctggcataaagtctttggtctcggtgcggcgctgcaccagaattttgcccatgccatcatgcacgacgatataggtcgcgcgatgacgcaaacactgcgcgcgcatttgttcgcggctggcctgcgctatcacctcattgtcttcgttgacaatatctacccattccgtgcctgtaaaatgacgttgttccaccatcaggaaaccttctctctaagcgttcttatgacgcgtttttggttgtcgggtaaattacggattaatcgtgacctgtgcaataacgcgttgatcattcagtgcgattacacgcaaaaccttttcatccagcatgccgtagctggcgacatttccgcctttaggaatgctgaccgagccgggattaaaatgaacaatctcatcacgccgttccgccaccggcagatgggtatgaccatacaccagcacatctcccgctcccagcggcggcagattatccggcccaaacagatgcccgtgggtcagaaacaaccgctgattatccatcagcacctgttgccagggcgcggtgatgggaaaattcagcagcatctgatccacttcgctgtcgcagttgccgcgcaccgcaataatgcgcgccgcctgctcgttcagccgcccggccacctgcgcaggcgcatagccttccggcagcgcgtttcgcggcccgtgattcagtatatcgcccagcagcaccagccactgcgcgccgctttcggcgaaccgttgcaacacgcgttcggtagccggtaacgatccatgaatgtctgaagcgaacatcagcttcattgcgcaaacctcgtggtaaaaatcccgtctaatgatagcggatctctgaccgtcgatcagtctgaaggctgcgcagaaagtgcgacataacgctgcactgaggagcgctgccactggaatgtcgcgtattccacaagcgcttcgggcacctcatcgccattaagcaccaggcggttgagcatcagcgccagatcggcatcagcaatgcaccattcgccaaacagattcggcttgccgtgagcaagcagcaggctggcagtatcaaagagtttttgagcgcttgccagaccagcggcgctgagcggcgcttttttcacgcccccgaataccacgtcagtggagcgctcttcacggatcggcatcaggtcgctgcgcagccaggcctggatttgtcgcgcgcgggcgcgtttttgcatgtcgtggggatagatgcgctcccattcaggcggggcgaacttctcgtcgagatattcggtaatggcggaggattcactgagctcgaaaccgtcaatttccagcaccggcacgcggcgggtcagcgtatagccctgccagccagggcgcgtattttcgccgctatccagatccaccgttttcagggtgaagggcaggcctttttcgtgcagtgccacatacaccgacataacataaggtgaaaagtaatttgcatcagaccataacgttattgccgcatcgctcataacaacctcacgcaccagggaatttaccttcaaaatagtgctttacgacacgtctgtcactcaggaaaactcaccacgccggtgttacgcctatactccattctgcgacgccaccgctacgacaggagctgacatgatcgatctctattacgccccgacgccgaacggccataaaatcaccttgtttctggaagaggctgaacttgattatcgtctgataccggtaaatatcggcaaaggcgatcagtttcgcgctgagtttctggaaatatcgcccaataataaaataccggccattgttgatcatacgccttcagatggcggtgcgcccctgagcctgttcgagtccggggagatcctgctttatctggcagagaaaaccggcctgctgctgagcggcgagctgcgcgagcggcaccgaacgctgcaatggctgttctggcaggtgggcggcctcggcccgatgctcgggcaaaatcatcatttcaaccacttcgcccctaaacccgaaccttacgctattgaacgctatcaggtggaaacccagcggctttataacgtactgaacaaacgccttgagcaggtgccctggctgggcggggaacattacagcatcgcggatatcgccgcctggccgtgggtcaacagccatgagcgccagcggattgatttaaataattttcccgcggttaataactggtttgagcgcattcgtaatcgccccgctacccagcgggcaatgcaaaaagcgcagcaactttaggggcgctgcgcgcggcaataatcctcgtgtatgatggagccattcattacaaggagaattatttcatgccgcaacctgatgctgttattcggataaaaaacctgcgcctgaggacttttatcggcatcaaagacgaggagatcgcgaaccgacaggacatcgtgatcaacgtggtgatccactatccggcggagaaagcgcgcgccagcgaagacattaatgatgcgctgaattaccggacgatcaccaaaagcattattcagcatgtggagaataatcgcttctccctgctggaaaaattaacccaggatgtactcgatattgcgcgggaacatcgctgggtgacctatgctgaagcagagatcgataaacttcacgccctgcgttacgccgattcggtatccatgaccatgagctggcggcgctgagcgttaacaggaggttgcatgagggtcctgattacgggcggtaccgggttgattggccgccatcttattccccgtttacttgaactgggccacagcgtgaccgtagtgacgcgcaacccgcacaaggcgcagggccagctcgacgcccgcgtcacgctgtggaaagggctgcacgatcgcacggatctgaacgatatcgacgcggtgatcaatctggcgggcgagcccatcgccgacaaacgctggagcgagacgcaaaaacagcgcctgtgcaacagccgctggaccatcacccaaaagcttgtcgatttgatcaaggccagcgacacgccgcctgcggtgctgatttccggctcggccaccggctattacggtgatttaggggaagtggtggttaccgaagaggaaccgccgcacaacgaatttacccataagctgtgcgcccgctgggagcagatcgcctgcggcgcgcagagcgaggccacccgcgtctgtctgctgcgtaccggcgtggtgcttgcccccaaaggcgggatcctcggaaaactgctgccggtgtttcgcgccggtcttggcggccccattggcaacgggcggcaatacatggcgtggatccatatcgacgatatggtcaacggcattctctggctgctggataacgatctgcgcggcccgttcaatatggtctcgccttatccggtgcacaatgaacagttcgcccactcccttggccatgtgctgcatcgcccgaccatcctgcgcacacccgctaccgccattcgcctgctgatgggtgaagccgcagtgctggtgctgggcggccagcgagcgctgcctaaacggctggaggaatcaggctttggcttccgctggtttgaactggaagacgcgctggcggacgtggtgcgctgaatggtaccggtaatggtcactctcaccaccccgcgcctgacgctttccacctttcaggaaagcgactggccgttctttttacgtctgcgtcaggatcctgacaacatgcgctatatggcggatattgccgccgaggacgaagtgcgccatgtgtttttcacccgcctgaataactccggggcctttgtcatccgccgtcatcacgatgcgacgccgctcggcgatctcgggctgcgtatcagctcgcagaatccgctggaggcggatgtcggctacagcgtggtaagcgaggcgcagggccagggcatcgccagcgaagcgttacgggcgctgtgtgagtatgcgtttgcacagacgggcgtgacggcgctgaatgcgtatgtgctggcggaaaaccgcgcgtcacaacgggtgctggaaaaactgggatttgtgcagacggacgtgctgccaaaggtttacagggtgaacggcgtgtttcatgacgactgcgtgtatcgtcttgagctggcggattttaaataagcccctcacccacaggatgagggggccggtttacttcagcgatcctttaaggaactgctgcaaacgcgggcttttcgggttgtcgaacagctcggcaggggtgccctcttcttcaattttcccctgatgcaggaaaatcacgtgggaagatacatggcgggcaaagcccatttcgtgggtgaccaccaccatggttttgccctcttccgccagctgctgcatgatgcgcagcacttcgcccaccagctcaggatccagcgccgaggttggctcgtcgaacaataacacttccggctccatcgccagcgcgcgggcaatggacacgcgctgctgctgaccgccggacaggtgcaccggatatttcccctgagcgcgctcgtcgatgccgactttcgccagatatttcaccgcccgctcgcgggattcctgcttgctcagccccagcacctgaatgggcgcttccatgacgttttccagcaccgtcatgtggctccacaggttgaaatgctggaacaccatggtcaggcgggtacgcagcaggcgcagctgatttttatcggccaccttcaattgaccgtctttatcgcgcaccagcgtgatgttctgcccgctgaccacgatcgtcccttcgctcggtttttcgaggaagttaatgcagcgtaaaaaggtacttttaccggagccggaggagccgataatggtgatcacatcgcccgcattcgccttcaacgatacgcctttcagcacttcgtgttcgccgtagtgtttgtgtagatcggtaacgtttagtttgttctcagacatcgtattctcagtgcgtcgaagaaggtttcacatgctgtaaccagcgcttttccgctttgcggaacagactgatcagcacataagagataatcagatacagcaccgccgccagcccaaaggcggtaaagggctgataggtcgccgagttaatatcacgggcaatcttcagcagatccggcacggtggcggtaaaggccagcgctgtggagtgcagcatgaggatcacttcgttgctgtaggcgggcagcgcaatacgcagcgccgacggcagaatgatgcagcgatacattttcacctgggaaaagccgtacgcccgcgccgcttcaatttccccgtgcggcaccgagcggatagcgccggcgaaaatctcagtggtataggcgcaggtattgagcgtcagcgccagcaccgtacagttcaggccgctgcggaaaaaggcgttcagcagctccgtacccttcaccacttccagggtgtacataccggagtagaacaccagcagttgtacgtagagcggcgtgccgcggaaaatataggtaaacagccagatcgggaaccagataaatttgttgctggaaacgcgtccgatagccagaaacagcgccagaatgccgcccattaccacggaggagatcaacagccacagggtgatcgccacgcccgttaagcgatagccgtccgtccacagcagggattgccagtactcctgaataatctcgatcacaggtcagccctcttcacacccacggagtagcgacgttcgagcagaagcagcacaccattggagacagtggtaaacaccagataaattaatccgcacactaccgcgaaatagaacggctcccaggtgcttttcccggccagctgcgtggcttttaccacgtcttccagacccagcagcgataccagcgcggtggcttttaaaatcacctgccagttgttaccgatgcccggcagcgcgtaacgcatcatcgccgggaacagaatacggcgaaagatctgcgatccggtaaaaccgaaggcggtcgccgcctcaatatgccctttcggcaccgccataaacgcgccgcggaaggtttcggtaaaataagcgccgtagataaagccgagggtgatgataccggccaccatcggatcgatatcgatctgccccatgccaatggcttcggtaacgctgttaatggcaatttgcagaccgtagaagatcagcagcatcagcaccagatccggcacgccgcggatcagcgtggtgtagccttcgaagatgatgcgcagcaggcggttgccggaaagcttgcccccggcccctgccagaccaatcgccaccgccagcactacggaactgagcgccagctccagcgtaacgatagcgccctgtaaaattacctgtgaaaacccgtacagcatgcagcctgtgtcctgtgtgtgttgatgccggatggcggcttcgcctgatccggcctacgaaatgcgctcaccgcgtaggccggataagacgcgtcagcgacgccatccggcgacctgatagcgatcagccaccgtaaacgtcaaaatcaaaatacttcttcgccagtttttcgtaggtgccatcggcgcgcatctccgcgaaagctttgttcagcgcttcacgcagttcggtatcgtctttacgcacgcccatgccggtgccgacgccaaacagtttttcatctttcactgacgggccgccgaatttataagcgctaccgaccttcgttttcaggaagccttcgctggcggcgacttcatcctggaaagcggcgtcaatgcggcctgcggtcaggtcagcgtagatattgtcctggccctgataggagacgatttccacgcccttcggtgcccagtgcacattaccgtaagtttcctgggtggtgccctgcaatacgcccacgcgcttgccctgcaacttcgccagttctggcacgatatcagaatcttttgccactaccagacgggaatctgccgcatagagcttgtcggtaaaggcaatctcctgctggcgtttttcggtaatcgacagcgacgacataatggcgtcgattttcttcgctttcagcgacgggatcagcgcatccagcgggttctcaatgaaggtacattgcgtattaatacgtttacagagttcttttgccagatcgatgtcgaaaccaactaattcaccctgtgcatttttcgattcaaagggcgcgtaagtcggatcggtaccgatacgaagtttttgcggaatggcagcgaaagcgccggagatactggaaacagcgaacaccagagaaagagataacaccagttttttcatatttatcctcaacagcctgactttccagggggatttgttaaatgaagttgactggtatcgtgccattgttcgccccgacaaggcaaaatattctgtaacaagttacgcttttttttgcatcgcttttgcttaactatgcatgaatgctccattgcggtgcatgaaacgcaccacgctgaagcattcatgtcagttatgcaccacggcgcaacaggtatcagtcgccgtagacgttaaagttaaagtattttttcgccagcttgtcgtaagtgccgtctttgcggatctcatcaaacgctttatcgaacgcagctttcagctcggcgtcgtctttgcgcagaccaataccggtgccgtcgccgaaatattttttgtctttcactgaagcgcccgcgaagtcgaaggttttaccggctggctgcttgaggaagccttcgctggcggccacttcatcctggaaggcggcgtcaatacggcctgcggtcaggtcggaataaattagatcctggttctggtaggccacaacgtcgacgcctttgctgcgccagttgtcatttgcataggcttcctgggtggaaccctgtagcacgcccacgtgtttgcctttcagcgaatcggtggtcggctggatgggcgagcctttcaccgcgatcagacgggcgttagcagcgtacagcggctgggagaaggcgatttcctgtaaacgtttttcggtgatcgacagagacgaaataatcgcgtcgattttcttcgctttcagggaggggatcagcgcatcaaaatcgctgccgacccaggtgcatttcactttgatacgggtgcacatctcgttgccaagatcgatatcaaaacccacgaagtcccctttcgcatccttggatgagaatggcgcgtaggtggcgtccgtaccaatgcgcacggtctgcggcagtgcggcgttaacgctggcgacaccggacaggcccagcagtaaagacagagcaacaaccgtcttcttcatacattcccctcaagttttctgattttattatgtattgcgttgtgttgtgtgtttgctacccgtcaatgcttgcatgtcttatgccagtttgttgccgctgcgatttaccgcgttgagtatgttaacaaaaggttgcaatactgacgtacagtgaaagatagcaggtctgccgacacactcgcgggttacaaaccgaaaacggggattaaatgtcgaggatatgatcgcgcttgcagaattgccccttaacggggcagcgcactactttgaggcattgccgcccggccagcgggtgaaaagatcggcgggcagttcaatatcaaactgatccagcacgcggttcaccgtctgattaatcacatcatccagcgtctgcggacgatgatagaacgccggaacaggcggcatgatcactgcgcctatttcagcggcctgggtcatgagacgcagatgtccaagatgcagcggcgtttcacgcacgcagagcaccagcggacgtcgctctttcagcaccacgtcagcggcgcgggtgaccaggctgtcggtatagctgtgtacgatgccggagagggttttgatcgagcatggcagaatgaccatgccagcggttttaaacgagccggaggagatagtggcggcgatatcgcgggagtcatgcactacatccgccagcgcctgcacatctttaactgagagatcggtttccagcgccagggtctggcgggcggcattactcatcaccagatgggtttccaccccggcaacatcccgcagaacctgtaataaacgcacgccgtaaatggcgccgctggccccggagatccctactatgagtcgtttcatgtccatcgccctttcgctaatttgctgaggactttgcaggattttggcgggagttgcaacagccctctcccggtgagagagggccggagtgagggcgttatccctcgttatgcatctctaaactttccacttcgttctgacgcagcagcgctttggtatcgtcattacgcacggcgtcgagatagtcgagatactgctgatccacgtctttggtgacgtagacgccgttgaacaccgagcattcaaactgctgaatatccgggttctcggcgcgcaccgcgtcgatgagatcgttcagatcctggaaaatcaggccgtcggcaccgatgatctggcgaatttcatccacttcgcgaccgtgagcgatcagctcattggcggtcggcatgtcgatgccgtagacgttcgggaaacgaatttcaggcgcggcggaggccaggtacactttcttcgcaccggcttcgcgggccatctcgatgatctgctcggaagtggtaccgcgcacgatggagtcgtccaccagcagcacattcttgtcacggaattccgcgcggttggcgttcagcttacggcgcacagacttacggcgcagctgctgacccggcatgataaaggtacggccaacgtaacggtttttcacgaagccctggcggtacggcttatccagaatacgggcgatttccagcgcgatatcgcaggaggtttccgggatcgggatgaccacgtcaatatccagatcttcccattcgcgggcaattttctcgcccagctttttacccatattcacacgggcgctgtacacggaaatcttgtcgataaaggaatccggacgggagaaatagacatactcgaacaggcacggattgctgaccgggttttccgcgcactgacgggtgaacagctggcctttttcggtgatgtacaccgcttcgccaggcgccacgtcgcgcaggaattcaaagcccagcgtatctaacgccacgctctccgacgccaccatgtattcggtgcggccatcggcgagatcgcgtttaccaagcaccagcggacgaataccgtttggatcgcggaaggcgaccataccgtgaccgatgatcatcgccacgcaggcataggccccgcggatctgacggttggtggcggcaacagcggcaaaaatgttatccgcttctaacgggtagtggcggaagttatccagctcgctggcaaaaatattgagcaggatttcagaatcggaggtggtgttaatgtgacggcgtttttcttcgaacagacgcttacgcagctcgtgggcgttggtcaggttgccgttatgggcaagcgtgataccgtacggagagttaacgtaaaaaggctgcgcttctgaagcgctggagctgcccgcagtcggataacgcacatggccaatacccatgttcccctgcaggcgctgcatatggcgggcttcaaatacatcgttcaccatgccgttcgctttacgcaaacggaagcagttaagttcatcaatggtgataatgcctgcggcgtcctgaccacggtgctgcaacaccgacaatgcatcataaatcgactggttaaccggcatgaaaccggcgataccgacaataccgcacatacgtatattcctcgttaagccacatctcaggacttacgccctgggcaagaaacttgacgagctttgcagatagtcaaagaaccatctgatgataaaactaaactgcgggatcagctgcgacttttgccagtcttcgcttttggaaaagccggtaaaggtgtcgagaaagaacagaatggcggcgacaatcagcgcaccgcgcagcgcaccgaagcaaatccccaacacccggtcagtacccgacaggccggttttctcgacaagctgactgataacatagttaacaatagcgccgacgatcagcgtcgcgataaacagcaccgcgatagcaatcccatttcgaaccagttcgtcttcaaagcccgtgaaccagacagacaggtaagtgtagtaatgactggcgacaaagaaagcacaaccccatgtcaccagcgacaacgcttcacgaacaaagccgcggataaggctaaccagacaggaaaaaccaattaccgcgatgatggcgtaatcaatccagaccatatgtgtcccacgattaatcgccctgtcatccagttcggggcgaattctaacagaaaaagaaaacgtttgcgtagggatttccttcccgcgcgtaaataaaaatggcgctgaaaaaatcttcaacgccagcacaggcctggcctctgcgggccgggtttttgtgcgttttttctcccctcaccccggccctctccccagggagagggggaaggaagtccgcgaacggttccctctccccccgggagagggttagggtgaggggaaaatcagttcggggtataacccatcaccacgccgcttaagccggagatctgcttcagctcgccaagggatcccttaagcttatctttcgaggcgtccgggccgaccagaatacgggtgattttaccctgcaccggcgtgcccggaatagtgaatacccgataacccgcgctgcgcagtttgccggtcacttcattaaccttatcggcattcttcagcgcccccagctgcacgacatacgccttacccgtcggcgcaggcttctcttcttcggcctgcttcgacggcgtcgtggctgcctgttgctgagcggtatcgcgctgcggttttggtttttccaccggcttaggtttaggtgttaccaccggctgcgggtcaatatccatttcaggattgttggccgcctgacgcgaggcctccagcgacggcgctgcggcgttgcccgcccgcacttcttcagccgcgccttccggcggctgtgccggaagcgcctgcgtggccgccggcagcatgtccggctcgtcgcgatcgccgggttttggcaccagcgggatcgccgcaaactcatcctggtaatgttttttctgcccgtccagcagccccggcagcacaatcacgcccagcgccaccagcacaatggtgcccattaaacggttctgaaacttactcgccaccggttctccccgcgtccatcgcttccatgacatgtgctacggtgtggaaggaaccacacaccagcacggtatcttctggtctggcatccgccattgccgcccgccacgcctgttcgacgctggcaaaggcgctgccgccgttaaggtgcgtcagcagctgttctgccgtcgcgccccgcggcccttccagaggggcacaataccagctatcgacctggctctccagacaggcaagcgttccggcaatatctttatcatgcagcatgccgaccaccgccagcacgcgtccgcttttcggcaacgctgccaggcgtccggccagataagccgccgcatgaggattgtgcgccacatccagaatcacgcgcggcgactggctcactatctggaaacgtcccggtaaaatcgctttcgcaatgccgtcgcggatcgccgtctcgctgatattcaggccgctggcacgcagggcagccagcgcggttgccgcgttgggctgcggcacctgcggtaacggcaggccagtcagctcgccctgagcatcgcgaaaacgccagcggtcgcccgtgacctcatactgccagtcggcatcgcggcgcagcaggtgcgcgcccttctcgcgtgcgacatcggcgatgctctgcggcatatccggctcgccgaccaccgccggtctgcccgcccggaagacaccggctttttcgcggccaatgctctcgcgatccggccccagccagtcggtatgatccagcgcgatgctggtcaccacggcgacatccgcatcgacaatgttggtggcgtcaagacgcccgccgaggccgacttcgaggatcaccacatcaagcgccgcctctttgaacagccacagcgccgacagcgtgccatattcgaaataggttaaggaggtatctccccgcgcaacttcgatggcggcgaacgagcgggtgtgatcgctttctgccagctcttcgccctgcacgcgcacgcgctcggtgtagcgtactaaatgcggcgaactgtaaacccctacccgtagccccgccgccagcagcacagactccagcgtacggcaggtggtgcccttgccgttggtaccggccacggtaaagacaaaaggcgcaggtttgagcacgtcgagcgtagccgccacggtctgaacgcgcgcaagtcccatatcaatggttttactgtgcaggttttccagataagaaagccacgtggccaggggcgacgtggcttgaggaatgcttttcgtttccatgatgcccggcttgaatgcagttgaaaaagtaaaaaggcagagcacctgcgctctgcccttcgattttatcaggcttcgttttcctgatcgggtaccggcggcaccacgatgctttcacgcggcgcatccgggtttggcgtcggcagattcatcagcttcgccagaatgctcgccagcttcaggcgcagttccggacgacgcacgatcatatcgatagcgcctttttcaatcaggaactcactgcgctggaagcccggcggcagtttttcgcgcacggtctgttcaataacgcgtggaccggcaaagccgatcagcgctttcggttccgcgatgttcagatcgcccagcatcgcgaagctcgcggagacgccgcccatggtcgggtcggtcagcacggagatatacggcagaccgcgctcctgcatcttcgccagcgccgcagaggttttcgccatctgcatcagcgacatcaatgcttcctgcatacgcgcgccaccggaagcggagaaacagatcagcgggcaattgtcttccagcgcctgttcaaccgcgcgaacaaagcgagcaccaaccacggaacccatggaaccgcccataaaggcgaattcaaacgccgcagcgacgaccggcataccatgcagcgtgcctttcatcaccaccagcgcgtctttctcaccggtttctttctgggcagacgtcagacggtctttgtactttttggaatcacggaacttcagcacatctttcggctcaagttcgctacccagttccaccatcgatccttcatccatcaggctatgcaggcggttacgcgctgacatacgcatgtggtgatcgcatttcgggcagacctcaaggttacgctccagttcggcacggtaaagcacctgaccgcagctgtcacatttggtccacactccctcaggaatgcttgccttgcgggtgggggtaatattgcttttaattcgttcaatccagctcattgatgacctttatgcatgaacctggtagcccataaatggggcacattaaaacataacgctcggcaacttgggacaaaaaagtggtcgaaccgctgacgggttcttattttgtctgtcgggctgctgcgcgtcggtgacgaataatttcgattacgcctggcaggatcgagagcacgataattgccacgataagcaatttcaggttctcctgcacaacgggcagatcaccgaacaggtagccggcgtaggtgaacagtaacacccacaacagcgcgccgatgacgttataggccgcgaagtgacgatacgacatatgccccattcccgccacaaagggcgcgaaagttctgacgataggcacaaatcgcgccaggataatcgtcttgccaccgtgcttatcgtaaaacgcatgggttttatcaagatagctgcgacggaagatttttgagttcggattgctgaacagcttttcgccgaacagccgtccaatggtgtagttcaccgcatcgccaaggatagcggccacaatcatcagcgtcaccatcaggtgcacgtttagatcgttcgtcggcagagcggagagcgcccctgcgacaaacagcagcgaatcacccggtaaaaacggcgtcactaccagtcctgtttcgcaaaacaggatcaggaacaggatggcgtaaatccagacgccgtactgcgcgaccagctcagccaggtgcacatcaatgtgtaaaataaaatcaatgagaaaataaatgaggtccatgtcttacgcctttgtctgaatgcatttagtccgctaaaaacagcggacccattggcgggcgcggcagatcgaagcggtcgggataatccaccgccaccagatacaacccttccgctttcgccgttgctgccgcgagcgttctgtccttcgccgccagcagttctgctatccagctctccggctggttgttggcgcctacttccatcaggctgccgacaatattcctgaccatatgatgtacaaaggcattggctttgatatcgaccaccacatatgcaccgtaacgcgccacgttaatgtgcatcacgtttcgccacggcgtgcgcgactggcactgaaccgcccgaaacgaggtaaagtcattttcccctatcagcgcctgggccgcacgatgcatccgatcggcatccagaggatgatagtagtgagtgacgccgcgccccagcacggcagggcgcaaacgatgattgtagatgacgtagcggtaacggcgagccgtggcgctaaaacgtgcatgaaaatcatcgggcacattttttacccagcgcaccgcgatgtcaccaggtaaattcgcatttacgcccagcgtccaggccgcatctttgcgctgtacgctggtttcgaaatgcaccacctgcccggtgccgtgcaccccggcgtcagtacgcccggcgcaaaacaccgtgatcggctcatccgccactttcgagagcgcggtttccagcttttcctgtacgctgcgtacttcgttctgccgctgccagccgtaatacttactgccgtcgtactcaatgccgagcgcaatcttgctgacgggctttgcctgcgcgtcggacattagtacatgtactcctgcaccagcttctcggcgattttcaccgccatcagcgcgccgccaaaacggacgttatcggccaccgaccagaactggatctgctccggcatgccgtaatcgttatgcacacagcccacggaaagctgcggattgccggaagcgtcgcccacctgggtcgggaagtcgttagccggggacagcgcaatatcttcgccgcgctcgaaggcatcgcgggcttcttccgccgccagcggacgcagcccttcaaagctgaccatctgcgccagaccgtagaataccggcgaacgtacacagttaacggagatcatcaggccatcgtcctggaggattttacgcacctgatccaccaccacacgggcttcacgcacgctgccctggctgtccggcagcatcggcagcatgttgaacgccagctggcggccaaagaaatcgtcctcatcaacgggaatgccgttgagcagttttgcgctctgccctgccagcgcatccacggcgactttgccctgggaggacgcagacagcaggctggtcacggcgatacgcgacaggccgccttcatcgatcagcggcttaagggcggtcagcagctggctggtgaggctgtccgccaccgccacgatattacggttacggtaatctgccagcacgaacggattgacgtccgggaccaccagcggcacgtccggctccattgcgaacagaccgctggcgtcgatcaccagacaaccggagttggtggcttcctcaatgtaacgggctgaggcttcaggcccggccacgaagaacgccagctgcgcctgcgtccagtcgaattcttcggcatcggtcacgtagaccgttttgctgttatagcgcagggccttaccggcgctttcactgcgcgccagggcgaaaatctcgcctgtggggaattcgcgctctgcaagagtttcgagaagcgcttcgcctacggcgccggtggcgcccaggatggcaatattccagccttcagacatggtggtttactccagacaatagcaatacgctcccctgcccgcaggcgggagagcgacagaaaatgagttagcgtgtcgggtgatgaacggcgttaaagccgagctgttgcagtaaggtcgcggcctgtgcgtcatcacactggatgtacagcgaagaccactcgcgacgctcaagataatttttgcgcagcttgtcaaattcacccggaatgcccgccacttttcgcagtggcgcatcatcgcggcgcacatcatacactaaatgcaccagtcgtttcagcgttggctcatcaagcgggccgtgcagcgtgatgcgaccgaattccggggcgggcagcagggtatccagcgccacctgctgacgcttgccgagaaattcgctgtaggcctcaaacacctgggtggtgccgcgcgctttgccttccagcgtgtaacccgcgatatgggcggtgccgatgtccactttatcgagcagcgcgacgttgagatccggctccggctcccagacatccagcaccacgctgagatcctgaccggcgttcagccgcgccagcagcgcggtgttatccaccaccggtccgcgacaggcgttgattaaaatggtgccgggtttaagtctggcgatcagcgcctcatcggcaaggtgcagcgttttgtacgggccgtctttgaacagcggcgtgtggaaggtaaggatatcggcttcctgcaccagctcgtccagcgaacggaaatcgccctcctcgccacggtcggcgcgcggcggatcgcacaataaggtgcgcacgcccagcgcctccagccgcgcctgcaaacgcgagccgacgttgcccacgcccacaatgccgacggtgcgatcgcgcaggctaaaaccatcgcgctcgcccagcatcagcagcgccgaaaagacatattccaccaccgcgatggcgttgcagcccggcgcggcagaaaagccaatgcccgcctgcgcaagccaggcgtcatcgacatgatcggtaccggccgtggcggtgccgacaaactggatcgcggttccgctgagcagggatgcattgaccttcgtcaccgagcgcaccatcagggcatcggcatcgttcagttccgccaccggtatcgggcggcctgggacaggtttcacctcacccagacgactgaacaaatcacgggcataaggcatattttcatcaacgagaattttcacgttccggtacctgtatgataacgagagataagcgtgcaagtgtgccataatctcgccgccaggcataccgagaatgccgaccaccgttacgaggattttgaatgatgcaacccatccagggtgtgccggtgcgccctccggggcaagacccaactccacccgccagtgctgcgggcgaacaaccgctctcctcgcaacagcgcaccgtgctggagcgcctgatcacgcgcctgatctctttaacgcaccaacagggcgcggaagtatgggcaggagtgaagcacgatctgggcttaaaaaatgataccccgctgctgtcgaaacactttccggcagcggaacagagcctgaatcagcgtctggagaatgccagccagcagcacgctaaccgccaggtcctttcccggctgacagagctgttaggccagggcaacaaccgtcaggcggtgagcgactttatccgccagcagttcggccagacggcgttaagccagctgtcgccggatcagctgaaaacggtgctggtgatgctgcaaaaaggcgagctgaatattccgcagcctcagcagcgccctgctaccgacaggccgctggtgcccgccgagcacaatgccctgaatcaggcggtgactaagctggcggccgcgaccggcgagtcaggcaaacagatctggcagtcgatgctggagctgtccggcgtgaagaccggcgagcttattccggcgaaacattttgcgccgctgatgacctggcttcaggcgcgtcagaccctcagcctgcaacccgcgccgacgctgcataccatgcaggccgcgctcaagcagccgatggacagcaacgaatggcagcatattcaggattatgcccagcagacgttccagctcacgccgcaaagtgtgctgaccaatgcccaggtgcaggatctgcttaattttgtcttcctgcgtcgtaccgagcgcgcgcaggaaacgctggaagtgcgcgatatacagccgatttacagcccgctgttcgcgccggtgatggaaacggtgaaaaccctttcagcccgcccgggcctgatgtttgttgccctgatggtggcattgttgctggtgtggatcgtcatttaacgacaccgccgggtagatttccctacccggcgttctgtttagcgcttacacattctcgccattactttttataacgtcgcgataccagtcgaaggatttcttcttactgcgcgccagcgtgcccttgccctcgttatctttatcgacataaataaaaccgtagcgctttttcatctcgccggtaccggcagagaccagatcgatacagccccacggggtataacccatcagatccacaccgtcctccaccaccgcttttttcatttcgcggatatggttttcaagatactcgatgcggtaccgatcgtttaccgtgccgtcaggctctttttcgtcgatcgcgccaaaaccgttctcgacaataaacagcggcagctgatacatatcgtagaaccagttcagcgaataacgtaagccaaccggatcgatttgccagccccagtccgacgctttgacatacggatttttcaccaggcttttggtttcgtcataatcgagctgcggattatcgtccgtcgctttggtggcaaaagacatgtaatagctaaagccaatataatccacacagccgcgggtcaggatctggcgatcctcatcggtaatgtccaggttaaaggctttctgctcgaagtaatttaaaatgtgctgcgggtaatagccgcgcacatggacgtcggtaaaccagtagcggcgatgcatagcgcgaaccgacatcatcatgtcgttcggatcgcagcttaacggataaatcgggcacatggcgatcatgcagccgatctgaaactgcgggttaatggcgtggcccgcttccaccgccagggcgctggctaccagctcataatgcgccgcctgatacatgattttttcgcgatcttcaccgggcttataatgcaggccggagttagtgaagggggcaaaatcttcgtggaaattggcctggttatttatttcgttgaaggtcatccagaatttcactttattctggtagcgggtgaataccgctctggcgaagcggacaaagaattcgatcacctgacgattgcgccagccgccgtattcggtcaccagataatagggcatttcaaaatgcgagagggtgatcaccggttcgatattatatttcaggcactcatcaaacagatcatcatagaattgcagcccggcttcatttggctccagctcatcccctttcggaaaaatacgtgtccaggcaattgaggtgcggaagcatttgaatcccatctccgcaaacagcttaatgtcttctttatagcgatggtaaaaatcgatgccttcgtggttgggataatatttgccttcgatcaccccttcggtgatctcacgcggcacgccatgacggcctgccgtcatcacatccgccacgctgacgccctttcctccttcgcgccagcccccttccagttgatgcgccgcgaccgcgccgccccagagaaaatccgctttaaatcctggcatgcttacccccttttccgttgataacgcaaagagaataacaacgacgcggcagctttaccggatcgacatcacattattggccaaggctcagaaatgaaaaaaggagccatcaggctcctttcagattcttgccgggcggcggctgcgccgccgggcatgttaattacgcgtcaaatttacgcatcaccagcgtggcgttggtgccgccgaaaccgaagctgttggacattacggttttcagttcgcgctcggtggttttggtcacgatgttcaggccttctgcctgcggatccatttcttcaatgttaatgcttggggcgacgaaaccgtgctccagcatcagcagggaatagatggcttcctgaacgccagccgcgcccagcgagtgaccggtcatggctttggtggcggaaatcgccggggagttatcgccgaagacttcgcggatcgcgcccagctctttcacatcgccaaccggcgtcgaggtgccgtgagagttcaggtaatcgatcggcgtatccacgccgtgcatcgccatcttcatgcagcgcactgcgccttcgcctgacggggcaaccatgtctgcgccatcggacgttgcgccgtaaccgacgatttcagcatagatgtgcgcgccgcgcgccagcgcatgctcaagctcttcaaccaccaccataccgccgccgcctgcgatcacgaaaccatcgcggtttgcatcataggtacgggacgctttggacgggtcgtcgttgtatttggtggacagcgcgcccatcgcatcaaattcacaggccatttcccagcccagctcttcgccgccgccagcaaacacgatgtcctgtttgcccaactggatctgctcaacggcgttgccgatgcagtgtgcggaggtcgcacaggcggagctgatggagtagttaacgccgtggattttgaacggcgtggcgaggcaggcggaaaccgcagaggccatcgctttagtcaccacatacgggccaacagctttcagaccgcgcgggctacgcatggcatcagcgccgaacacctgcgctttggacgagccgccggaaccggcaacgatacccacgcgtgggttgttctggtacatctcttcagtcagaccggcgtcctgcactgcctgctgcatagacaggtaggcataaacagaggcatcgttcatgaaacggaccactttgcgatcgatcatgccggtggtgtcgagttttacgttaccccatacatggctacgcatgccagcatcaagaaattcttgagagaaagtgatccctgagcgtccttcacgcagagatgccaggacttcctgctggttgttaccgatgctggaaacgatgcccaggccagtaatcactgcacgtttcattcaatacccctgtaagtcgaacaattttaatattcgagtggcaagatagcgtacacttgtacgccgaacaagtccgatcagcgaatttatgcagaaatttgcaccaactgacactcctcgttaagatcgtgacactgcccgccacacgagtaacttacgtgaaacaaaccgttatacaacctgccaacctcgaatttaacgctgagggtacacctgtttcccgagattttgatgacgtctacttttccaacgataacgggctggaagaaacgcgttacgtctttctcggcggcaatcagttgcccgcgcgttttcgcccccatccccgcgatttgatggtggtggcggagagcggttttggcaccggcctgaatttcctgacgctgtggcaggcgtttgacgccttcaccgcggcgcacccccatactggcgtacaaagattacattttatcagttttgaaaaattccctctgcgcgccgacgacctgcaaaaggcgcatcagcgctggccggaactggccccctgggcggaacagttacaggcgcagtggccgctgccttttgaaggctgtcaccgtttattgcttgatggcggacgggtgacgctggatctgtggtttggcgatattactaccctgaccgacgcgctggacgattcgctggatcaaaaagtggatgcctggtttctggatggttttgcgcctgctaaaaacccggatatgtggactccggcgctgtttaacgccatggcgcggctggcgcgcccggactgcacgctggcgaccttcacctccgccggttttgtgcgtcgcgggctacaggacgccggttttaccatgcaaaaatgcaaagggtttggccgtaaacgtgaaatgctcaccggcgtgatgacgcagacccgtgagcctgccccgcgcgcgccctggtttgcgcgcagcggcgcatccggccgtgaagtggcgcttatcggtggcggggtggccagcgcgctgttatccctctccctgctgcgccggggctggcaggtgaccctttactgcgccgatgccgcccctgcgcttggcgcgtccggtaatcgccagggggcgctctatccgctgctgaatgcccacgatccggcgctggcgcgcttcttccccgccgccttcacttttgcccgcagactgtatgacacgctgccggtagcgttcgatcatgactggtgcggcgtgacgcagaccggctgggatgaaaagagccagcataaaatcgatcagatgttatctctggcgctgccgcaggagatcgccgcggcagccgatggagcgtgtattgaagcaacgaccggcgttgataccggctgcggcggtattcagtatccgctcggcggctggctgtgtccggcccagctaacggcggcggccattgagctgggcgttactcagggcctgaaagtgcattatcagcgggacgttgccgaactgacgcagggggaaagtggctggcagctgcgttttgctgatggcgctcaggccgcccatgcggtggtggtgctggcgaacgggcaccggctgggggatttcacccagaccgaggcgttgccggtctatccggtggcgggccaggtcagtcatattcccaccacgccggggctgtcgcctttacgtcaggtactgtgttacgacggttatctgacgccgcaaaatccgctgaatcagcagcattgcatcggcgcaagctatcatcgtggcgatcgggaaacggcgtatcgcgaggacgatcagcagcataatcgccagcgcttgctggactgttttccggatgccgcctgggcgaaagaggtggatgtaacggctaaggaggcgcgcaacggcgtgcgctgcgccacccgcgatcatctgccggtggtcggcaacgcacctgattttgcggcgacgttacgggaatatgcgaccctggcggaacacccggcgcaggcggtcagcgcaccggtgtgggaagatttgtatctgctgggggcgctgggttcgcggggattgtgcagcgcgccgctggcggcggagatcctcgccgcgcagatgagcgacgagccgatcccgctggatagcgaaacgctggcggcgctgaacccaaaccgcttctgggtacggaaattgttaaaaggcaaagcggtgataacgccccacggggcgggccggtaaacctgcacgtatcgcccggcggcgcaggcttgccgggcctacatacctgttgtaggccgggtaagcgccagcgccacccggcaaaacagcgggcacggtgccaaatatatcgcccggcggcgcaggcttgccgggcctacatggctgttgtaggccgggtaagcgacagcgccacccggcatatcacgcaaacacccctgccgcgacctgttccggcgttaccacgcccgtatccagcacccagccgctgatcaacgccgccggggtcacatcaaacgccgggttgtacacccgtactttttctggcgcccattgcaccgcgccaaagctgcccgccacgcctgtcacttcctctgccgcccgctgttcaatggggatggcgtcgccatccggacagccacaatccagtgtagtgtgaggcgcggcaacgtaaaacggaataccgtggaatttcgccagcaccgccagcgaataggtgccgatcttgttcgccacatcgccattggcggcaatgcgatctgccccgacccacaccgcgtccacctgccctttcgccatcaggctggcggccattgaatcggtgatcaactggcagggcacacccagttcgcccatttcccaggccgttaaacgcccgccctgcaacagcgggcgcgtctcacccacccagacattcgccacccgcccctgctcatgggcgcgggcaatcacgccgatagctgtcccgacgcccgccgttgccagcccgccggtattgcagtgggtcagcaggcgacttcccggcgttaccagcgcgcttccggcgcgggcgatggcgtcacacaactgcttgtcttcatcgatcaggcgcagcgcctccgccaccagcgccggaacataattctcccgcgccagcgccgctttcatgcgatcaagattattcatcaggttcaccgccgtcgggcgtgccgcgcgcagcgtcgccagcgattcagccagttcatcccgcgtcagcccctgctctgcctgtaacgccagcagcaggctggcggaaaggccaatcagcggcgcgccgcgcacgcgcagggcgtggatatgccccaccagttgttctgtggtgctggccgcaagccagtttttctgctgcggcagcgcctgctggtcgaggataaaaagctgattttcgctgacgcgcagactggtggtctgtaatggctgcatatcgttaaatccctgttgcgttgttgtgacctattgtgtcaggatgacttccggaagtatagacgtctgaatggctttattaacataagaatgaggatcagggcaatgtcggaataccgcaccttcaacgcgcaggacgctgtcgcttatgcacaacaatttggcggtctggccgatccgtccgaactggtggatgcgcaggaggtcggcgacggcaatctcaatctggtgtttaaaatttttgaccgtcagggcgtcagccgggtgattgttaaacaggcgctgccctatgtgcgctgcgtgggggaatcctggccgctgacgctggatcgcgcgcggctggaagcgcagaccctggtggaacattatcagcactgtccacagcacacggtgcagatcctgcattttgacccgcagctggcggtgatggtgatggaagatctctccagtcatcgcatctggcgcggcgagctgattaataacgtcagctatccgcaggcgccgcaacagctgggggaatatctggcgtatacgctgttccacaccagcgatttttatctgcatccccatgagaaaaaagcgcaggtggcgcgctttatcaacccggaaatgtgcgagatcactgaagatctgttcttcaacgacccttaccagatccacgagcgcaataattatcccgccgaactggaagcggacgtcgccgccctgcgtgacgacgcccagcttaaactggcggtggcggcgctgaagcaccacttcttctcccacgccgaagcgctgctgcacggcgatattcacagcgggtcgattttcgtcgccgacggcagcctgaaagctatcgacgccgaatttggtttctttggtccggtgggctttgatatcggcaccgccatcggcaacctgttgctgaactactgcggcctgccggggcatctgggtattcgcgatgctgcggctgcccgtgagcagcgcctcgccgatattcagcagctatggcatacctttgccgagcgtttccagcaactggctacggaaaaaacccgcgacgcggcgctggcgacgccgggctatgcctcgcagttcctgaaaaaagtgtggactgatgcggtgggctactgcgggacagaactgatccgccgcagcgtcggcttgtcccacgtcgccgatctggataccatccgcgacgaggagatgcgccacgcctgtctgcgtcatgccattgagctgggtaaatccctgatcctggtcgccggacgtatcgacagcgcagaggagttaattgcgcgggtgcgccagtacagctgaaccgcgccacggcgcttacggaatgcgggcaatgactttaatttcaaaatcgaagcccgccagccagttgacgcccaccgccgtccagttgggatagggagcctgcgggaaaatctcctgcttcaccgccataatggtggcaaactggttttccggatcggtgtgaaaggtcgtcacatcaaccaaatcatcgaacccgcatccggcagcggccagcgtagcccgcaggttagcaaaggccagccggacctgggcggcaaagtccggctccggcgacccgtcttcccggctgcccacctgcccggacacaaacaataaatccccggagcggatcgccgcggagtagccatgctgctcatataaagcatgccgattggccgggaatatcgcttcgcgttctgtcatcactcacctcttttattcagtcagaaaatccgggcgtcacgcgccaggatcatttaacatacacgctgtatgtgaaaccgagtatctttgcatacgccgcgtatgtcaatttaaaatacgcgacgtatatgaaatgaaggagtgaagaatatggccgtcggtcgtcgtgcagaaatgatggaagagaaccgcaacaaactgattgccgccgcgcgtaaggcttttgcggaaaaaggctttgccgcggcgtcaatggatgaactcaccgccagcgccgggctgacccgtggcgcgctgtaccataattttggcgataagcgcggcctgctcgccgccgtggtggcgcaggtggacggggaaatggcgcagcaggcgaaagatcgcgccagccttgcgccggaaggctgggagcggctgcttgctgaaggcacggcttatattgaaatggcgctcgatccggaagtgcagcgcattgtgctgctcgacggcccggcttttctcggcgatccgtctggctggcccagtcagaatgcctgtctggaagccacctgtgaggcggttgcagagatgatcggccagggcattatgaaagcggtggacgttgaagcggctgcccgcctgctgaacggggcggcgatgaatgcggcgctgtgggtggcggcggcagatgcgccggatgagcgcttgcctaaagcaacgcaggccttcgtgctgttagcggaaggcctgcgtcggtagtgcgattgctggttagttaacggtcagggtggtggttacctcgtaatccagcgcccatgaggtgtgccagtccttaccggcaaaggtcactacgccgcgataaacgccagctggcaggccggggttgtcgctgtgctcatagtgcaacgatgccgcgtagccagtgtactgccatccgtcacaacccgccgctgagttgaaggtgcggtttgaacagttagaatggcgttgtccccggatgtttacattccatgtctggcccatttcatcagtcattggcacagtaagttgcgaataaccattctctgcccagaccagatcacgtggcccctgggtttcgccgatagcgacaaaaccgaggtcaccgaaaccaaatactccatccgttttataagtgctgctatcgtcgctgatctcccagtctgcctcatacttcgcaatgaatatgatttcctgactgaccttgctgctgccgttgatcgaagcggtcaccgtcgctgtacccgcttccggccccgacagctcagctttcgcgatgccgctattattggtgttgctggctggagctgagaggttattcaaggtggtttcccagctcacttccgcgtgcggtaccgcattgtcatgggcgtcaaccacagtagccatcagttccaccctggtggtgttaacgatagcggtggtggtactgacgttcagtgcgacgattttcgcggtttttaaatcaccgacaaaggcgacggcactggctttacgctcttttgccgggctggtcagcgctgcggtcaccacaacattacccgctttcagcgtggtgccgctggtggtcacttcaccgttgctgttggtggtggcgttttccggcgttagtgtcacatcactgcgatccgccttccagtttaccgtcacgtccggtagcaggttgtggtttttatcctccactatcgccttccaggtgatagcctcagagccatccgccacggcctcagttttatccgccacgacatcggcgaactgcgccgtttcaacgttgccaatcaccgtcagcgtcagcgtcttgtcaccgtgggtatgcgaggcggtgacatcgacactgcccgctttcagggttttaaaggtggctgttgcctggccgttggcatcggtcaccgacgtcgctggcgtgaaggtgctgttagcgtcgtcgctgctgagccagttcaccgtttcgcccgccaccggatgctggttagcgtccagcaacgtcgccgtcagcgtcaccacatctttatccgccacaatgtcagcggtcttatccgccgtcaggctggtaatctttgccgtggcgctatcggcggtgaatctcaggctgctgatggagtcgctgttgccattgaccgtcgccctgacttcatagctggcgacaacggctgatttcagcgtcacctgcgccacgcctgcggcattgctggtgctggtgctcgctgacagcattccgctttctggcgccacttcccaggtcacatccgttgcgtctaacgggttggcgttggcatccgtgaccgtggcgctgagggtgatcacatctttatcgttcgccagcgcggtagttttgtcgctgctgacggccacgactttcgccgtcgtcttatccgcgataaaggttgcgctgttcgcctgcattgccgtttccgggctggtctgggcggtaatgactttctcaccggctttcagtgacgttacggtaatggtcgatttgccgttgccgtcgctggtggtctgtgtgctactcagaatggcatcggaggtgtctgcggaccagctcaccgtcgcgccattcaccgcgttgccctgctggtcggtcaccgtcgcttcataggtaatgcgatccgtaccgtcggcgatggcctcggttttatcgagggcgatcgtggtgactttctgggtactgctgtcggcgataaaagtaatgtcttcggtccgtaacggcgtgccgccgttgatagccgccgagacgctgaccgatccggttttcgcagatttcagcacggtcgtcgccacgccctgcgcatccgtctgcgaggtgcggttgccgagggtagtgccgtcggttttatccaccttccaggtgacgctgatgcccgataacggatgattattcgcatcggtgactttcgccgtcagcttagcgctgtcgatgttattcgccaccacctggtttttgtcgggctccactgataccagtttcgccgaggccgggtccgccacaaagttcagcgtctcgctgcgcagggcttccgcctgaccacgctgggcagtgatcaccgtagcgataacatccgcgctggtcaccaggatctgcgcctcgccctgggtattggtgacggattgcgtgtcagagagctgtgccttgatgttatccgccgtccagttgatcgtctccccggataccggatgcccgctgttatcgataaccttcgcggtcagcgtgatagccgtattgttgtctgccagagcctccgttgacgatgccgtcagcgtattaaggtgcgccgtgccgctgtcgacaataaagtacaatcctgccagggtttcgctgctgctgccgctggatgccgtcacgctgtactgcgccacgtcccgcgagctgagtgtcacccgcgccacgccggaggcatcggttttactgctgctggcggagagcgtgccggttgccgggtctaccgtccagttaacgtctgcattgttcaccaggttgccgttcgcatcctcgaccgtggcggtcaggctgatggcatcgctgccgtttgccagcgcagaggcgcgatcgcttttcagcgttttgatggtcgcggtggcgctgtcggcgataaaggtcgcaggctccgcctgtagcggcgtggcttcgctggtcttcgcagtgaccacgaccttgcccgctttcagagaggtcacggtgatggtcgatttaccgtccgcgccgctggtggtgttgctggcgcttaatgtagcatccggattatccgctgaccacgccacgcgggcagcgttgatggcgttcccctgggcatccgtcacctgcgcttcataggtaatactgtccgtgccgttcgccagcgcctgggttttactgagcgtcagggtggtcactttttgcgtgctggtgtccgccacaaagacgatcggatcggtttcctgtacggcgtcgcggttcaccgccgccaataccgtcactgtgccggttttcggggatttcagttcaagcgtggcgatgccgtcgttgtcagagaccgacgttttactgctgaccggcgtaccgtcgcgctttttcaccatccagttgacggtgatacccgccagcggatggttgttctgatccttcacctgcgcggtgacggtgtcggtgtcgatattgttggcgaccacctgctgtttttcactctcaatggcaaccacctgcgcgctggcaacatcggcggtaaagttcagcgcagcggtgctgacgctgttgccctgctccagttgcgcggtgacgacggtactgatgacttcacgactggtgacgtcgatcgtcgccagaccttgtgcatcagtggtggtgctgtcggtggaaagcagcgctttcgggttgtcggcgcgccatttaatggctgcatcttgtatcggtttgccatactgatccaccacgtgcgcggtcagcgcgataggcgtggtgccgtcagccggaacactgctggcggagacgtcaatctgcgttagcttcggcagaatttccgtggcttcgaggatgagttttgccgtcgccagtttggtgctgccgtcaatcagcggttgcacggtaacgctgcccggcgtggtgccgctggtgaaggtggcgacatagacgccggacgaggtttctttaaaggcgctgatggccgccgctttgctgtcgctggcaaggcctttcgcgacgctggccggagcggtaagggtcgcactcaggcgttccgcaaatccaccggcattttctcctgctgcggttttcagtgtcacggttaccgccgaggtgctgatgccatcggctggcagcgtgacgggcgaggcgctggtcgtggacaccaggcttgccacatcaatgccgctgacgttcaccttcatctggctagtgtttgaagcattgccctttttatcccgcgcgacggcggaaagcacatacgtattggcgctgccgtttttccacgccgggaaggtcagcaccacctgctcggggctggaagtatcggcgattttcccgccctggcggaagaattcatccccctgccagtcgattttttcaaggccgtatttggttttgaccttcgccgtcaccgtctgcttttcgccttccgcgccggtgagttcgggcggcaggcccagcgaaatcagatcctgcttgcgatactccagcacgatattattgttgcgatccactaaatccatgcggctgccgagcagcgagcggcgcagggcgacctggtccggatcgagctgggtgctgagcggcacgccaggggtccaggagacgcccagattcacctgggtgtcatttttaccgcccttaccgaatttctggttaacacccagcgtcatcattggcaccggggtgtaattcagcccgaaggtaatagcatgcgggtttttctgccggtcgtcttcgtcgtcgctgaacaggccgacgctgtcgccataatattgttcgtagaccagcgtggtgcccagctgcggccaggcgggtaaataaccattggcgcgaatgtcaaagccgttggcgacccgctcgtcatagtcgctgtattcttttgatgccatccagtcgctgagtcggaaatagccgttggcggaaagtttcaggtaatcccagcccatttccgtcccgacgccgaggcgtttatggtgattagcggaaatctgctcatcgtagaaaacgttggtgccccacatccagctatcgctgaaataacgatagccaagaccggcgtttaccatatttcgctcatcgtaccgacgtccacccaactgggtaaaccagaggtgttcttttccgtcatataacggcagcagcagatccagttcagaatcctggagggtaaaatgttcgtcggtgctgatgctgacgcgggcggtaccaaactgattaagccagttttgcacttcggccgtcgcggcgctggtcgcagtggagacaatagcctcgtcgagcgccccgccattaccgccgtttaagactgaccccgcctgcatggcagtctgggcgatggcctgttcgttgctggtatccggaggctgagatttaatcactctttcctgcgcctggctggtcgagaatgttcccagataacagagcgaggtcggtgagataaactggagcgcgatttgcacccatgccagtgcttttttcattcgcatgataattaagttccctttaagtaacacaccagcggggaactatatatagaatgaaaggtctttttaatattttataagtggcgctgcattattgcatctataaagcaataatcaatagtaatttaaaaaaacgaattcactcatgggcaagaaggccttccttaatttaataaggaaggccttaaatttatcagaaaataccaatgaaaaatataatcggggtgtatatcagtaatccccaattattttgaaagaagttatttcataatgaattattatcgtctaacccaggtattcaatcacggagagtccgccattatagtctgttgcataaatgatccccgccgcatcgacaaagacatcacaggactggatcacctgcgggcgtccgggacgggtgtccatcatggtagtcggtgcggcaggcaccagcgcgccggtttccaccggacggtacggatctgatatgtcataggcacgcacgccagcattctgataagtggcaaagatcagcgttgagctgacaaaactgccaggccggttttcatgcaggttatgcggcccgaagtgcgcgcccttcgccacgtagtcagtttcattcggctgcgggaaagtggcgatgctcaccgggtttgacggctcgcgaatatcaaacagccagatcagcttctcgccatcttcctgattgtcgagcaccgcttcatccagcaccaccagcagatctctgtccggtaacggcagcgcggtatgcgtgccgccgccaaagggcgggctccagttgcggtggctgatgagcgttggccggttgcgatctttcacgtccagcagcgtcagcccgccgtcgcgccagctgccataggcggtatcgccggcaataatggcgtgatgcagcgcatagcgtttaccttccggccaatgcggagtttcgcccgccgcctgatgcatcccaggtaaccaccagcgcccggccacctctggtttgcgcggatccgccagatcgatagtcaggaaaatataatcggtgaagccgtcgatcagcgccgagacgtaagcccagcgtccgccgacgtaccagatacggtgaatgccaatgccgttcagcgacaggaagctgatttcacgcggtttgtcgggtgtggaaatatcaaaaatgcgcagcccggcgctccagtctttgtcctgcacatcgcgcaccgtctcgcctaccggacggctgtaatagaccttttcatcggcaaaacgcgcgtcggcgaacagatcccgggcgttgatcaccagcagcaaatcgtcgtgcgcctgtaaatgaacgttccaggtgcccggcggcgcaggtatgtagcctgcgggtttcgggttggcaggattgcgcacgtccacaatggaaaagccctgcgacaccatatggccgatatacgcatagccgcgatgcaccatcagctgcaccccgtccggtcgaccgccctgatcgctgtggccaatgaggcgcatattgcggctgtagtcgggagtgggtaaatgagaagccacgttgtttccttgttacgatgttgccatttcgccgggcggcgctgcgcttgcaccggcctacatgatgtaggtcatgggattttgtaggcccggtaagcgcgagcgccaccgggcaacattatttctgcttcgcttccagcgtcgcaaaccacggcgcgataaagtcttccgtctggccccagcccggaataattttgcccagcgccgcgacgttaacattgcctggctgactcgccagcagcgcctgcggaatggcggcggctttaaagtcataggtggcaggcgttttctcaccggcgatcttattggcgatcagccgcacgttggtggcgccaatcagcttcggatccaccgccacgctcactttccacgggctgcccgcctcacgcatcagctgtaaatcctgattggagatgtcgatgctgtagagtttgatctcggtacggccattctctttcagcgctttatatgcgccctggctgaaggcatcccaggtgccccagatggcgtcgatctgccctttcgggtatttcgccagcaccgcgcccactttgttggcggtatccccctgtacgtccgacgacaccgcgccaatggattccagctctttgatgcccggatgctgcttcagcagttcctgataggccgcctggcgacgctccatcggcgggaaaccggcgacccacagtttgatgatgttcgccttgccgttgaaatctttcaccagctcgccaaacgacagatccgtcagggaggcgtcatcctgctgggtaacggtcacgcccgggatctccccttttaccgccgtatcaaataccgacaccgcaatgcctgcgtccaccgctttcttcaccagctcagtggaataaggatcgcgcccctgggaaagaataatgccgtcgtatttctggctgatggcctgattgacgaaatcctggaacttcgcgtcatcgccgttacttaaaaaggtgctgattttaaagccgagctttttgccttccgtcagcgccccggagacaaactgcgtcgtgttatcgtcggaaccaaggttacgaataaccgcaatacggatcgggccgtcgtgattggcgatggcggccggaaccggcgcaggcgtggcggcataacccggtactgaactcagtaagcccagcgccagcagtgacagtgcaaattttttcatctctgtttcccctgaataataaattaacggcgctggaaataagtgagtgcaagagcgccggccagcaccagccccttaataatgtccatggcgtaatagggcactgacagcatcaccagcccgttcgacagcacgccgaggatgaccgcgccaaccagcgtaccgagcgcattgggtttaccggagcccgcgagcgaaaagccgatccacgccgccgccaccgcatccatcagataaccgccccccgcgttcacctgcgaggagccgatgcgcgaggccagtaaaatcccgcccagcccggccagcagcgaggcaatcacataggccgccactttgtagcgcgtggtgcgaataccggacaggcgcgccgcttccgggttgccgccgatggcgtacatacggcgaccgtgcgttgtcagcgacagcgcaagctgcgccagcaccgtgaccaccagcatgatgatgacgatcaccggcacctggccgagcagcgcaaaaccctccgggatcagcccttccgccatttcgccgctcggcagcagcatgttttgcgtgatcgagccgccgtagctgtacgtcatcgccacaccctgaataacgaacaggctgccgagcgtggcgagcatgtcaggaatacgcagcacgacgatgagaaaggcgttgaacagccccaccagcgtacagagcgccagcgtcaccagaatggcttccgtggtgccaaatccgtgccagacaaacagcgaaatcaccagcgcgtttgccagcgacgccgtcgatcctaccgacaggtcaaaaccgcccacggtgagggaaatggacacgccgatggcgatcaccgtgacaatggcaatggagcgcagaatattgatgatgttgaacggatcgaggaagttatccgaggcgaggccaaacacggcgatcagcaccaccacggtcagcaacatgccccatttataaagaaaatcgaaaaactgctgacggcccgatgccgtcgcattcactgaaagggccttgctcacgacgccgtacctccggtcgaataataaagtaatgtctcttcacgggcgtccgccccggcgatctccgccacgattttgccgtcccacaacacgcagatgcggtcgcacagtcccaccagctcggcgaactcgccggaagcgtagatcacgcccttcccttcccgcgccaggccgtcgataagctgaaacagatcggttttagctttcacgtccacgcctttggtcggctcatcaaaaatcagtacgttcgcgttaccgcgcagccatttgccaatcgccactttctgctgattgccgccggaaagccgccgcagcagttgcgctggtccggtggtgcgcacgccggtgcgggcgatcacctcctgcgcccagcgccaggccttgcgatggctgaagatcccgccccgggagaagctgttgtctgcgctgaccgccagattcatgctcaccgattcgtcaatgaaaatgccctctttgcggcgctcctccggcaccagcgcgatgccgcgcagtacagagtccgccggatcgcgcggtttccacggctggctgttaagctccccgcgggtgatacggcttttgctggcgccgaaaagcgccttgcacagctcggttttgcctgcgcccgccagcccggcaatgcctaaaatctcgcccttgcgcagctgcagggagatgtcttttaacaggccttcatcgtgcagcccctccacccgcagcaaggtctcgtcgctgtggcgggcgcgtttcggcgggtaaatatcgctcagctcatgacccagcatcttctcgacgatctcctcgccgcgcagattgtccattggcccggattcgatcagcctgccgtcccgcagcaccgttaaggtgtcgcagatggctttcagttcatggatgcggtgcgagataaacaccaaggcgatcccctgctgttgcaggcgtttgaccaccgcaaacagccgctcgctttcgtgctgatcgaggggggctgtgggttcatcgaggatcaaaaaacggcagcggtgcgacagggcgcgcgccagcaaaatttgctgtttttcggccagcgtgcagctgtcaatcgggcgtcgcacgtccagagttacatccagctgcgccagcgcagcacgcgcctgctgacgcactttcgaccagtgatatgcatggcccggctccgccagccggtcgagcataatgttttccgcaatcgacaggccggggatcagcgccacgtccacttcctgctgcaccagatgaatacccaactgttttgcgtcgcggggcgagcgaatggacaccacctggttattgatggcgatctccccttcgtaatgatcgtgggtgccgcacagcaccgccatcagcgtggatttgcccgcgccgtttgccccggtcagggcatgaaccgagccgccgcgcagggtaaaatcgacctgcgacagcgctctgacaccggcaaaggcgagcgtgatggcgcgcatgtcgagatggttaacgctcattcgctggagatccctgtcattaatagattgatttcatgaatttttcacagcgcggcttgactgacaactacggaaaaggcataagataaagcaaaatattattagccatccggatgtccagacataacatcaggttagcgatcacgcacaaggacacactcatgagcaacaccgatattcgcgtcgtacccggccccgccaactactattcccacgccggcagtctggcgcgcctgcatgatttttatacccccgaacagctttcccgcgcggtctggatctacggcgaacgggccatcgccgccgccacgccgtacctgccggaaagctttcatacgccgggagcaaagcacctgctgtttaaaggccattgcagcgagcgcgatgtcgcggagctggtggcgcagtcgggagaagatcgcagcgtggtgataggcctcggcggcggtgcgctgctggataccgtgaaagcggtggcacgtcgtctggcgctgccggtggtggccattccgaccattgccgccacctgcgcggcctggacgccgctctccgtctggtataacgacgccggacaggcgctgcattttgagattttcgatgacgctaatttccttgtactggtggagccgcagatcattcttgacgccccggcggagtacctgctggcaggcatcggcgataccctggcaaagtggtatgaagcggtggtgctggcccctgaaccggaaagcctgccgctgacggtacggcttggcatcaatggcgcgctggcgatccgcgatgtgctgctggaaagcagtgaagcggcgctggcggatcaggcacggggcgaggtgacgcaggcgtttcgtgatgtggtggacgccatcatcgccggtgggggcatggtgggcggcctgggcgagcgctatacccgcgtggcggcggcgcattcggtgcataacgggctgaccgtgctgccgcaaaccgagaaatacctgcacggcaccaaagtcgcctacggcattctggtgcagagcgccctgctcggccaggacgaggtactggcgcagctcatcgccgcctataaacgtttcaacctgcccaccaccctggcacaactggaggtggatattcacaacgccgccgaactggataaagtgatcgtccacaccctgcgcccggtggaatccatccacgcgctgccggtgccggtgacccccgcctccctgcgtgcggcctttgaaaaagtggaaaacctcagccgctgatcttaacagcagcgcgcgccgcctttgctgccgtagcgcgcgtcctgccgatcgcggaaaaattcttcataggtcatcggcggctgatcggggtggttctggcgcatgtgctcaacgtagttatcgtagtccggcacgccgatcatcagcttcgcggcctggcccaggtattttccggctttagaaagcgtatcgaacatagtgactccgttttgatagtttggcccggcactcttaccagagcgccgggcgttaccgcatcagtgcgcgcttttcgcctgcgtcacaatctgatcgacatttgccggcatcggctcatacggcgtctcattggcagtaggacgatcaacctttattgccgccagcgcggttttaatggagtaaaacgccagtaccaccacaaccaccataaagaagatggtcagcccggcatcgagacggttgttgaacaccagctgacgcagctgtgcggcggtgtactgcgccggaatgttgccgctgtcgatcatgctctggaagcggttggcgatcgccaggaagcccactttcgcatccgggctgaaggccttctgccagcccgccgtcagggtgcagatcagcagccaggcggtcggcagcagcgctacccaggcataacgctgacgcttcattttgaacagcactaccgcgcagagcatcagcgccatccccgccagcatctggttagcgatgccgaacagcggccacagggtattgataccgcccagcggatccaccacgccctggtgcaggaaataaccccatgccagcacgcagagcgccgtcgccagcaggttggcgggcagcgaatcggtacgcttcagccccgggcttatcacccccagcagatcctgcaacataaagcgtgcggcgcgcgttcccgcatccactgccgtgaggataaacagcgcttcaaacaggatggcaaagtgataccagaaggagacgtccatcaggccgccgagcgcgccgtgcagaatgtacgccatccctaccgccagcgtcggtgcgccgcccgcacgggaaataatcgactgctcgcccacttcattagcaatttgcgtgagcgtttccggggtaatactaaagccccagccgctgaccacctgcgccgccgatgcaactacgtcggctgtccccgccggagccagcaccgccatcgggctgttcatcgcgaagtagacgcccggatcgataatacaggccgacaccagcgccatgatcgccacgaacgactccatcagcatgccgccgtaaccgatcagacaggcctggttttcattcgccagcattttcggcgtggtgccggaagcgatcagcgcatggaagccggacaccgcgccacaggcaatggtaataaacaggaacgggaacaggttgcccgtccacaccggcccggtgccgtcgataaatttcgtcagcgcgggcatggtcagggtcgggcgcataatcagaatgccaatcgccagcccgacaatggtgccgattttcaggaaagtggaaaggtaatcgcgcggcgccagcagcagccacaccggcagcaccgccgccacaaagccgtagcccacgaggatccacgtcagttgcacgccggtaaagtcaaagtacggcgcccaggtcggactgtccgccacccagccgccggagatgatagcgaacaccagaaacaccaggccaatcaccgacacttcgccaatacgtcccggacgcagataacggatatagatccccataaagagcgccagcggaatggtaaaggcaacggtgtaagtcccccatggactgtgggtgagggctttcaccacgatcatcgccagcaccgcgaggatgatcaccatgatcataaagcacgccaccagcgcaatcaccccggcggtcggccccatctcctctttcaccagctcgccgagggatcgtccgtcgcggcgcgtggaaacgaacagcaccataaaatcctgcacggcacccgccagcaccacgcctgcgaggatccagatcatccccggcagatagcccatttgcgccgccagcaccggccccaccagcggccctgccccggcaatggccgcaaaatgatgaccgaacagcacttttttatcggtcggcacatagtccagaccgtcgttatgccgcaccgcgggcgtcatacgtgtggcatccaccgccagcaccgtgcgggcgatatactgtccataaaaacgataagcaatcagataaatacagaccgccgccaccacaatccacagggcgttgatctgttcaccacggtttaatgcgatatagcccagggcgaaggcgccaacaacagagagcgcggcccatatgaggtatttccctgaattttgcataatcggtatccgttggctgagacagagagatgttacattttgtatctatatcaacctcctgcttttaacaatgttgaaaccttaaaaacgcctgtcagccccgtctatttacttcacagtgttacggcgatcactctgcgcaggtcgtcaggctgcaacagccgccgcgtttcagatccggcgtaacattccgcccttcccgccagctggtacaacctcggtcgttattctgatttatggctttttagcaattttctataggagtcaacggcttgcttcacggtttttgcccggcccatcacggataatccgttaagtttgtgaggatttatttaatcaaggagaagcaaatggatgtaacaccagacgatcgtaaaccgggtcccgtggcctacttcgcgctggcctttgcagcggtgtttttctcagggctgctgggcggtaaagagtggtacggggtgtttgacttcaccaccctgaacggcgcttttggcaaagtggtgtccggcgtcagccagaacggcgaaacgctgaaaaccaccaccagcgcctttcgcggcgtcggcggtaacggggcgatggacggctttctgttcgcccttgggctgatcccggcggtgatgtttgcgctggggatgattaacgtgctggagcattacggcgcgctgaacgccgcccgccgtctgctcacgccgctgctgcgcccgctgctggggctgcctggcaccaccgggctggcgctaatcggcagcctgcaaagcactgacgtcggggcgtccttaacccgtaatctggcggatgaaggtcagctggatgaaaacgaaaaagacgtgttcgccatgttccagttttccgccggagcgatgatcaccaactttttctcctcaggcgccattctctttacgctcatcgccgccgatggcagcaccgctgtacccacctctatcggcatgtgtatcctggtgatgtttattatgaaaattgtcggcgcgaacctgatgcgcctgtttatccgcttcacgcagaaaaaaagcgccgcgcaaggagctgcacaatgagccacccgacctctaatcccgttattaccgatgtgtttgtcgcaggcgcgcgcaaggggtggaatatcgccaccaccagcacactgcctaacgtggtgatggcgtttatcatcatcaaagcgctggagatcaccggcgcgctgaagggactcgggctgattttctcgccgctgatggggctgttcgggctgccgggggaagcggcggcggtgctgatcggcggctggatgtcgatgggcggcggaattggcgtcgccatcggcttattcgataagggcattatcaccggcgaacatctggcgatcatggccccggccatttacctgatgggatcgcaggtacagtacctcgggcgcattctcggggtgattggcaccagcgcccgccgcattccgctgatgatcgtgatctcggttatcaacgccttcatcgctatgttactgatgcgtatcattatctagaacaggatgtcttatgaatatcgaacactatattgctgaactggaaagcctggtcaacgtcgattgcggcacgcaatgcgtgcagggcgtggcgcaggtcgccgacagactggcggcgctgtggcgtcaggaaggctggcatgtgactaccgttgatctcggcactgcggtagggccgggactgctggtgaccaatcagccgcaggccacccattatgatgtgctgctggtcggccatatggacaccgtgtttccggcgggtacagtcgcccaacgcccgatgagccgcgacgacagccgcctgtacgggcctggcgtctcggacatgaaaagcgggctgctgaatattcttcaggcgatgcgcgaactgcccgccgccgataaacatcgcctgagcattgcggtggcgatgaacccggacgaagagaccggctcggtgcactcggaagcctggctaagcagcctggcaagcaccgcgcgggtggtgctggtatgcgaagcggcgcgcgccgacggttcgctggtgaaagcgcgtaaagggctggccggttatcaactgaccttcagcggcgtcgccgcccatgcgggtaacgatccggaaaaaggccgctccgccatcaccgcgctggcaaatgcggtgatcgccattaatgcgctggcggatatgccgcgcggcaccacgctgaatatcggcgtgatcagcggcggcagcgcgtctaatgtagtggccgaccatgccaccgccgagctggatctgcgctattgggaaaacagcgaatacgatcgcgtccacgcccggctggaagcgctgtgcgctgaaggttttcttgacggtgtgaccaccaccctgacgcgcgtgaactacaaaccggcgatggcggcaagcgagggtaccgccgcgctgatggcgctggtggaacaggcgggtgcggcagaaggcattccggtgacctggcaggcggtgggcggcggcagcgacgccaaccatattgccgcgctcggcattccgacgctggacggcttaggtccagtcggcgcgggctttcacagcccggcggaatggctggatatcgcttccatcgagccgcgtatcaggctgctgaagcggattgtgtcgatgctgtaaatggcgctggtgatggggactaccccatcaccgccgtacttaaccgacaggtgcagcagcgccgtccctgctcgtcaaagaccacaatttcccagctctggctttgccgcccgaggtgcagcggctggcaaacgccgcgcaccctgccctgcgataccgggcggtgatgcgtggcgttcagctccgtgcccaccacgcactgcccgtcgcgggtcatcagaaaaccggccatcgaacccagagtttccgccagcgccgccgacgcgccgccgtgcagcaggccgaacggctgatgagtgcgcgcatccaccggcatcaccgcttccagcacctcatccccgagacgggtatagacaatgcccagatgcgccaccatggtgttcgcgctggtggcattcagttcatcgagggataaatgacgtttccagatcatgcttatgctcccagcgtcgagccgccgtccaccaccagatcctgcaaggtgatgtgccctgccagatcggacgccagaaacagcacggtaccggcgatgtcctcaggtctggcgattttccccagcggaatgccgagcttgaactgctcgccgaaaccgcgaatgcgctgctgttccgcgtcctcgctggtccacagcgtacgctgcatgtcggtatccgtggagccgggggagacaagattacagcgcacgccgctggcggccagctccagcccgacggtcagggtcaggcttttcagcgccgctttcgacgcgccataagcgctcatccccatacgcggcgtgtgcgcggcgtcggaggcgacggtgacaatcgccccgcccttctgggcgcggaatattggcatggtctgctgaaagagattaaaggccccgccgacgttcaccgccatggtctgctgccagtcggcaaggctgagggcatcggtcgcgcccatgcgcaaaatcccggcggcgttcaccagcacgtccagccgtggggtatgcgccagcagacgctggcaggtgtctgccacctgtgtggcatcggcaatatccagccgcttgcaggtgaagggataatccgcctgcggaaagtccagatcgaagccggtcacctgcgcgcccgcatcggcaaaggccagcgcggtggcgtaaccgatgcctttaccggctccggtcacccacacggttttgccgctaaaatccagccccgccattatttcacctcgcgggagagcagcgcccaccaggcgtcgagagtcgggtttttcgccagcatcacgaaatcaatgtcgctgtagactttgcgccagcgggcggcgagcgccatcatgcgcaccgaatccagaccgtaatcgatcaggttgtcatcatccagcggcacgtcggattcatccagcagcggcaggatctgcgcacgcagcgcgtccttagtcagcggtaccggcagcagttcgtcggtcatcaccacgcggcctgaacgtccggccacgtagttgagcgccatcaggtgctcgtcgcggctgaaatccgccagcgcatcggcgaccataaacggcttgatgtcgcgcataaaggcatcggtggcggtggtcatgcagccgatgtgggcatacacgccggtgatcagcagctggttacgcccggtctctttcagcatctgctcaagcggcgagcggtgaaacgcgctgtagcgccacttcaccagcacggtgtcgtctgcgtcaggcgcaagggccgccaccacctgttgttcttccggtttgcgggtcaggcccggcccccacatgtcgttcagcagcgcgcgatcttcgtcgctctgctctttgggctgcgcggtgtaataaaccggaatgccctgctgtttgcagaactggcgcagcgcggcgatgttcgccaccacctgctccatcatcgggcagttatcgccccagaaattgatgaaatagtcctgcatatcgtggataagcaatgcggcgcgctcaggctcaaaggcccagttcactttgttgttcgggatctctgccgcggcgggcagcgcatagccggttaatttcgggatagccatctcttctccagtgttacgcctgtgacttttcagccagcatctgacgcagtttcttcttatcaactttgccgaccggggtcagcggcagcgcgtccacgcactccacgcgatccggcagcttaaattccgccacgccctgctcgcgcagaaaacgtcgtatctccaccggacgcaccggctggcgcaccaccagatacgcgcagcttttctcgcccagcaggctgtcttccatgctcaccagcgcggcgtggatcaccgccggatggcgcagcagcaggttttcaatctcttcggcagcgattttctctccgccgcggttaatctgatctttttcgcgcccctgcacggtgatatagccgtcggcgtcaatggagatcagatcgccggagctgtaaaaaccgttggcgtcgaaggcgctggcattgtgctccgggctgttaaagtagccgcggaaggtatagggcccgcgggtcatcaggcggcccacctccccggtcggcagcggattgccctgttcatcggcgacccacacttcatcgtccgggcacatcgggcggccctgggtgtggttcacccgcgccgggccatcatccaggcgggtatagttcaccagcccttccgccatgccgaacacctgctgtaactgacagccgatctccgccggaatacgcgcggcaagggtggcggacagacgcgcgccgcccacctgcaacagcttcagcgacgccagctgcgcattgctgccccactcggcaattgcctgcaaccacaggctgacggcgggcggtaccagcgcggtgacgttaatctgatgtttttcgatcagcgggaagcagagcgtggcgcttggatccgccgccagcaccacacagccttctgcgagaaatacccccagcgcgccgggggagctgagcggatagttatgggcggcaggcagcgcgcacagatagcgcgtgtcggcggtaaattcacagatctcgttgctgcggcggatactgtagtagtaatcgttatgagtgcgcgggatcagcttcggcgtgccggtactgccgccggatagctggaaaaacgccacttcatcggcaggggtcggcaacagaggcgtaccgtccgccgggcgttcaatggccgcctgtaaggcatgttcgccctggtcgttacgcaacagcaccacgcgcacgctggcatgttcggcgacaaagccattcaggaagctgtcatcctggaacagtttatgttcgcgatcggcgatcaccagcgccgggcggatctgcgcggcataggcgttgagttcactctgctgatggctgaagagcgcattgaccggcgcgacgcccattttcagcagcgcaaaaaaggtaatgtaaaactccgcgacgttgcccagctgcaccagcgcggtgtcgccatggcgaatgccctgcgccgtcagcgcgcaggcgaggttatccgacgcctgatccagctcgcggtagcttaacgcgcgctcgccttcaatcaccgccgtgcggtcagactgcccatgacgggtgagaatgtcggtcagcggcagatcctgccagtagcctttttcacgataacggcgggcgaagtcatccggccagcgggtaaaaggaagggtcatgatcgctccttaattcagaccaaaaacattaagcatggtggagagtttgacgccggtttcgcgccactccgccgccggggacgacgcaggcacaatgcccgccccggcaaacaggcgaacgttacgatcctggatgcgcgcgcagcgaatggtcaccacccactcgccattgccctgctcatcacaccagccgacgatgccgccgaacagctcgcggttgaacggctcaagttccgcgatgacgcgcttcgccacctgatgcgggaagccgctcagcgccggggtcgggtgcagcagacaggccagcgacagggcgttttcttcaccggcggcgagaccttcgaccggcgtcgccagatgccacagcgtcggggtattcaccagttgcggcgaggcggggatcgccagttcacggctgcgcggcgtgagcacggttttcatcgcctgcaccaccagatcgtgttcgtgacgatctttttccgaggccagcagtttgttaccggcctcgcgatccagcatgtcatccggctgacgacgggccgagcctgccagcggcagcgaactgaaccgctcatcttctttacgcagcagcagctccgggctggcaccgagcagcacgccgccatccggcagcggcacatggaagttaaagctcgccggattctgcgcgatcagccgttccagcagcgccccgctgtcaatccgggcgtcggtggcaatgtcaatcagtcgcgagagcaccaccttgtcaacggtcggcgtggcggtcaggcgtgcggcttccgccaccatcgccataaaggcgtcctgctccggaatggcctggcgcgaaaccacgttcggcgtcgggctgccctggaaatagcgcgcggaatgctgctttgccggacgggtgaacgtctgccaggactgcggaataaagagcgccgacggctgcgtggtatcaaacgggatcgcccctaccatcaccggttttgcaatgccctgggctttcgcctgcgcaaaggccgccgccagtttgcgctggaacgggctttgcaggtcatcgccgttaacggcaggctctgagaagcgcgcaaagcagccggatgtggtaaagctgcggtacggcgacataaagaaaaaccggtcgggcgacaacgcgtctgtacgctgcgcgatcccctctgccactgacgtatccatatctttctccgaaaatgataaaggcattaagaataattatcatttatattttggtcggtaagctaaaagttattgtcagcagtgtcaactctggttgatgcaacttctgcggctaacgcttgcatccgcttcgcacaatgatgaaaatgagaagcattaactgcaataaatacaggataccacgccgtgagatttgcttcgttacgcctgcatgctgtgctggcgctcagccttttcgttttaggactttccgcaagccacgccgccggatggccgcgtcaggtgactgacagccggggcactcataccctggaaagcaaaccgctgcgtattgtctccaccagcgtgacgcttaccggatcgctgctcgccattgatgcgccggtaatagccagcggcgcgaccacgccgaataaccgctttgccgacgatcagggctttctgcgccagtgggggcagatagcaaaacagcgtcaggtttcccggctctacattggcgaggccagcgcggaagccgtggcggcgcagatgcccgatttgatcctcgtcagcgccaccggcggcgactctgcgctggcgttgtacgatcagttctccgccatcgcgccgacgctggtcatcaattacgacgataaaagctggcaggcgctgctgacgcagctcggcgagatcaccggccaggagaaacaggcgcaggcgcgcatcgacgaattcaatacgcagctggcggcggtaaagcagaagatcaccctgccgccgcagccggtaagcgcgctggtttatcaccgggcggcgcacagcgccaatctgtggacccgcgattccgcgcaggggcagctgttagcccagcttggctttacgctcgccaccctgccggaggggctgaacgccagccagagccagggtaaacgccatgacatcgtgcagctgggcggcgaaaatctggcggcggggctgaacggcgaagcgctgtttttattcgccaatgacgacaacgacgccgcggccattgaagccaacccgctgttaagtcatctcagcgcggtgaaaaacaaacgcgtttacgcgctgggcagtgaaaccttccgcctcgacttttacagcgtgacgctgctgcttcagcggttcgccacgctgtttggctgatggaaacggcgtaactctttcagtagcaccaccagcagcagtccgatgaccgccagcacccagccgccaacactggcggaggccgctggcgtcatcagcgcccccataccgccgagcagtgccgcgccgatagcatcgccggtgacgttctgcgccgtccataagccgttaatgcgcccgagcatcgcctcgggggtttgcgtctggatcagcgtgtactgcaacagcgaactcaccgcgctcagccagccaaagagcgcgaggaacaacacccccagcccccagacgggcatcaggctgaacagcgccaccgccacaaaggcggcgacggtggtcaacagcatgatcgcccccggacgcgcacgctgcgccatattgccgctggtcagcgcccccagcgccgcaccgagcggaacggcggcatacaacaggccgatttccgacggcgacatttgccagttcaccgccagcgccggataaagcacgcgcacggcgctcgccatggtcagcagcccgccgagcagcgcgatgccgccgatcagcggactgcgcattaaaaactgaaaggccgccagcagggatttcagcggatgttcccgcggctgcggcggcggaggcagcaagggtaaacgcagcagcgtcagggtggtgagaaaggtccccgccgccgccagcccgtagttccacaccacaccgccggacgccagcagcaggccgccgcacagcggggagatcactgagcccaggcgtacggtcagcatggtgatcgcccccgcctgcatcagattctcacgcccgaccagcgcgggcgtcgccgccagcagcgccgtcacgccgagcgcgccaaaaaagccgtcccacaaaccgagcagataaatcgccaccagcgagggttccggcagcgccgcattaatggcaaggccgataaaacccagcccgcaggtgccgcgcgcgatcaggatcaggcgcttacgctcatagcgatccgccagcacgccgcccaccatcagcccgacaaacatcgccccgccggtcagggtgaccgcaaggcccaccagcgcgctggagtgggtcatcgcctggatctgcaccggcacgccgacgcccagcaaaccgagggataaaatggagataaaacgggcgataaataccgcgcggaatgccgggtgggttttcagcaggctcatgttgagcagccaggattgtcggttcattacagggccttttattgcgatttctcataccttttcaatggccgcacatgctaacatacccgaacaagatcgataacgataactactatcattatcaactcaaggacgttgtgatgtctttttcgctcagcctggcgcgtccaattatcgtgaccgggttattgttattgctgctccttgcggctgcgctcagcttacttatcggggcgaaacccctgcccttttccgccgtcatggacgccttcacgggcagctgccagaccgcggactgcactatcgtgctggatgcccgtctgccccgtaccctggccggactgctggctggcggcgcgctgggccttgccggggcgctgatgcaaaccctgacccgcaacccgctggccgatcccggtctgctcggcgtgaacgctggcgccagcttcgccatcgtgctgggcgcggcgctgctcggtttaacctctccctatgaacagctggcattggcctttagcggcgcgctggcggcgtcattagtggtggcctttaccggcagcgcgggcggcgggcagctcagcccggtgcggctgacgctggcgggcgtcgcgctgggcgcggtgctggaaggtttatccagcggcatcgcgctgctgaaccccgatgtttacgatcagctgcgcttctggcaggccggatcgctggacgtgcggcagatccacaccctgaaaatcgtcctgctgccggtactgatcgccgcaggcatcacgctgctgcaaagccgggcgctgaacagtctcagtctcggcacggataccgccacggcgctcggtagccgcgtggcgcgcacgcagttgctgggcttactggcaattaccgtgctgtgcggcagcgccacggcggtggtcggcccgattgcctttatcggcctgatgatgccgcacatggcgcgctggctggtgggggcggatcaccgctggtcgctgccggtcacgctgatcgccacccctgccctgctgctgtttgccgatgttattggccgtctgctggtgcccggcgagctgcgggtatcggtggtcagcgcctttatcggcgcgcctgtgcttatctggctggttcgccgccatcgtcgcggaggtggctggtgaacgccccttcccgtcgtctgattttgagctgtctgctgctggcgatcgcctgtctgctggtggcgctatggagtctgcaaagcggcgcggtgccgctgacgttttctcaggtatttgccgccctcaccggcgatgcgccgcgcggtattatgctggtggtcaatgagtggcgtctgccacgtgtcgtcatcgccctgctgaccggcgcggcgctggggatcagcggggccattttccagtcgctgatgcgtaacccgctcggcagcccggacgtgatgggctttaacaccggggcatggagcggcgtgctgatcgccatggtatttttcggccagcatctgacggccattgcgctggcggcgatggcgggcggtattctcacctcgctggtggtctggctgctggcgtggcgcaacggcattgaaaccttccggctgattattatcggcatcggcgtgcgcgccatgctggtggccttcaatacctggctgctgttgcaggcgtcccttgagacggcctttaccgccgggctgtggaacgccggatcgctcaatggcctgacgtgggcgaaaaccctgcccgccgcgccggtactgctggtgatgtttgtctgcgccgcgctgctggtacgccgtatgcggctactggaaatgggcgatgacagcgcctgtgcgctgggggtcagcgttgagcgttcccgcctgctgatgatgctggtggcggtggtgctgaccgccgcctccaccgccctgaccggcccgatctcttttattgcgctggtcgccccgcacatcgcgcggcgtatcagcggcaccgcgcgctgggggctgacccaggcggcactgtgcggcgcattgctgttgctggccgccgatctctgcgcccagcggctgtttgtaccctatcaacttccggtcggcgtggtgaccgtgagcctgggcgggatttatctcatcgccctgttaattaaggagtcccgcaaaagatgactttctcagatgcccgtttgcgcggcgaggccttaaccctcggctatggcaaaaaaatcgttgccgaaaacctgaacgtcactctgcccgacgggcatttcaccgccattatcggccccaacggctgcggaaaatcgacgctgctgcgcaccttaagccgcctgatgaccccggcgcaggggcatgtttatctcgacggcgagcagatccagcgtttcaacagtaaagaggtggcccgccgcattggactactggcgcagaacgccaccacgccgggggatattacggttcaggagctggtggtgcgcgggcgctatccgcatcagccgctgtttacccgctggcgggcagaggatgacgcggcggtgcaacgagcgatggaggccaccggcgttacggcgctggccgggcagagcgtggacacgctttccggcgggcagcgtcagcgggcgtggatcgctatggtgctggcgcaggaaacggcgatcatgctgctggatgagccgaccacctggctggacatcagctatcagattgacgtgctggagctgttaagcgagctgaaccgcgagcagggctatacgctggccgccgtgctgcacgatctcaatcaggcctgtcgctatgccacgcatctgattgcgctgcgggacgggaagattgtggcgcagggcgcgccgaaagagattgtgacggcggatctgatcgagaaaatttacgggatgcgttgcgtgattattgaggatccggtggcccatacgccgctggtggtgccgctcgggcgcgggctacggtaggtttgctgcgcccggcggcgctgcgcttgcacgggcctacagtagcctcattccgtaggcccggtaagcgcagcgccaccgggcaaaaacttagtgagaaggttccagcgtcagttccggcgtcagcgtgcg

(The sequence listing continues in the following parts.)

We claim:

1. A method for increasing salt tolerance in a plant comprising: treating a plant grown under salt stress with an amount of 2-keto-4-methylthiobutyric acid effective to increase salt tolerance in the plant relative to an untreated plant.

2. The method of claim 1, wherein the amount of 2-keto-4-methylthiobutyric acid is in solution.

3. The method of claim 1, wherein the solution is an aqueous solution.

4. The method of claim 1, wherein the amount of 2-keto-4-methylthiobutyric acid is in water.

5. The method of claim 2, wherein the solution comprises 1.0 to 10% salt, optionally, wherein the salt is selected from the group consisting of salts of sodium, chloride, sulfate, magnesium, calcium, potassium, and combinations thereof.

6. The method of claim 5, wherein the solution comprises 3.5% salt.

7. The method of claim 1, wherein the salt stress is provided by growing the plant under conditions selected from the group consisting of sodic soil and aqueous saline solution, and combinations thereof.

8. The method of claim 1, wherein the 2-keto-4-methylthiobutyric acid is present at a concentration of 1.0 to 250 nM.

9. The method of claim 8, wherein the 2-keto-4-methylthiobutyric acid is present at a concentration of at least 100 nM.

10. The method of claim 7, comprising growing a seed or the plant in a plant substrate, wherein the plant substrate comprises an effective amount of SA187 to colonize the seed or a root of the plant to provide abiotic stress resistance to the seed or plant.

11. A method of increasing salt tolerance in a plant comprising treating the plant with a composition comprising an amount of 2-keto-4-methylthiobutyric acid effective to increase salt tolerance in the plant relative to an untreated plant, wherein the 2-keto-4-methylthiobutyric acid is in salt water.

12. The method of claim 11, further comprising inoculating the plant with a microbial system to produce 2-keto-4-methylthiobutyric in the plant.

13. The method of claim 12, wherein the microbial system comprises an effective amount of SA187 to colonize plant seed or a root of the plant to provide abiotic stress resistance to the seed or plant;

or a bacterium genetically engineered to overexpress express L-amino acid deaminase (L-AAD) from Proteus vulgaris or one or more genes from the methionine salvage pathway selected from the group consisting of mtnN (EC 3.2.2.16), tyrB encoding a wide spectrum aminotransferase, mtnA, encoding MtnA (methylthioribose-1-phosphate isomerase), mtnB, encoding a methylthioribulose-1-phosphate dehydratase; mtnC, encoding an enolase-phosphatase, mtnD (ykrZ), encodiong an aci-reductone dioxygenase; mtnK, encoding a methylthioribose kinase; metK, enclodig S-adenosylmethionine (SAM) synthetase; speE encoding a spermidine synthetase; and speD, encoding an S-adenosylmethionine decarboxylase.

14. The method of claim 11, wherein the plant is a forage crop.

15. The method of claim 11, wherein salt tolerance is determined by fresh weight of seedling shoots, seedling roots, and/or dry weight of seedlings.

16. The method of claim 11, wherein the composition comprises 1.0 to 10% salt solution.

17. A method for cultivating a plant comprising:
planting seeds or seedlings of the plant; and
irrigating the seeds or seedlings with a saline solution comprising 2-keto-4-methylthiobutyric acid.

18. The method of claim 17, wherein the plant is selected from the group consisting of rice, wheat, sugarcane, maize, soybean, cotton, vegetables, rape, mustard, sorghum, millet, grass, Brassica spp., rapeseed, barley, hay, and alfalfa.

19. An agricultural irrigation solution comprising: 1.0 to 250 nM 2-keto-4-methylthiobutyric acid in an aqueous saline solution.

20. The solution of claim 19, wherein the aqueous saline solution comprises at least 3% salt.

21. The irrigation solution-of claim 19, wherein the aqueous saline solution comprises 1 to 10% salt.

22. A method of for increasing salt tolerance in a plant comprising growing the plant in a plant substrate comprising the irrigation solution of claim 19.

23. The method of claim 22, wherein the plant substrate is selected from the group consisting of soil, peat, compost, vermiculite, perlite, sand, and clay, and combinations thereof.

24. The solution of claim 19, in a plant substrate selected from the group consisting of soil, peat, compost, vermiculite, perlite, sand, and clay, and combinations thereof.

25. An agricultural composition comprising:
2-keto-4-methylthiobutyric acid in an aqueous saline solution and plant seeds, plant seedlings or mature plants, wherein the 2-keto-4-methylthiobutyric acid is
in an effective amount to increase salt tolerance in the plant seeds, plant seedlings or mature plants relative to untreated plant seeds, plant seedlings or mature plant.

26. The composition of claim 25, comprising the 2-keto-4-methylthiobutyric acid in an aqueous saline solution, and plant seeds, plant seedlings or mature plants.

* * * * *